United States Patent 8,097,712 (COMPOSITIONS FOR CONFERRING TOLERANCE TO VIRAL DISEASE IN SOCIAL INSECTS, AND THE USE THEREOF) - sequence listing, part 2

SEQ ID NO: 30532 - DNA, 21 bp, Artificial sequence
  SiRNA target sequence
ccagaaaatgctttgatccgt

SEQ ID NO: 30533 - DNA, 21 bp, Artificial sequence
  SiRNA target sequence
cagaaaatgctttgatccgtc

SEQ ID NO: 30534 - DNA, 21 bp, Artificial sequence
  SiRNA target sequence
agaaaatgctttgatccgtca

SEQ ID NO: 30535 - DNA, 21 bp, Artificial sequence
  SiRNA target sequence
gaaaatgctttgatccgtcat

SEQ ID NO: 30536 - DNA, 21 bp, Artificial sequence
  SiRNA target sequence
aaaatgctttgatccgtcatg

SEQ ID NO: 30537 - DNA, 21 bp, Artificial sequence
  SiRNA target sequence
aaatgctttgatccgtcatgt

SEQ ID NO: 30538 - DNA, 21 bp, Artificial sequence
  SiRNA target sequence
aatgctttgatccgtcatgta

SEQ ID NO: 30539 - DNA, 21 bp, Artificial sequence
  SiRNA target sequence
atgctttgatccgtcatgtat

SEQ ID NO: 30540 - DNA, 21 bp, Artificial sequence
  SiRNA target sequence
tgctttgatccgtcatgtatt

SEQ ID NO: 30541 - DNA, 21 bp, Artificial sequence
  SiRNA target sequence
gctttgatccgtcatgtatta

SEQ ID NO: 30542 - DNA, 21 bp, Artificial sequence
  SiRNA target sequence
ctttgatccgtcatgtattat

SEQ ID NO: 30543 - DNA, 21 bp, Artificial sequence
  SiRNA target sequence
tttgatccgtcatgtattatt

SEQ ID NO: 30544 - DNA, 21 bp, Artificial sequence
  SiRNA target sequence
ttgatccgtcatgtattattg

SEQ ID NO: 30545 - DNA, 21 bp, Artificial sequence
  SiRNA target sequence
tgatccgtcatgtattattgg

SEQ ID NO: 30546 - DNA, 21 bp, Artificial sequence
  SiRNA target sequence
gatccgtcatgtattattggt

SEQ ID NO: 30547 - DNA, 21 bp, Artificial sequence
  SiRNA target sequence
atccgtcatgtattattggtg

SEQ ID NO: 30548 - DNA, 21 bp, Artificial sequence
  SiRNA target sequence
tccgtcatgtattattggtgg

SEQ ID NO: 30549 - DNA, 21 bp, Artificial sequence
  SiRNA target sequence
ccgtcatgtattattggtgga

SEQ ID NO: 30550 - DNA, 21 bp, Artificial sequence
  SiRNA target sequence
cgtcatgtattattggtggat

SEQ ID NO: 30551 - DNA, 21 bp, Artificial sequence
  SiRNA target sequence
gtcatgtattattggtggatg

SEQ ID NO: 30552 - DNA, 21 bp, Artificial sequence
  SiRNA target sequence
tcatgtattattggtggatgt

SEQ ID NO: 30553 - DNA, 21 bp, Artificial sequence
  SiRNA target sequence
catgtattattggtggatgtg

SEQ ID NO: 30554 - DNA, 21 bp, Artificial sequence
  SiRNA target sequence
atgtattattggtggatgtgt

SEQ ID NO: 30555 - DNA, 21 bp, Artificial sequence
  SiRNA target sequence
tgtattattggtggatgtgta

SEQ ID NO: 30556 - DNA, 21 bp, Artificial sequence
  SiRNA target sequence
gtattattggtggatgtgtac

SEQ ID NO: 30557 - DNA, 21 bp, Artificial sequence
  SiRNA target sequence
tattattggtggatgtgtaca

SEQ ID NO: 30558 - DNA, 21 bp, Artificial sequence
  SiRNA target sequence
attattggtggatgtgtacaa

SEQ ID NO: 30559 - DNA, 21 bp, Artificial sequence
  SiRNA target sequence
ttattggtggatgtgtacaat

SEQ ID NO: 30560 - DNA, 21 bp, Artificial sequence
  SiRNA target sequence
tattggtggatgtgtacaatt

SEQ ID NO: 30561 - DNA, 21 bp, Artificial sequence
  SiRNA target sequence
attggtggatgtgtacaattc

SEQ ID NO: 30562 - DNA, 21 bp, Artificial sequence
  SiRNA target sequence
ttggtggatgtgtacaattct

SEQ ID NO: 30563 - DNA, 21 bp, Artificial sequence
  SiRNA target sequence
tggtggatgtgtacaattctg

SEQ ID NO: 30564 - DNA, 21 bp, Artificial sequence
  SiRNA target sequence
ggtggatgtgtacaattctgt

SEQ ID NO: 30565 - DNA, 21 bp, Artificial sequence
  SiRNA target sequence
gtggatgtgtacaattctgtg

SEQ ID NO: 30566 - DNA, 21 bp, Artificial sequence
  SiRNA target sequence
tggatgtgtacaattctgtgc

SEQ ID NO: 30567 - DNA, 21 bp, Artificial sequence
  SiRNA target sequence
ggatgtgtacaattctgtgca

SEQ ID NO: 30568 - DNA, 21 bp, Artificial sequence
  SiRNA target sequence
gatgtgtacaattctgtgcat

SEQ ID NO: 30569 - DNA, 21 bp, Artificial sequence
  SiRNA target sequence
atgtgtacaattctgtgcata

SEQ ID NO: 30570 - DNA, 21 bp, Artificial sequence
  SiRNA target sequence
tgtgtacaattctgtgcatat

SEQ ID NO: 30571 - DNA, 21 bp, Artificial sequence
  SiRNA target sequence
gtgtacaattctgtgcatatt

SEQ ID NO: 30572 - DNA, 21 bp, Artificial sequence
  SiRNA target sequence
tgtacaattctgtgcatattt

SEQ ID NO: 30573 - DNA, 21 bp, Artificial sequence
  SiRNA target sequence
gtacaattctgtgcatatttg

SEQ ID NO: 30574 - DNA, 21 bp, Artificial sequence
  SiRNA target sequence
tacaattctgtgcatatttgt

SEQ ID NO: 30575 - DNA, 21 bp, Artificial sequence
  SiRNA target sequence
acaattctgtgcatatttgta

SEQ ID NO: 30576 - DNA, 21 bp, Artificial sequence
  SiRNA target sequence
caattctgtgcatatttgtaa

SEQ ID NO: 30577 - DNA, 21 bp, Artificial sequence
  SiRNA target sequence
aattctgtgcatatttgtaat

SEQ ID NO: 30578 - DNA, 21 bp, Artificial sequence
  SiRNA target sequence
attctgtgcatatttgtaatg

SEQ ID NO: 30579 - DNA, 21 bp, Artificial sequence
  SiRNA target sequence
ttctgtgcatatttgtaatga

SEQ ID NO: 30580 - DNA, 21 bp, Artificial sequence
  SiRNA target sequence
tctgtgcatatttgtaatgac

SEQ ID NO: 30581 - DNA, 21 bp, Artificial sequence
  SiRNA target sequence
ctgtgcatatttgtaatgact

SEQ ID NO: 30582 - DNA, 21 bp, Artificial sequence
  SiRNA target sequence
tgtgcatatttgtaatgactc

SEQ ID NO: 30583 - DNA, 21 bp, Artificial sequence
  SiRNA target sequence
gtgcatatttgtaatgactca

SEQ ID NO: 30584 - DNA, 21 bp, Artificial sequence
  SiRNA target sequence
tgcatatttgtaatgactcag

SEQ ID NO: 30585 - DNA, 21 bp, Artificial sequence
  SiRNA target sequence
gcatatttgtaatgactcagt

SEQ ID NO: 30586 - DNA, 21 bp, Artificial sequence
  SiRNA target sequence
catatttgtaatgactcagta

SEQ ID NO: 30587 - DNA, 21 bp, Artificial sequence
  SiRNA target sequence
atatttgtaatgactcagtat

SEQ ID NO: 30588 - DNA, 21 bp, Artificial sequence
  SiRNA target sequence
tatttgtaatgactcagtata

SEQ ID NO: 30589 - DNA, 21 bp, Artificial sequence
  SiRNA target sequence
atttgtaatgactcagtatac

SEQ ID NO: 30590 - DNA, 21 bp, Artificial sequence
  SiRNA target sequence
tttgtaatgactcagtataca

SEQ ID NO: 30591 - DNA, 21 bp, Artificial sequence
  SiRNA target sequence
ttgtaatgactcagtatacat

SEQ ID NO: 30592 - DNA, 21 bp, Artificial sequence
  SiRNA target sequence
tgtaatgactcagtatacatg

SEQ ID NO: 30593 - DNA, 21 bp, Artificial sequence
  SiRNA target sequence
gtaatgactcagtatacatga

SEQ ID NO: 30594 - DNA, 21 bp, Artificial sequence
  SiRNA target sequence
taatgactcagtatacatgat

SEQ ID NO: 30595 - DNA, 21 bp, Artificial sequence
  SiRNA target sequence
aatgactcagtatacatgatg

SEQ ID NO: 30596 - DNA, 21 bp, Artificial sequence
  SiRNA target sequence
atgactcagtatacatgatga

SEQ ID NO: 30597 - DNA, 21 bp, Artificial sequence
  SiRNA target sequence
tgactcagtatacatgatgac

SEQ ID NO: 30598 - DNA, 21 bp, Artificial sequence
  SiRNA target sequence
gactcagtatacatgatgact

SEQ ID NO: 30599 - DNA, 21 bp, Artificial sequence
  SiRNA target sequence
actcagtatacatgatgactc

SEQ ID NO: 30600 - DNA, 21 bp, Artificial sequence
  SiRNA target sequence
ctcagtatacatgatgactca

SEQ ID NO: 30601 - DNA, 21 bp, Artificial sequence
  SiRNA target sequence
tcagtatacatgatgactcat

SEQ ID NO: 30602 - DNA, 21 bp, Artificial sequence
  SiRNA target sequence
cagtatacatgatgactcata

SEQ ID NO: 30603 - DNA, 21 bp, Artificial sequence
  SiRNA target sequence
agtatacatgatgactcatag

SEQ ID NO: 30604 - DNA, 21 bp, Artificial sequence
  SiRNA target sequence
gtatacatgatgactcatagc

SEQ ID NO: 30605 - DNA, 21 bp, Artificial sequence
  SiRNA target sequence
tatacatgatgactcatagcc

SEQ ID NO: 30606 - DNA, 21 bp, Artificial sequence
  SiRNA target sequence
atacatgatgactcatagcca

SEQ ID NO: 30607 - DNA, 21 bp, Artificial sequence
  SiRNA target sequence
tacatgatgactcatagccaa

SEQ ID NO: 30608 - DNA, 21 bp, Artificial sequence
  SiRNA target sequence
acatgatgactcatagccaac

SEQ ID NO: 30609 - DNA, 21 bp, Artificial sequence
  SiRNA target sequence
catgatgactcatagccaacc

SEQ ID NO: 30610 - DNA, 21 bp, Artificial sequence
  SiRNA target sequence
atgatgactcatagccaaccc

SEQ ID NO: 30611 - DNA, 21 bp, Artificial sequence
  SiRNA target sequence
tgatgactcatagccaaccca

SEQ ID NO: 30612 - DNA, 21 bp, Artificial sequence
  SiRNA target sequence
gatgactcatagccaacccac

SEQ ID NO: 30613 - DNA, 21 bp, Artificial sequence
  SiRNA target sequence
atgactcatagccaacccaca

SEQ ID NO: 30614 - DNA, 21 bp, Artificial sequence
  SiRNA target sequence
aatcgctgcaaacgatgattt

SEQ ID NO: 30615 - DNA, 21 bp, Artificial sequence
  SiRNA target sequence
atcgctgcaaacgatgatttt

SEQ ID NO: 30616 - DNA, 21 bp, Artificial sequence
  SiRNA target sequence
tcgctgcaaacgatgattttg

SEQ ID NO: 30617 - DNA, 21 bp, Artificial sequence
  SiRNA target sequence
cgctgcaaacgatgattttgc

SEQ ID NO: 30618 - DNA, 21 bp, Artificial sequence
  SiRNA target sequence
gctgcaaacgatgattttgca

SEQ ID NO: 30619 - DNA, 21 bp, Artificial sequence
  SiRNA target sequence
ctgcaaacgatgattttgcaa

SEQ ID NO: 30620 - DNA, 21 bp, Artificial sequence
  SiRNA target sequence
tgcaaacgatgattttgcaat

SEQ ID NO: 30621 - DNA, 21 bp, Artificial sequence
  SiRNA target sequence
gcaaacgatgattttgcaatt

SEQ ID NO: 30622 - DNA, 21 bp, Artificial sequence
  SiRNA target sequence
caaacgatgattttgcaattg

SEQ ID NO: 30623 - DNA, 21 bp, Artificial sequence
  SiRNA target sequence
aaacgatgattttgcaattga

SEQ ID NO: 30624 - DNA, 21 bp, Artificial sequence
  SiRNA target sequence
aacgatgattttgcaattgag

SEQ ID NO: 30625 - DNA, 21 bp, Artificial sequence
  SiRNA target sequence
acgatgattttgcaattgagg

SEQ ID NO: 30626 - DNA, 21 bp, Artificial sequence
  SiRNA target sequence
cgatgattttgcaattgaggg

SEQ ID NO: 30627 - DNA, 21 bp, Artificial sequence
  SiRNA target sequence
gatgattttgcaattgaggga

SEQ ID NO: 30628 - DNA, 21 bp, Artificial sequence
  SiRNA target sequence
atgattttgcaattgagggaa

SEQ ID NO: 30629 - DNA, 21 bp, Artificial sequence
  SiRNA target sequence
tgattttgcaattgagggaag

SEQ ID NO: 30630 - DNA, 21 bp, Artificial sequence
  SiRNA target sequence
gattttgcaattgagggaagt

SEQ ID NO: 30631 - DNA, 21 bp, Artificial sequence
  SiRNA target sequence
attttgcaattgagggaagtg

SEQ ID NO: 30632 - DNA, 21 bp, Artificial sequence
  SiRNA target sequence
ttttgcaattgagggaagtgc

SEQ ID NO: 30633 - DNA, 21 bp, Artificial sequence
  SiRNA target sequence
tttgcaattgagggaagtgcc

SEQ ID NO: 30634 - DNA, 21 bp, Artificial sequence
  SiRNA target sequence
ttgcaattgagggaagtgcct

SEQ ID NO: 30635 - DNA, 21 bp, Artificial sequence
  SiRNA target sequence
tgcaattgagggaagtgcctg

SEQ ID NO: 30636 - DNA, 21 bp, Artificial sequence
  SiRNA target sequence
gcaattgagggaagtgcctgc

SEQ ID NO: 30637 - DNA, 21 bp, Artificial sequence
  SiRNA target sequence
caattgagggaagtgcctgca

SEQ ID NO: 30638 - DNA, 21 bp, Artificial sequence
  SiRNA target sequence
aattgagggaagtgcctgcaa

SEQ ID NO: 30639 - DNA, 21 bp, Artificial sequence
  SiRNA target sequence
attgagggaagtgcctgcaac

SEQ ID NO: 30640 - DNA, 21 bp, Artificial sequence
  SiRNA target sequence
ttgagggaagtgcctgcaaca

SEQ ID NO: 30641 - DNA, 21 bp, Artificial sequence
  SiRNA target sequence
tgagggaagtgcctgcaacat

SEQ ID NO: 30642 - DNA, 21 bp, Artificial sequence
  SiRNA target sequence
gagggaagtgcctgcaacatg

SEQ ID NO: 30643 - DNA, 21 bp, Artificial sequence
  SiRNA target sequence
agggaagtgcctgcaacatga

SEQ ID NO: 30644 - DNA, 21 bp, Artificial sequence
  SiRNA target sequence
gggaagtgcctgcaacatgaa

SEQ ID NO: 30645 - DNA, 21 bp, Artificial sequence
  SiRNA target sequence
ggaagtgcctgcaacatgaat

SEQ ID NO: 30646 - DNA, 21 bp, Artificial sequence
  SiRNA target sequence
gaagtgcctgcaacatgaatc

SEQ ID NO: 30647 - DNA, 21 bp, Artificial sequence
  SiRNA target sequence
aagtgcctgcaacatgaatcc

SEQ ID NO: 30648 - DNA, 21 bp, Artificial sequence
  SiRNA target sequence
agtgcctgcaacatgaatccg

SEQ ID NO: 30649 - DNA, 21 bp, Artificial sequence
  SiRNA target sequence
gtgcctgcaacatgaatccgg

SEQ ID NO: 30650 - DNA, 21 bp, Artificial sequence
  SiRNA target sequence
tgcctgcaacatgaatccggg

SEQ ID NO: 30651 - DNA, 21 bp, Artificial sequence
  SiRNA target sequence
gcctgcaacatgaatccggga

SEQ ID NO: 30652 - DNA, 21 bp, Artificial sequence
  SiRNA target sequence
cctgcaacatgaatccgggaa

SEQ ID NO: 30653 - DNA, 21 bp, Artificial sequence
  SiRNA target sequence
ctgcaacatgaatccgggaaa

SEQ ID NO: 30654 - DNA, 21 bp, Artificial sequence
  SiRNA target sequence
tgcaacatgaatccgggaaaa

SEQ ID NO: 30655 - DNA, 21 bp, Artificial sequence
  SiRNA target sequence
gcaacatgaatccgggaaaat

SEQ ID NO: 30656 - DNA, 21 bp, Artificial sequence
  SiRNA target sequence
caacatgaatccgggaaaatt

SEQ ID NO: 30657 - DNA, 21 bp, Artificial sequence
  SiRNA target sequence
aacatgaatccgggaaaatta

SEQ ID NO: 30658 - DNA, 21 bp, Artificial sequence
  SiRNA target sequence
acatgaatccgggaaaattaa

SEQ ID NO: 30659 - DNA, 21 bp, Artificial sequence
  SiRNA target sequence
catgaatccgggaaaattaaa

SEQ ID NO: 30660 - DNA, 21 bp, Artificial sequence
  SiRNA target sequence
atgaatccgggaaaattaaac

SEQ ID NO: 30661 - DNA, 21 bp, Artificial sequence
  SiRNA target sequence
tgaatccgggaaaattaaacc

SEQ ID NO: 30662 - DNA, 21 bp, Artificial sequence
  SiRNA target sequence
gaatccgggaaaattaaaccg

SEQ ID NO: 30663 - DNA, 21 bp, Artificial sequence
  SiRNA target sequence
aatccgggaaaattaaaccgc

SEQ ID NO: 30664 - DNA, 21 bp, Artificial sequence
  SiRNA target sequence
atccgggaaaattaaaccgcc

SEQ ID NO: 30665 - DNA, 21 bp, Artificial sequence
  SiRNA target sequence
tccgggaaaattaaaccgccg

SEQ ID NO: 30666 - DNA, 21 bp, Artificial sequence
  SiRNA target sequence
ccgggaaaattaaaccgccgg

SEQ ID NO: 30667 - DNA, 21 bp, Artificial sequence
  SiRNA target sequence
cgggaaaattaaaccgccgga

SEQ ID NO: 30668 - DNA, 21 bp, Artificial sequence
  SiRNA target sequence
gggaaaattaaaccgccggat

SEQ ID NO: 30669 - DNA, 21 bp, Artificial sequence
  SiRNA target sequence
ggaaaattaaaccgccggatc

SEQ ID NO: 30670 - DNA, 21 bp, Artificial sequence
  SiRNA target sequence
gaaaattaaaccgccggatca

SEQ ID NO: 30671 - DNA, 21 bp, Artificial sequence
  SiRNA target sequence
aaaattaaaccgccggatcac

SEQ ID NO: 30672 - DNA, 21 bp, Artificial sequence
  SiRNA target sequence
aaattaaaccgccggatcaca

SEQ ID NO: 30673 - DNA, 21 bp, Artificial sequence
  SiRNA target sequence
aattaaaccgccggatcacat

SEQ ID NO: 30674 - DNA, 21 bp, Artificial sequence
  SiRNA target sequence
attaaaccgccggatcacatt

SEQ ID NO: 30675 - DNA, 21 bp, Artificial sequence
  SiRNA target sequence
ttaaaccgccggatcacattt

SEQ ID NO: 30676 - DNA, 21 bp, Artificial sequence
  SiRNA target sequence
taaaccgccggatcacatttc

SEQ ID NO: 30677 - DNA, 21 bp, Artificial sequence
  SiRNA target sequence
aaaccgccggatcacatttca

SEQ ID NO: 30678 - DNA, 21 bp, Artificial sequence
  SiRNA target sequence
aaccgccggatcacatttcaa

SEQ ID NO: 30679 - DNA, 21 bp, Artificial sequence
  SiRNA target sequence
accgccggatcacatttcaaa

SEQ ID NO: 30680 - DNA, 21 bp, Artificial sequence
  SiRNA target sequence
ccgccggatcacatttcaaaa

SEQ ID NO: 30681 - DNA, 21 bp, Artificial sequence
  SiRNA target sequence
cgccggatcacatttcaaaag

SEQ ID NO: 30682 - DNA, 21 bp, Artificial sequence
  SiRNA target sequence
gccggatcacatttcaaaagc

SEQ ID NO: 30683 - DNA, 21 bp, Artificial sequence
  SiRNA target sequence
ccggatcacatttcaaaagca

SEQ ID NO: 30684 - DNA, 21 bp, Artificial sequence
  SiRNA target sequence
cggatcacatttcaaaagcac

SEQ ID NO: 30685 - DNA, 21 bp, Artificial sequence
  SiRNA target sequence
ggatcacatttcaaaagcacg

SEQ ID NO: 30686 - DNA, 21 bp, Artificial sequence
  SiRNA target sequence
gatcacatttcaaaagcacgg

SEQ ID NO: 30687 - DNA, 21 bp, Artificial sequence
  SiRNA target sequence
atcacatttcaaaagcacggt

SEQ ID NO: 30688 - DNA, 21 bp, Artificial sequence
  SiRNA target sequence
tcacatttcaaaagcacggtg

SEQ ID NO: 30689 - DNA, 21 bp, Artificial sequence
  SiRNA target sequence
cacatttcaaaagcacggtga

SEQ ID NO: 30690 - DNA, 21 bp, Artificial sequence
  SiRNA target sequence
acatttcaaaagcacggtgaa

SEQ ID NO: 30691 - DNA, 21 bp, Artificial sequence
  SiRNA target sequence
catttcaaaagcacggtgaaa

SEQ ID NO: 30692 - DNA, 21 bp, Artificial sequence
  SiRNA target sequence
atttcaaaagcacggtgaaac

SEQ ID NO: 30693 - DNA, 21 bp, Artificial sequence
  SiRNA target sequence
tttcaaaagcacggtgaaacg

SEQ ID NO: 30694 - DNA, 21 bp, Artificial sequence
  SiRNA target sequence
ttcaaaagcacggtgaaacga

SEQ ID NO: 30695 - DNA, 21 bp, Artificial sequence
  SiRNA target sequence
tcaaaagcacggtgaaacgac

SEQ ID NO: 30696 - DNA, 21 bp, Artificial sequence
  SiRNA target sequence
caaaagcacggtgaaacgacg

SEQ ID NO: 30697 - DNA, 21 bp, Artificial sequence
  SiRNA target sequence
aaaagcacggtgaaacgacga

SEQ ID NO: 30698 - DNA, 21 bp, Artificial sequence
  SiRNA target sequence
aaagcacggtgaaacgacgaa

SEQ ID NO: 30699 - DNA, 21 bp, Artificial sequence
  SiRNA target sequence
aagcacggtgaaacgacgaat

SEQ ID NO: 30700 - DNA, 21 bp, Artificial sequence
  SiRNA target sequence
agcacggtgaaacgacgaatg

SEQ ID NO: 30701 - DNA, 21 bp, Artificial sequence
  SiRNA target sequence
gcacggtgaaacgacgaatga

SEQ ID NO: 30702 - DNA, 21 bp, Artificial sequence
  SiRNA target sequence
cacggtgaaacgacgaatgaa

SEQ ID NO: 30703 - DNA, 21 bp, Artificial sequence
  SiRNA target sequence
acggtgaaacgacgaatgaaa

SEQ ID NO: 30704 - DNA, 21 bp, Artificial sequence
  SiRNA target sequence
cggtgaaacgacgaatgaaaa

SEQ ID NO: 30705 - DNA, 21 bp, Artificial sequence
  SiRNA target sequence
ggtgaaacgacgaatgaaaac

SEQ ID NO: 30706 - DNA, 21 bp, Artificial sequence
  SiRNA target sequence
gtgaaacgacgaatgaaaacg

SEQ ID NO: 30707 - DNA, 21 bp, Artificial sequence
  SiRNA target sequence
tgaaacgacgaatgaaaacgg

SEQ ID NO: 30708 - DNA, 21 bp, Artificial sequence
  SiRNA target sequence
gaaacgacgaatgaaaacggg

SEQ ID NO: 30709 - DNA, 21 bp, Artificial sequence
  SiRNA target sequence
aaacgacgaatgaaaacgggt

SEQ ID NO: 30710 - DNA, 21 bp, Artificial sequence
  SiRNA target sequence
aacgacgaatgaaaacgggtt

SEQ ID NO: 30711 - DNA, 21 bp, Artificial sequence
  SiRNA target sequence
acgacgaatgaaaacgggttt

SEQ ID NO: 30712 - DNA, 21 bp, Artificial sequence
  SiRNA target sequence
cgacgaatgaaaacgggttta

SEQ ID NO: 30713 - DNA, 21 bp, Artificial sequence
  SiRNA target sequence
gacgaatgaaaacgggtttaa

SEQ ID NO: 30714 - DNA, 21 bp, Artificial sequence
  SiRNA target sequence
acgaatgaaaacgggtttaaa

SEQ ID NO: 30715 - DNA, 21 bp, Artificial sequence
  SiRNA target sequence
cgaatgaaaacgggtttaaaa

SEQ ID NO: 30716 - DNA, 21 bp, Artificial sequence
  SiRNA target sequence
gaatgaaaacgggtttaaaac

SEQ ID NO: 30717 - DNA, 21 bp, Artificial sequence
  SiRNA target sequence
aatgaaaacgggtttaaaaca

SEQ ID NO: 30718 - DNA, 21 bp, Artificial sequence
  SiRNA target sequence
atgaaaacgggtttaaaacag

SEQ ID NO: 30719 - DNA, 21 bp, Artificial sequence
  SiRNA target sequence
tgaaaacgggtttaaaacaga

SEQ ID NO: 30720 - DNA, 21 bp, Artificial sequence
  SiRNA target sequence
gaaaacgggtttaaaacagat

SEQ ID NO: 30721 - DNA, 21 bp, Artificial sequence
  SiRNA target sequence
aaaacgggtttaaaacagatg

SEQ ID NO: 30722 - DNA, 21 bp, Artificial sequence
  SiRNA target sequence
aaacgggtttaaaacagatgg

SEQ ID NO: 30723 - DNA, 21 bp, Artificial sequence
  SiRNA target sequence
aacgggtttaaaacagatggc

SEQ ID NO: 30724 - DNA, 21 bp, Artificial sequence
  SiRNA target sequence
acgggtttaaaacagatggct

SEQ ID NO: 30725 - DNA, 21 bp, Artificial sequence
  SiRNA target sequence
cgggtttaaaacagatggctg

SEQ ID NO: 30726 - DNA, 21 bp, Artificial sequence
  SiRNA target sequence
gggtttaaaacagatggctgg

SEQ ID NO: 30727 - DNA, 21 bp, Artificial sequence
  SiRNA target sequence
ggtttaaaacagatggctggg

SEQ ID NO: 30728 - DNA, 21 bp, Artificial sequence
  SiRNA target sequence
gtttaaaacagatggctgggt

SEQ ID NO: 30729 - DNA, 21 bp, Artificial sequence
  SiRNA target sequence
tttaaaacagatggctgggtg

SEQ ID NO: 30730 - DNA, 21 bp, Artificial sequence
  SiRNA target sequence
ttaaaacagatggctgggtgg

SEQ ID NO: 30731 - DNA, 21 bp, Artificial sequence
  SiRNA target sequence
taaaacagatggctgggtgga

SEQ ID NO: 30732 - DNA, 21 bp, Artificial sequence
  SiRNA target sequence
aaaacagatggctgggtggat

SEQ ID NO: 30733 - DNA, 21 bp, Artificial sequence
  SiRNA target sequence
aaacagatggctgggtggatg

SEQ ID NO: 30734 - DNA, 21 bp, Artificial sequence
  SiRNA target sequence
aacagatggctgggtggatgt

SEQ ID NO: 30735 - DNA, 21 bp, Artificial sequence
  SiRNA target sequence
acagatggctgggtggatgtg

SEQ ID NO: 30736 - DNA, 21 bp, Artificial sequence
  SiRNA target sequence
cagatggctgggtggatgtgc

SEQ ID NO: 30737 - DNA, 21 bp, Artificial sequence
  SiRNA target sequence
agatggctgggtggatgtgca

SEQ ID NO: 30738 - DNA, 21 bp, Artificial sequence
  SiRNA target sequence
gatggctgggtggatgtgcag

SEQ ID NO: 30739 - DNA, 21 bp, Artificial sequence
  SiRNA target sequence
atggctgggtggatgtgcaga

SEQ ID NO: 30740 - DNA, 21 bp, Artificial sequence
  SiRNA target sequence
tggctgggtggatgtgcagac

SEQ ID NO: 30741 - DNA, 21 bp, Artificial sequence
  SiRNA target sequence
ggctgggtggatgtgcagacg

SEQ ID NO: 30742 - DNA, 21 bp, Artificial sequence
  SiRNA target sequence
gctgggtggatgtgcagacgg

SEQ ID NO: 30743 - DNA, 21 bp, Artificial sequence
  SiRNA target sequence
ctgggtggatgtgcagacggt

SEQ ID NO: 30744 - DNA, 21 bp, Artificial sequence
  SiRNA target sequence
tgggtggatgtgcagacggtt

SEQ ID NO: 30745 - DNA, 21 bp, Artificial sequence
  SiRNA target sequence
gggtggatgtgcagacggttt

SEQ ID NO: 30746 - DNA, 21 bp, Artificial sequence
  SiRNA target sequence
ggtggatgtgcagacggtttg

SEQ ID NO: 30747 - DNA, 21 bp, Artificial sequence
  SiRNA target sequence
gtggatgtgcagacggtttgg

SEQ ID NO: 30748 - DNA, 21 bp, Artificial sequence
  SiRNA target sequence
tggatgtgcagacggtttggg

SEQ ID NO: 30749 - DNA, 21 bp, Artificial sequence
  SiRNA target sequence
ggatgtgcagacggtttgggc

SEQ ID NO: 30750 - DNA, 21 bp, Artificial sequence
  SiRNA target sequence
gatgtgcagacggtttgggcg

SEQ ID NO: 30751 - DNA, 21 bp, Artificial sequence
  SiRNA target sequence
atgtgcagacggtttgggcgt

SEQ ID NO: 30752 - DNA, 21 bp, Artificial sequence
  SiRNA target sequence
tgtgcagacggtttgggcgtg

SEQ ID NO: 30753 - DNA, 21 bp, Artificial sequence
  SiRNA target sequence
gtgcagacggtttgggcgtgc

SEQ ID NO: 30754 - DNA, 21 bp, Artificial sequence
  SiRNA target sequence
tgcagacggtttgggcgtgca

SEQ ID NO: 30755 - DNA, 21 bp, Artificial sequence
  SiRNA target sequence
gcagacggtttgggcgtgcat

SEQ ID NO: 30756 - DNA, 21 bp, Artificial sequence
  SiRNA target sequence
cagacggtttgggcgtgcatc

SEQ ID NO: 30757 - DNA, 21 bp, Artificial sequence
  SiRNA target sequence
agacggtttgggcgtgcatca

SEQ ID NO: 30758 - DNA, 21 bp, Artificial sequence
  SiRNA target sequence
gacggtttgggcgtgcatcaa

SEQ ID NO: 30759 - DNA, 21 bp, Artificial sequence
  SiRNA target sequence
acggtttgggcgtgcatcaag

SEQ ID NO: 30760 - DNA, 21 bp, Artificial sequence
  SiRNA target sequence
cggtttgggcgtgcatcaaga

SEQ ID NO: 30761 - DNA, 21 bp, Artificial sequence
  SiRNA target sequence
ggtttgggcgtgcatcaagac

SEQ ID NO: 30762 - DNA, 21 bp, Artificial sequence
  SiRNA target sequence
gtttgggcgtgcatcaagacg

SEQ ID NO: 30763 - DNA, 21 bp, Artificial sequence
  SiRNA target sequence
tttgggcgtgcatcaagacgc

SEQ ID NO: 30764 - DNA, 21 bp, Artificial sequence
  SiRNA target sequence
ttgggcgtgcatcaagacgct

SEQ ID NO: 30765 - DNA, 21 bp, Artificial sequence
  SiRNA target sequence
tgggcgtgcatcaagacgctg

SEQ ID NO: 30766 - DNA, 21 bp, Artificial sequence
  SiRNA target sequence
gggcgtgcatcaagacgctga

SEQ ID NO: 30767 - DNA, 21 bp, Artificial sequence
  SiRNA target sequence
ggcgtgcatcaagacgctgaa

SEQ ID NO: 30768 - DNA, 21 bp, Artificial sequence
  SiRNA target sequence
gcgtgcatcaagacgctgaaa

SEQ ID NO: 30769 - DNA, 21 bp, Artificial sequence
  SiRNA target sequence
cgtgcatcaagacgctgaaag

SEQ ID NO: 30770 - DNA, 21 bp, Artificial sequence
  SiRNA target sequence
gtgcatcaagacgctgaaagg

SEQ ID NO: 30771 - DNA, 21 bp, Artificial sequence
  SiRNA target sequence
tgcatcaagacgctgaaaggg

SEQ ID NO: 30772 - DNA, 21 bp, Artificial sequence
  SiRNA target sequence
gcatcaagacgctgaaaggga

SEQ ID NO: 30773 - DNA, 21 bp, Artificial sequence
  SiRNA target sequence
catcaagacgctgaaagggaa

SEQ ID NO: 30774 - DNA, 21 bp, Artificial sequence
  SiRNA target sequence
atcaagacgctgaaagggaaa

SEQ ID NO: 30775 - DNA, 21 bp, Artificial sequence
  SiRNA target sequence
tcaagacgctgaaagggaaag

SEQ ID NO: 30776 - DNA, 21 bp, Artificial sequence
  SiRNA target sequence
caagacgctgaaagggaaaga

SEQ ID NO: 30777 - DNA, 21 bp, Artificial sequence
  SiRNA target sequence
aagacgctgaaagggaaagaa

SEQ ID NO: 30778 - DNA, 21 bp, Artificial sequence
  SiRNA target sequence
agacgctgaaagggaaagaat

SEQ ID NO: 30779 - DNA, 21 bp, Artificial sequence
  SiRNA target sequence
gacgctgaaagggaaagaatt

SEQ ID NO: 30780 - DNA, 21 bp, Artificial sequence
  SiRNA target sequence
acgctgaaagggaaagaattt

SEQ ID NO: 30781 - DNA, 21 bp, Artificial sequence
  SiRNA target sequence
cgctgaaagggaaagaatttt

SEQ ID NO: 30782 - DNA, 21 bp, Artificial sequence
  SiRNA target sequence
gctgaaagggaaagaatttta

SEQ ID NO: 30783 - DNA, 21 bp, Artificial sequence
  SiRNA target sequence
ctgaaagggaaagaattttat

SEQ ID NO: 30784 - DNA, 21 bp, Artificial sequence
  SiRNA target sequence
tgaaagggaaagaattttatg

SEQ ID NO: 30785 - DNA, 21 bp, Artificial sequence
  SiRNA target sequence
gaaagggaaagaattttatga

SEQ ID NO: 30786 - DNA, 21 bp, Artificial sequence
  SiRNA target sequence
aaagggaaagaattttatgaa

SEQ ID NO: 30787 - DNA, 21 bp, Artificial sequence
  SiRNA target sequence
aagggaaagaattttatgaag

SEQ ID NO: 30788 - DNA, 21 bp, Artificial sequence
  SiRNA target sequence
agggaaagaattttatgaagc

SEQ ID NO: 30789 - DNA, 21 bp, Artificial sequence
  SiRNA target sequence
gggaaagaattttatgaagcc

SEQ ID NO: 30790 - DNA, 21 bp, Artificial sequence
  SiRNA target sequence
ggaaagaattttatgaagcct

SEQ ID NO: 30791 - DNA, 21 bp, Artificial sequence
  SiRNA target sequence
gaaagaattttatgaagcctc

SEQ ID NO: 30792 - DNA, 21 bp, Artificial sequence
  SiRNA target sequence
aaagaattttatgaagcctct

SEQ ID NO: 30793 - DNA, 21 bp, Artificial sequence
  SiRNA target sequence
aagaattttatgaagcctcta

SEQ ID NO: 30794 - DNA, 21 bp, Artificial sequence
  SiRNA target sequence
agaattttatgaagcctctac

SEQ ID NO: 30795 - DNA, 21 bp, Artificial sequence
  SiRNA target sequence
gaattttatgaagcctctact

SEQ ID NO: 30796 - DNA, 21 bp, Artificial sequence
  SiRNA target sequence
aattttatgaagcctctacta

SEQ ID NO: 30797 - DNA, 21 bp, Artificial sequence
  SiRNA target sequence
attttatgaagcctctactac

SEQ ID NO: 30798 - DNA, 21 bp, Artificial sequence
  SiRNA target sequence
ttttatgaagcctctactaca

SEQ ID NO: 30799 - DNA, 21 bp, Artificial sequence
  SiRNA target sequence
tttatgaagcctctactacac

SEQ ID NO: 30800 - DNA, 21 bp, Artificial sequence
  SiRNA target sequence
ttatgaagcctctactacaca

SEQ ID NO: 30801 - DNA, 21 bp, Artificial sequence
  SiRNA target sequence
tatgaagcctctactacacag

SEQ ID NO: 30802 - DNA, 21 bp, Artificial sequence
  SiRNA target sequence
atgaagcctctactacacaga

SEQ ID NO: 30803 - DNA, 21 bp, Artificial sequence
  SiRNA target sequence
tgaagcctctactacacagaa

SEQ ID NO: 30804 - DNA, 21 bp, Artificial sequence
  SiRNA target sequence
gaagcctctactacacagaac

SEQ ID NO: 30805 - DNA, 21 bp, Artificial sequence
  SiRNA target sequence
aagcctctactacacagaacc

SEQ ID NO: 30806 - DNA, 21 bp, Artificial sequence
  SiRNA target sequence
agcctctactacacagaacca

SEQ ID NO: 30807 - DNA, 21 bp, Artificial sequence
  SiRNA target sequence
gcctctactacacagaaccaa

SEQ ID NO: 30808 - DNA, 21 bp, Artificial sequence
  SiRNA target sequence
cctctactacacagaaccaaa

SEQ ID NO: 30809 - DNA, 21 bp, Artificial sequence
  SiRNA target sequence
ctctactacacagaaccaaaa

SEQ ID NO: 30810 - DNA, 21 bp, Artificial sequence
  SiRNA target sequence
tctactacacagaaccaaaat

SEQ ID NO: 30811 - DNA, 21 bp, Artificial sequence
  SiRNA target sequence
ctactacacagaaccaaaata

SEQ ID NO: 30812 - DNA, 21 bp, Artificial sequence
  SiRNA target sequence
tactacacagaaccaaaatac

SEQ ID NO: 30813 - DNA, 21 bp, Artificial sequence
  SiRNA target sequence
actacacagaaccaaaataca

SEQ ID NO: 30814 - DNA, 21 bp, Artificial sequence
  SiRNA target sequence
ctacacagaaccaaaatacaa

SEQ ID NO: 30815 - DNA, 21 bp, Artificial sequence
  SiRNA target sequence
tacacagaaccaaaatacaac

SEQ ID NO: 30816 - DNA, 21 bp, Artificial sequence
  SiRNA target sequence
acacagaaccaaaatacaaca

SEQ ID NO: 30817 - DNA, 21 bp, Artificial sequence
  SiRNA target sequence
cacagaaccaaaatacaacac

SEQ ID NO: 30818 - DNA, 21 bp, Artificial sequence
  SiRNA target sequence
acagaaccaaaatacaacacg

SEQ ID NO: 30819 - DNA, 21 bp, Artificial sequence
  SiRNA target sequence
cagaaccaaaatacaacacgg

SEQ ID NO: 30820 - DNA, 21 bp, Artificial sequence
  SiRNA target sequence
agaaccaaaatacaacacggt

SEQ ID NO: 30821 - DNA, 21 bp, Artificial sequence
  SiRNA target sequence
gaaccaaaatacaacacggtt

SEQ ID NO: 30822 - DNA, 21 bp, Artificial sequence
  SiRNA target sequence
aaccaaaatacaacacggttt

SEQ ID NO: 30823 - DNA, 21 bp, Artificial sequence
  SiRNA target sequence
accaaaatacaacacggttta

SEQ ID NO: 30824 - DNA, 21 bp, Artificial sequence
  SiRNA target sequence
ccaaaatacaacacggtttat

SEQ ID NO: 30825 - DNA, 21 bp, Artificial sequence
  SiRNA target sequence
caaaatacaacacggtttatc

SEQ ID NO: 30826 - DNA, 21 bp, Artificial sequence
  SiRNA target sequence
aaaatacaacacggtttatca

SEQ ID NO: 30827 - DNA, 21 bp, Artificial sequence
  SiRNA target sequence
aaatacaacacggtttatcat

SEQ ID NO: 30828 - DNA, 21 bp, Artificial sequence
  SiRNA target sequence
aatacaacacggtttatcatc

SEQ ID NO: 30829 - DNA, 21 bp, Artificial sequence
  SiRNA target sequence
atacaacacggtttatcatcc

SEQ ID NO: 30830 - DNA, 21 bp, Artificial sequence
  SiRNA target sequence
tacaacacggtttatcatccg

SEQ ID NO: 30831 - DNA, 21 bp, Artificial sequence
  SiRNA target sequence
acaacacggtttatcatccgg

SEQ ID NO: 30832 - DNA, 21 bp, Artificial sequence
  SiRNA target sequence
caacacggtttatcatccggt

SEQ ID NO: 30833 - DNA, 21 bp, Artificial sequence
  SiRNA target sequence
aacacggtttatcatccggta

SEQ ID NO: 30834 - DNA, 21 bp, Artificial sequence
  SiRNA target sequence
acacggtttatcatccggtat

SEQ ID NO: 30835 - DNA, 21 bp, Artificial sequence
  SiRNA target sequence
cacggtttatcatccggtatc

SEQ ID NO: 30836 - DNA, 21 bp, Artificial sequence
  SiRNA target sequence
acggtttatcatccggtatcg

SEQ ID NO: 30837 - DNA, 21 bp, Artificial sequence
  SiRNA target sequence
cggtttatcatccggtatcga

SEQ ID NO: 30838 - DNA, 21 bp, Artificial sequence
  SiRNA target sequence
ggtttatcatccggtatcgaa

SEQ ID NO: 30839 - DNA, 21 bp, Artificial sequence
  SiRNA target sequence
gtttatcatccggtatcgaaa

SEQ ID NO: 30840 - DNA, 21 bp, Artificial sequence
  SiRNA target sequence
tttatcatccggtatcgaaaa

SEQ ID NO: 30841 - DNA, 21 bp, Artificial sequence
  SiRNA target sequence
ttatcatccggtatcgaaaag

SEQ ID NO: 30842 - DNA, 21 bp, Artificial sequence
  SiRNA target sequence
tatcatccggtatcgaaaagg

SEQ ID NO: 30843 - DNA, 21 bp, Artificial sequence
  SiRNA target sequence
atcatccggtatcgaaaaggg

SEQ ID NO: 30844 - DNA, 21 bp, Artificial sequence
  SiRNA target sequence
tcatccggtatcgaaaagggc

SEQ ID NO: 30845 - DNA, 21 bp, Artificial sequence
  SiRNA target sequence
catccggtatcgaaaagggct

SEQ ID NO: 30846 - DNA, 21 bp, Artificial sequence
  SiRNA target sequence
atccggtatcgaaaagggctt

SEQ ID NO: 30847 - DNA, 21 bp, Artificial sequence
  SiRNA target sequence
tccggtatcgaaaagggcttc

SEQ ID NO: 30848 - DNA, 21 bp, Artificial sequence
  SiRNA target sequence
ccggtatcgaaaagggcttca

SEQ ID NO: 30849 - DNA, 21 bp, Artificial sequence
  SiRNA target sequence
cggtatcgaaaagggcttcac

SEQ ID NO: 30850 - DNA, 21 bp, Artificial sequence
  SiRNA target sequence
ggtatcgaaaagggcttcacc

SEQ ID NO: 30851 - DNA, 21 bp, Artificial sequence
  SiRNA target sequence
gtatcgaaaagggcttcaccc

SEQ ID NO: 30852 - DNA, 21 bp, Artificial sequence
  SiRNA target sequence
tatcgaaaagggcttcaccct

SEQ ID NO: 30853 - DNA, 21 bp, Artificial sequence
  SiRNA target sequence
atcgaaaagggcttcaccctg

SEQ ID NO: 30854 - DNA, 21 bp, Artificial sequence
  SiRNA target sequence
tcgaaaagggcttcaccctga

SEQ ID NO: 30855 - DNA, 21 bp, Artificial sequence
  SiRNA target sequence
cgaaaagggcttcaccctgac

SEQ ID NO: 30856 - DNA, 21 bp, Artificial sequence
  SiRNA target sequence
gaaaagggcttcaccctgaca

SEQ ID NO: 30857 - DNA, 21 bp, Artificial sequence
  SiRNA target sequence
aaaagggcttcaccctgacat

SEQ ID NO: 30858 - DNA, 21 bp, Artificial sequence
  SiRNA target sequence
aaagggcttcaccctgacatg

SEQ ID NO: 30859 - DNA, 21 bp, Artificial sequence
  SiRNA target sequence
aagggcttcaccctgacatga

SEQ ID NO: 30860 - DNA, 21 bp, Artificial sequence
  SiRNA target sequence
agggcttcaccctgacatgag

SEQ ID NO: 30861 - DNA, 21 bp, Artificial sequence
  SiRNA target sequence
gggcttcaccctgacatgagg

SEQ ID NO: 30862 - DNA, 21 bp, Artificial sequence
  SiRNA target sequence
ggcttcaccctgacatgagga

SEQ ID NO: 30863 - DNA, 21 bp, Artificial sequence
  SiRNA target sequence
gcttcaccctgacatgaggat

SEQ ID NO: 30864 - DNA, 21 bp, Artificial sequence
  SiRNA target sequence
cttcaccctgacatgaggatc

SEQ ID NO: 30865 - DNA, 21 bp, Artificial sequence
  SiRNA target sequence
ttcaccctgacatgaggatca

SEQ ID NO: 30866 - DNA, 21 bp, Artificial sequence
  SiRNA target sequence
tcaccctgacatgaggatcaa

SEQ ID NO: 30867 - DNA, 21 bp, Artificial sequence
  SiRNA target sequence
caccctgacatgaggatcaaa

SEQ ID NO: 30868 - DNA, 21 bp, Artificial sequence
  SiRNA target sequence
accctgacatgaggatcaaat

SEQ ID NO: 30869 - DNA, 21 bp, Artificial sequence
  SiRNA target sequence
ccctgacatgaggatcaaata

SEQ ID NO: 30870 - DNA, 21 bp, Artificial sequence
  SiRNA target sequence
cctgacatgaggatcaaatat

SEQ ID NO: 30871 - DNA, 21 bp, Artificial sequence
  SiRNA target sequence
ctgacatgaggatcaaatata

SEQ ID NO: 30872 - DNA, 21 bp, Artificial sequence
  SiRNA target sequence
tgacatgaggatcaaatataa

SEQ ID NO: 30873 - DNA, 21 bp, Artificial sequence
  SiRNA target sequence
gacatgaggatcaaatataat

SEQ ID NO: 30874 - DNA, 21 bp, Artificial sequence
  SiRNA target sequence
acatgaggatcaaatataata

SEQ ID NO: 30875 - DNA, 21 bp, Artificial sequence
  SiRNA target sequence
catgaggatcaaatataataa

SEQ ID NO: 30876 - DNA, 21 bp, Artificial sequence
  SiRNA target sequence
atgaggatcaaatataataac

SEQ ID NO: 30877 - DNA, 21 bp, Artificial sequence
  SiRNA target sequence
tgaggatcaaatataataacc

SEQ ID NO: 30878 - DNA, 21 bp, Artificial sequence
  SiRNA target sequence
gaggatcaaatataataaccg

SEQ ID NO: 30879 - DNA, 21 bp, Artificial sequence
  SiRNA target sequence
aggatcaaatataataaccga

SEQ ID NO: 30880 - DNA, 21 bp, Artificial sequence
  SiRNA target sequence
ggatcaaatataataaccgat

SEQ ID NO: 30881 - DNA, 21 bp, Artificial sequence
  SiRNA target sequence
gatcaaatataataaccgata

SEQ ID NO: 30882 - DNA, 21 bp, Artificial sequence
  SiRNA target sequence
atcaaatataataaccgatat

SEQ ID NO: 30883 - DNA, 21 bp, Artificial sequence
  SiRNA target sequence
tcaaatataataaccgatatt

SEQ ID NO: 30884 - DNA, 21 bp, Artificial sequence
  SiRNA target sequence
caaatataataaccgatattt

SEQ ID NO: 30885 - DNA, 21 bp, Artificial sequence
  SiRNA target sequence
aaatataataaccgatatttt

SEQ ID NO: 30886 - DNA, 21 bp, Artificial sequence
  SiRNA target sequence
aatataataaccgatattttg

SEQ ID NO: 30887 - DNA, 21 bp, Artificial sequence
  SiRNA target sequence
atataataaccgatattttga

SEQ ID NO: 30888 - DNA, 21 bp, Artificial sequence
  SiRNA target sequence
tataataaccgatattttgat

SEQ ID NO: 30889 - DNA, 21 bp, Artificial sequence
  SiRNA target sequence
ataataaccgatattttgata

SEQ ID NO: 30890 - DNA, 21 bp, Artificial sequence
  SiRNA target sequence
taataaccgatattttgatat

SEQ ID NO: 30891 - DNA, 21 bp, Artificial sequence
  SiRNA target sequence
aataaccgatattttgatatt

SEQ ID NO: 30892 - DNA, 21 bp, Artificial sequence
  SiRNA target sequence
ataaccgatattttgatattg

SEQ ID NO: 30893 - DNA, 21 bp, Artificial sequence
  SiRNA target sequence
taaccgatattttgatattga

SEQ ID NO: 30894 - DNA, 21 bp, Artificial sequence
  SiRNA target sequence
aaccgatattttgatattgaa

SEQ ID NO: 30895 - DNA, 21 bp, Artificial sequence
  SiRNA target sequence
accgatattttgatattgaag

SEQ ID NO: 30896 - DNA, 21 bp, Artificial sequence
  SiRNA target sequence
ccgatattttgatattgaagc

SEQ ID NO: 30897 - DNA, 21 bp, Artificial sequence
  SiRNA target sequence
cgatattttgatattgaagcc

SEQ ID NO: 30898 - DNA, 21 bp, Artificial sequence
  SiRNA target sequence
gatattttgatattgaagcca

SEQ ID NO: 30899 - DNA, 21 bp, Artificial sequence
  SiRNA target sequence
atattttgatattgaagccat

SEQ ID NO: 30900 - DNA, 21 bp, Artificial sequence
  SiRNA target sequence
tattttgatattgaagccatc

SEQ ID NO: 30901 - DNA, 21 bp, Artificial sequence
  SiRNA target sequence
attttgatattgaagccatca

SEQ ID NO: 30902 - DNA, 21 bp, Artificial sequence
  SiRNA target sequence
ttttgatattgaagccatcat

SEQ ID NO: 30903 - DNA, 21 bp, Artificial sequence
  SiRNA target sequence
tttgatattgaagccatcatt

SEQ ID NO: 30904 - DNA, 21 bp, Artificial sequence
  SiRNA target sequence
ttgatattgaagccatcatta

SEQ ID NO: 30905 - DNA, 21 bp, Artificial sequence
  SiRNA target sequence
tgatattgaagccatcattaa

SEQ ID NO: 30906 - DNA, 21 bp, Artificial sequence
  SiRNA target sequence
gatattgaagccatcattaat

SEQ ID NO: 30907 - DNA, 21 bp, Artificial sequence
  SiRNA target sequence
atattgaagccatcattaatg

SEQ ID NO: 30908 - DNA, 21 bp, Artificial sequence
  SiRNA target sequence
tattgaagccatcattaatga

SEQ ID NO: 30909 - DNA, 21 bp, Artificial sequence
  SiRNA target sequence
attgaagccatcattaatgac

SEQ ID NO: 30910 - DNA, 21 bp, Artificial sequence
  SiRNA target sequence
ttgaagccatcattaatgacg

SEQ ID NO: 30911 - DNA, 21 bp, Artificial sequence
  SiRNA target sequence
tgaagccatcattaatgacga

SEQ ID NO: 30912 - DNA, 21 bp, Artificial sequence
  SiRNA target sequence
gaagccatcattaatgacgac

SEQ ID NO: 30913 - DNA, 21 bp, Artificial sequence
  SiRNA target sequence
aagccatcattaatgacgacg

SEQ ID NO: 30914 - DNA, 21 bp, Artificial sequence
  SiRNA target sequence
agccatcattaatgacgacga

SEQ ID NO: 30915 - DNA, 21 bp, Artificial sequence
  SiRNA target sequence
gccatcattaatgacgacgaa

SEQ ID NO: 30916 - DNA, 21 bp, Artificial sequence
  SiRNA target sequence
ccatcattaatgacgacgaaa

SEQ ID NO: 30917 - DNA, 21 bp, Artificial sequence
  SiRNA target sequence
catcattaatgacgacgaaat

SEQ ID NO: 30918 - DNA, 21 bp, Artificial sequence
  SiRNA target sequence
atcattaatgacgacgaaatg

SEQ ID NO: 30919 - DNA, 21 bp, Artificial sequence
  SiRNA target sequence
tcattaatgacgacgaaatga

SEQ ID NO: 30920 - DNA, 21 bp, Artificial sequence
  SiRNA target sequence
cattaatgacgacgaaatgaa

SEQ ID NO: 30921 - DNA, 21 bp, Artificial sequence
  SiRNA target sequence
attaatgacgacgaaatgaat

SEQ ID NO: 30922 - DNA, 21 bp, Artificial sequence
  SiRNA target sequence
ttaatgacgacgaaatgaata

SEQ ID NO: 30923 - DNA, 21 bp, Artificial sequence
  SiRNA target sequence
taatgacgacgaaatgaataa

SEQ ID NO: 30924 - DNA, 21 bp, Artificial sequence
  SiRNA target sequence
aatgacgacgaaatgaataaa

SEQ ID NO: 30925 - DNA, 21 bp, Artificial sequence
  SiRNA target sequence
atgacgacgaaatgaataaaa

SEQ ID NO: 30926 - DNA, 21 bp, Artificial sequence
  SiRNA target sequence
tgacgacgaaatgaataaaac

SEQ ID NO: 30927 - DNA, 21 bp, Artificial sequence
  SiRNA target sequence
gacgacgaaatgaataaaacc

SEQ ID NO: 30928 - DNA, 21 bp, Artificial sequence
  SiRNA target sequence
acgacgaaatgaataaaaccc

SEQ ID NO: 30929 - DNA, 21 bp, Artificial sequence
  SiRNA target sequence
cgacgaaatgaataaaaccct

SEQ ID NO: 30930 - DNA, 21 bp, Artificial sequence
  SiRNA target sequence
gacgaaatgaataaaaccctg

SEQ ID NO: 30931 - DNA, 21 bp, Artificial sequence
  SiRNA target sequence
acgaaatgaataaaaccctga

SEQ ID NO: 30932 - DNA, 21 bp, Artificial sequence
  SiRNA target sequence
cgaaatgaataaaaccctgac

SEQ ID NO: 30933 - DNA, 21 bp, Artificial sequence
  SiRNA target sequence
gaaatgaataaaaccctgacg

SEQ ID NO: 30934 - DNA, 21 bp, Artificial sequence
  SiRNA target sequence
aaatgaataaaaccctgacga

SEQ ID NO: 30935 - DNA, 21 bp, Artificial sequence
  SiRNA target sequence
aatgaataaaaccctgacgat

SEQ ID NO: 30936 - DNA, 21 bp, Artificial sequence
  SiRNA target sequence
atgaataaaaccctgacgata

SEQ ID NO: 30937 - DNA, 21 bp, Artificial sequence
  SiRNA target sequence
tgaataaaaccctgacgatac

SEQ ID NO: 30938 - DNA, 21 bp, Artificial sequence
  SiRNA target sequence
gaataaaaccctgacgataca

SEQ ID NO: 30939 - DNA, 21 bp, Artificial sequence
  SiRNA target sequence
aataaaaccctgacgatacac

SEQ ID NO: 30940 - DNA, 21 bp, Artificial sequence
  SiRNA target sequence
ataaaaccctgacgatacacg

SEQ ID NO: 30941 - DNA, 21 bp, Artificial sequence
  SiRNA target sequence
taaaaccctgacgatacacgc

SEQ ID NO: 30942 - DNA, 21 bp, Artificial sequence
  SiRNA target sequence
aaaaccctgacgatacacgcc

SEQ ID NO: 30943 - DNA, 21 bp, Artificial sequence
  SiRNA target sequence
aaaccctgacgatacacgcca

SEQ ID NO: 30944 - DNA, 21 bp, Artificial sequence
  SiRNA target sequence
aaccctgacgatacacgccaa

SEQ ID NO: 30945 - DNA, 21 bp, Artificial sequence
  SiRNA target sequence
accctgacgatacacgccaag

SEQ ID NO: 30946 - DNA, 21 bp, Artificial sequence
  SiRNA target sequence
ccctgacgatacacgccaagg

SEQ ID NO: 30947 - DNA, 21 bp, Artificial sequence
  SiRNA target sequence
cctgacgatacacgccaagga

SEQ ID NO: 30948 - DNA, 21 bp, Artificial sequence
  SiRNA target sequence
ctgacgatacacgccaaggag

SEQ ID NO: 30949 - DNA, 21 bp, Artificial sequence
  SiRNA target sequence
tgacgatacacgccaaggaga

SEQ ID NO: 30950 - DNA, 21 bp, Artificial sequence
  SiRNA target sequence
gacgatacacgccaaggagag

SEQ ID NO: 30951 - DNA, 21 bp, Artificial sequence
  SiRNA target sequence
acgatacacgccaaggagagg

SEQ ID NO: 30952 - DNA, 21 bp, Artificial sequence
  SiRNA target sequence
cgatacacgccaaggagaggg

SEQ ID NO: 30953 - DNA, 21 bp, Artificial sequence
  SiRNA target sequence
gatacacgccaaggagagggt

SEQ ID NO: 30954 - DNA, 21 bp, Artificial sequence
  SiRNA target sequence
atacacgccaaggagagggta

SEQ ID NO: 30955 - DNA, 21 bp, Artificial sequence
  SiRNA target sequence
tacacgccaaggagagggtac

SEQ ID NO: 30956 - DNA, 21 bp, Artificial sequence
  SiRNA target sequence
acacgccaaggagagggtaca

SEQ ID NO: 30957 - DNA, 21 bp, Artificial sequence
  SiRNA target sequence
cacgccaaggagagggtacaa

SEQ ID NO: 30958 - DNA, 21 bp, Artificial sequence
  SiRNA target sequence
acgccaaggagagggtacaat

SEQ ID NO: 30959 - DNA, 21 bp, Artificial sequence
  SiRNA target sequence
cgccaaggagagggtacaatg

SEQ ID NO: 30960 - DNA, 21 bp, Artificial sequence
  SiRNA target sequence
gccaaggagagggtacaatga

SEQ ID NO: 30961 - DNA, 21 bp, Artificial sequence
  SiRNA target sequence
ccaaggagagggtacaatgag

SEQ ID NO: 30962 - DNA, 21 bp, Artificial sequence
  SiRNA target sequence
caaggagagggtacaatgagc

SEQ ID NO: 30963 - DNA, 21 bp, Artificial sequence
  SiRNA target sequence
aaggagagggtacaatgagct

SEQ ID NO: 30964 - DNA, 21 bp, Artificial sequence
  SiRNA target sequence
aggagagggtacaatgagctt

SEQ ID NO: 30965 - DNA, 21 bp, Artificial sequence
  SiRNA target sequence
ggagagggtacaatgagcttt

SEQ ID NO: 30966 - DNA, 21 bp, Artificial sequence
  SiRNA target sequence
gagagggtacaatgagctttc

SEQ ID NO: 30967 - DNA, 21 bp, Artificial sequence
  SiRNA target sequence
agagggtacaatgagctttca

SEQ ID NO: 30968 - DNA, 21 bp, Artificial sequence
  SiRNA target sequence
gagggtacaatgagctttcaa

SEQ ID NO: 30969 - DNA, 21 bp, Artificial sequence
  SiRNA target sequence
agggtacaatgagctttcaag

SEQ ID NO: 30970 - DNA, 21 bp, Artificial sequence
  SiRNA target sequence
gggtacaatgagctttcaagt

SEQ ID NO: 30971 - DNA, 21 bp, Artificial sequence
  SiRNA target sequence
ggtacaatgagctttcaagtg

SEQ ID NO: 30972 - DNA, 21 bp, Artificial sequence
  SiRNA target sequence
gtacaatgagctttcaagtgt

SEQ ID NO: 30973 - DNA, 21 bp, Artificial sequence
  SiRNA target sequence
tacaatgagctttcaagtgtc

SEQ ID NO: 30974 - DNA, 21 bp, Artificial sequence
  SiRNA target sequence
acaatgagctttcaagtgtct

SEQ ID NO: 30975 - DNA, 21 bp, Artificial sequence
  SiRNA target sequence
caatgagctttcaagtgtctg

SEQ ID NO: 30976 - DNA, 21 bp, Artificial sequence
  SiRNA target sequence
aatgagctttcaagtgtctgg

SEQ ID NO: 30977 - DNA, 21 bp, Artificial sequence
  SiRNA target sequence
atgagctttcaagtgtctggt

SEQ ID NO: 30978 - DNA, 21 bp, Artificial sequence
  SiRNA target sequence
tgagctttcaagtgtctggta

SEQ ID NO: 30979 - DNA, 21 bp, Artificial sequence
  SiRNA target sequence
gagctttcaagtgtctggtat

SEQ ID NO: 30980 - DNA, 21 bp, Artificial sequence
  SiRNA target sequence
agctttcaagtgtctggtatg

SEQ ID NO: 30981 - DNA, 21 bp, Artificial sequence
  SiRNA target sequence
gctttcaagtgtctggtatgg

SEQ ID NO: 30982 - DNA, 21 bp, Artificial sequence
  SiRNA target sequence
ctttcaagtgtctggtatgga

SEQ ID NO: 30983 - DNA, 21 bp, Artificial sequence
  SiRNA target sequence
tttcaagtgtctggtatggag

SEQ ID NO: 30984 - DNA, 21 bp, Artificial sequence
  SiRNA target sequence
ttcaagtgtctggtatggagg

SEQ ID NO: 30985 - DNA, 21 bp, Artificial sequence
  SiRNA target sequence
tcaagtgtctggtatggagga

SEQ ID NO: 30986 - DNA, 21 bp, Artificial sequence
  SiRNA target sequence
caagtgtctggtatggaggaa

SEQ ID NO: 30987 - DNA, 21 bp, Artificial sequence
  SiRNA target sequence
aagtgtctggtatggaggaat

SEQ ID NO: 30988 - DNA, 21 bp, Artificial sequence
  SiRNA target sequence
agtgtctggtatggaggaatt

SEQ ID NO: 30989 - DNA, 21 bp, Artificial sequence
  SiRNA target sequence
gtgtctggtatggaggaatta

SEQ ID NO: 30990 - DNA, 21 bp, Artificial sequence
  SiRNA target sequence
tgtctggtatggaggaattat

SEQ ID NO: 30991 - DNA, 21 bp, Artificial sequence
  SiRNA target sequence
gtctggtatggaggaattatt

SEQ ID NO: 30992 - DNA, 21 bp, Artificial sequence
  SiRNA target sequence
tctggtatggaggaattatta

SEQ ID NO: 30993 - DNA, 21 bp, Artificial sequence
  SiRNA target sequence
ctggtatggaggaattattag

SEQ ID NO: 30994 - DNA, 21 bp, Artificial sequence
  SiRNA target sequence
tggtatggaggaattattagc

SEQ ID NO: 30995 - DNA, 21 bp, Artificial sequence
  SiRNA target sequence
ggtatggaggaattattagcc

SEQ ID NO: 30996 - DNA, 21 bp, Artificial sequence
  SiRNA target sequence
gtatggaggaattattagccc

SEQ ID NO: 30997 - DNA, 21 bp, Artificial sequence
  SiRNA target sequence
tatggaggaattattagccca

SEQ ID NO: 30998 - DNA, 21 bp, Artificial sequence
  SiRNA target sequence
atggaggaattattagcccaa

SEQ ID NO: 30999 - DNA, 21 bp, Artificial sequence
  SiRNA target sequence
tggaggaattattagcccaac

SEQ ID NO: 31000 - DNA, 21 bp, Artificial sequence
  SiRNA target sequence
ggaggaattattagcccaact

SEQ ID NO: 31001 - DNA, 21 bp, Artificial sequence
  SiRNA target sequence
gaggaattattagcccaactc

SEQ ID NO: 31002 - DNA, 21 bp, Artificial sequence
  SiRNA target sequence
aggaattattagcccaactcc

SEQ ID NO: 31003 - DNA, 21 bp, Artificial sequence
  SiRNA target sequence
ggaattattagcccaactccg

SEQ ID NO: 31004 - DNA, 21 bp, Artificial sequence
  SiRNA target sequence
gaattattagcccaactccgc

SEQ ID NO: 31005 - DNA, 21 bp, Artificial sequence
  SiRNA target sequence
aattattagcccaactccgcc

SEQ ID NO: 31006 - DNA, 21 bp, Artificial sequence
  SiRNA target sequence
attattagcccaactccgcca

SEQ ID NO: 31007 - DNA, 21 bp, Artificial sequence
  SiRNA target sequence
ttattagcccaactccgccat

SEQ ID NO: 31008 - DNA, 21 bp, Artificial sequence
  SiRNA target sequence
tattagcccaactccgccata

SEQ ID NO: 31009 - DNA, 21 bp, Artificial sequence
  SiRNA target sequence
attagcccaactccgccatat

SEQ ID NO: 31010 - DNA, 21 bp, Artificial sequence
  SiRNA target sequence
ttagcccaactccgccatatg

SEQ ID NO: 31011 - DNA, 21 bp, Artificial sequence
  SiRNA target sequence
tagcccaactccgccatatgg

SEQ ID NO: 31012 - DNA, 21 bp, Artificial sequence
  SiRNA target sequence
agcccaactccgccatatggg

SEQ ID NO: 31013 - DNA, 21 bp, Artificial sequence
  SiRNA target sequence
gcccaactccgccatatggga

SEQ ID NO: 31014 - DNA, 21 bp, Artificial sequence
  SiRNA target sequence
cccaactccgccatatgggag

SEQ ID NO: 31015 - DNA, 21 bp, Artificial sequence
  SiRNA target sequence
ccaactccgccatatgggaga

SEQ ID NO: 31016 - DNA, 21 bp, Artificial sequence
  SiRNA target sequence
caactccgccatatgggagaa

SEQ ID NO: 31017 - DNA, 21 bp, Artificial sequence
  SiRNA target sequence
aactccgccatatgggagaaa

SEQ ID NO: 31018 - DNA, 21 bp, Artificial sequence
  SiRNA target sequence
actccgccatatgggagaaaa

SEQ ID NO: 31019 - DNA, 21 bp, Artificial sequence
  SiRNA target sequence
ctccgccatatgggagaaaaa

SEQ ID NO: 31020 - DNA, 21 bp, Artificial sequence
  SiRNA target sequence
tccgccatatgggagaaaaag

SEQ ID NO: 31021 - DNA, 21 bp, Artificial sequence
  SiRNA target sequence
ccgccatatgggagaaaaagg

SEQ ID NO: 31022 - DNA, 21 bp, Artificial sequence
  SiRNA target sequence
cgccatatgggagaaaaagga

SEQ ID NO: 31023 - DNA, 21 bp, Artificial sequence
  SiRNA target sequence
gccatatgggagaaaaaggag

SEQ ID NO: 31024 - DNA, 21 bp, Artificial sequence
  SiRNA target sequence
ccatatgggagaaaaaggaga

SEQ ID NO: 31025 - DNA, 21 bp, Artificial sequence
  SiRNA target sequence
catatgggagaaaaaggagac

SEQ ID NO: 31026 - DNA, 21 bp, Artificial sequence
  SiRNA target sequence
atatgggagaaaaaggagaca

SEQ ID NO: 31027 - DNA, 21 bp, Artificial sequence
  SiRNA target sequence
tatgggagaaaaaggagacaa

SEQ ID NO: 31028 - DNA, 21 bp, Artificial sequence
  SiRNA target sequence
atgggagaaaaaggagacaaa

SEQ ID NO: 31029 - DNA, 21 bp, Artificial sequence
  SiRNA target sequence
tgggagaaaaaggagacaaaa

SEQ ID NO: 31030 - DNA, 21 bp, Artificial sequence
  SiRNA target sequence
gggagaaaaaggagacaaaat

SEQ ID NO: 31031 - DNA, 21 bp, Artificial sequence
  SiRNA target sequence
ggagaaaaaggagacaaaata

SEQ ID NO: 31032 - DNA, 21 bp, Artificial sequence
  SiRNA target sequence
gagaaaaaggagacaaaataa

SEQ ID NO: 31033 - DNA, 21 bp, Artificial sequence
  SiRNA target sequence
agaaaaaggagacaaaataaa

SEQ ID NO: 31034 - DNA, 21 bp, Artificial sequence
  SiRNA target sequence
gaaaaaggagacaaaataaaa

SEQ ID NO: 31035 - DNA, 21 bp, Artificial sequence
  SiRNA target sequence
aaaaaggagacaaaataaaag

SEQ ID NO: 31036 - DNA, 21 bp, Artificial sequence
  SiRNA target sequence
aaaaggagacaaaataaaaga

SEQ ID NO: 31037 - DNA, 21 bp, Artificial sequence
  SiRNA target sequence
aaaggagacaaaataaaagag

SEQ ID NO: 31038 - DNA, 21 bp, Artificial sequence
  SiRNA target sequence
aaggagacaaaataaaagagc

SEQ ID NO: 31039 - DNA, 21 bp, Artificial sequence
  SiRNA target sequence
aggagacaaaataaaagagca

SEQ ID NO: 31040 - DNA, 21 bp, Artificial sequence
  SiRNA target sequence
ggagacaaaataaaagagcag

SEQ ID NO: 31041 - DNA, 21 bp, Artificial sequence
  SiRNA target sequence
gagacaaaataaaagagcagg

SEQ ID NO: 31042 - DNA, 21 bp, Artificial sequence
  SiRNA target sequence
agacaaaataaaagagcaggc

SEQ ID NO: 31043 - DNA, 21 bp, Artificial sequence
  SiRNA target sequence
gacaaaataaaagagcaggcc

SEQ ID NO: 31044 - DNA, 21 bp, Artificial sequence
  SiRNA target sequence
acaaaataaaagagcaggccg

SEQ ID NO: 31045 - DNA, 21 bp, Artificial sequence
  SiRNA target sequence
caaaataaaagagcaggccga

SEQ ID NO: 31046 - DNA, 21 bp, Artificial sequence
  SiRNA target sequence
aaaataaaagagcaggccgag

SEQ ID NO: 31047 - DNA, 21 bp, Artificial sequence
  SiRNA target sequence
aaataaaagagcaggccgaga

SEQ ID NO: 31048 - DNA, 21 bp, Artificial sequence
  SiRNA target sequence
aataaaagagcaggccgagat

SEQ ID NO: 31049 - DNA, 21 bp, Artificial sequence
  SiRNA target sequence
ataaaagagcaggccgagatg

SEQ ID NO: 31050 - DNA, 21 bp, Artificial sequence
  SiRNA target sequence
taaaagagcaggccgagatgg

SEQ ID NO: 31051 - DNA, 21 bp, Artificial sequence
  SiRNA target sequence
aaaagagcaggccgagatgga

SEQ ID NO: 31052 - DNA, 21 bp, Artificial sequence
  SiRNA target sequence
aaagagcaggccgagatggaa

SEQ ID NO: 31053 - DNA, 21 bp, Artificial sequence
  SiRNA target sequence
aagagcaggccgagatggaag

SEQ ID NO: 31054 - DNA, 21 bp, Artificial sequence
  SiRNA target sequence
agagcaggccgagatggaagg

SEQ ID NO: 31055 - DNA, 21 bp, Artificial sequence
  SiRNA target sequence
gagcaggccgagatggaaggt

SEQ ID NO: 31056 - DNA, 21 bp, Artificial sequence
  SiRNA target sequence
agcaggccgagatggaaggtg

SEQ ID NO: 31057 - DNA, 21 bp, Artificial sequence
  SiRNA target sequence
gcaggccgagatggaaggtgc

SEQ ID NO: 31058 - DNA, 21 bp, Artificial sequence
  SiRNA target sequence
caggccgagatggaaggtgca

SEQ ID NO: 31059 - DNA, 21 bp, Artificial sequence
  SiRNA target sequence
aggccgagatggaaggtgcaa

SEQ ID NO: 31060 - DNA, 21 bp, Artificial sequence
  SiRNA target sequence
ggccgagatggaaggtgcaaa

SEQ ID NO: 31061 - DNA, 21 bp, Artificial sequence
  SiRNA target sequence
gccgagatggaaggtgcaaaa

SEQ ID NO: 31062 - DNA, 21 bp, Artificial sequence
  SiRNA target sequence
ccgagatggaaggtgcaaaaa

SEQ ID NO: 31063 - DNA, 21 bp, Artificial sequence
  SiRNA target sequence
cgagatggaaggtgcaaaaat

SEQ ID NO: 31064 - DNA, 21 bp, Artificial sequence
  SiRNA target sequence
gagatggaaggtgcaaaaatc

SEQ ID NO: 31065 - DNA, 21 bp, Artificial sequence
  SiRNA target sequence
agatggaaggtgcaaaaatca

SEQ ID NO: 31066 - DNA, 21 bp, Artificial sequence
  SiRNA target sequence
gatggaaggtgcaaaaatcat

SEQ ID NO: 31067 - DNA, 21 bp, Artificial sequence
  SiRNA target sequence
atggaaggtgcaaaaatcatg

SEQ ID NO: 31068 - DNA, 21 bp, Artificial sequence
  SiRNA target sequence
tggaaggtgcaaaaatcatgc

SEQ ID NO: 31069 - DNA, 21 bp, Artificial sequence
  SiRNA target sequence
ggaaggtgcaaaaatcatgca

SEQ ID NO: 31070 - DNA, 21 bp, Artificial sequence
  SiRNA target sequence
gaaggtgcaaaaatcatgcag

SEQ ID NO: 31071 - DNA, 21 bp, Artificial sequence
  SiRNA target sequence
aaggtgcaaaaatcatgcagc

SEQ ID NO: 31072 - DNA, 21 bp, Artificial sequence
  SiRNA target sequence
aggtgcaaaaatcatgcagca

SEQ ID NO: 31073 - DNA, 21 bp, Artificial sequence
  SiRNA target sequence
ggtgcaaaaatcatgcagcaa

SEQ ID NO: 31074 - DNA, 21 bp, Artificial sequence
  SiRNA target sequence
gtgcaaaaatcatgcagcaag

SEQ ID NO: 31075 - DNA, 21 bp, Artificial sequence
  SiRNA target sequence
tgcaaaaatcatgcagcaagc

SEQ ID NO: 31076 - DNA, 21 bp, Artificial sequence
  SiRNA target sequence
gcaaaaatcatgcagcaagcc

SEQ ID NO: 31077 - DNA, 21 bp, Artificial sequence
  SiRNA target sequence
caaaaatcatgcagcaagcca

SEQ ID NO: 31078 - DNA, 21 bp, Artificial sequence
  SiRNA target sequence
aaaaatcatgcagcaagccat

SEQ ID NO: 31079 - DNA, 21 bp, Artificial sequence
  SiRNA target sequence
aaaatcatgcagcaagccatc

SEQ ID NO: 31080 - DNA, 21 bp, Artificial sequence
  SiRNA target sequence
aaatcatgcagcaagccatca

SEQ ID NO: 31081 - DNA, 21 bp, Artificial sequence
  SiRNA target sequence
aatcatgcagcaagccatcaa

SEQ ID NO: 31082 - DNA, 21 bp, Artificial sequence
  SiRNA target sequence
atcatgcagcaagccatcaag

SEQ ID NO: 31083 - DNA, 21 bp, Artificial sequence
  SiRNA target sequence
tcatgcagcaagccatcaagg

SEQ ID NO: 31084 - DNA, 21 bp, Artificial sequence
  SiRNA target sequence
catgcagcaagccatcaagga

SEQ ID NO: 31085 - DNA, 21 bp, Artificial sequence
  SiRNA target sequence
atgcagcaagccatcaaggaa

SEQ ID NO: 31086 - DNA, 21 bp, Artificial sequence
  SiRNA target sequence
tgcagcaagccatcaaggaag

SEQ ID NO: 31087 - DNA, 21 bp, Artificial sequence
  SiRNA target sequence
gcagcaagccatcaaggaagg

SEQ ID NO: 31088 - DNA, 21 bp, Artificial sequence
  SiRNA target sequence
cagcaagccatcaaggaaggt

SEQ ID NO: 31089 - DNA, 21 bp, Artificial sequence
  SiRNA target sequence
agcaagccatcaaggaaggta

SEQ ID NO: 31090 - DNA, 21 bp, Artificial sequence
  SiRNA target sequence
gcaagccatcaaggaaggtac

SEQ ID NO: 31091 - DNA, 21 bp, Artificial sequence
  SiRNA target sequence
caagccatcaaggaaggtact

SEQ ID NO: 31092 - DNA, 21 bp, Artificial sequence
  SiRNA target sequence
aagccatcaaggaaggtactc

SEQ ID NO: 31093 - DNA, 21 bp, Artificial sequence
  SiRNA target sequence
agccatcaaggaaggtactcc

SEQ ID NO: 31094 - DNA, 21 bp, Artificial sequence
  SiRNA target sequence
gccatcaaggaaggtactcct

SEQ ID NO: 31095 - DNA, 21 bp, Artificial sequence
  SiRNA target sequence
ccatcaaggaaggtactccta

SEQ ID NO: 31096 - DNA, 21 bp, Artificial sequence
  SiRNA target sequence
catcaaggaaggtactcctat

SEQ ID NO: 31097 - DNA, 21 bp, Artificial sequence
  SiRNA target sequence
atcaaggaaggtactcctatt

SEQ ID NO: 31098 - DNA, 21 bp, Artificial sequence
  SiRNA target sequence
tcaaggaaggtactcctattg

SEQ ID NO: 31099 - DNA, 21 bp, Artificial sequence
  SiRNA target sequence
caaggaaggtactcctattgg

SEQ ID NO: 31100 - DNA, 21 bp, Artificial sequence
  SiRNA target sequence
aaggaaggtactcctattggt

SEQ ID NO: 31101 - DNA, 21 bp, Artificial sequence
  SiRNA target sequence
aggaaggtactcctattggtc

SEQ ID NO: 31102 - DNA, 21 bp, Artificial sequence
  SiRNA target sequence
ggaaggtactcctattggtcc

SEQ ID NO: 31103 - DNA, 21 bp, Artificial sequence
  SiRNA target sequence
gaaggtactcctattggtcct

SEQ ID NO: 31104 - DNA, 21 bp, Artificial sequence
  SiRNA target sequence
aaggtactcctattggtcctc

SEQ ID NO: 31105 - DNA, 21 bp, Artificial sequence
  SiRNA target sequence
aggtactcctattggtcctca

SEQ ID NO: 31106 - DNA, 21 bp, Artificial sequence
  SiRNA target sequence
ggtactcctattggtcctcat

SEQ ID NO: 31107 - DNA, 21 bp, Artificial sequence
  SiRNA target sequence
gtactcctattggtcctcata

SEQ ID NO: 31108 - DNA, 21 bp, Artificial sequence
  SiRNA target sequence
tactcctattggtcctcatac

SEQ ID NO: 31109 - DNA, 21 bp, Artificial sequence
  SiRNA target sequence
actcctattggtcctcatacc

SEQ ID NO: 31110 - DNA, 21 bp, Artificial sequence
  SiRNA target sequence
ctcctattggtcctcatacca

SEQ ID NO: 31111 - DNA, 21 bp, Artificial sequence
  SiRNA target sequence
tcctattggtcctcataccaa

SEQ ID NO: 31112 - DNA, 21 bp, Artificial sequence
  SiRNA target sequence
cctattggtcctcataccaaa

SEQ ID NO: 31113 - DNA, 21 bp, Artificial sequence
  SiRNA target sequence
ctattggtcctcataccaaac

SEQ ID NO: 31114 - DNA, 21 bp, Artificial sequence
  SiRNA target sequence
tattggtcctcataccaaaca

SEQ ID NO: 31115 - DNA, 21 bp, Artificial sequence
  SiRNA target sequence
attggtcctcataccaaacac

SEQ ID NO: 31116 - DNA, 21 bp, Artificial sequence
  SiRNA target sequence
ttggtcctcataccaaacacg

SEQ ID NO: 31117 - DNA, 21 bp, Artificial sequence
  SiRNA target sequence
tggtcctcataccaaacacgc

SEQ ID NO: 31118 - DNA, 21 bp, Artificial sequence
  SiRNA target sequence
ggtcctcataccaaacacgct

SEQ ID NO: 31119 - DNA, 21 bp, Artificial sequence
  SiRNA target sequence
gtcctcataccaaacacgcta

SEQ ID NO: 31120 - DNA, 21 bp, Artificial sequence
  SiRNA target sequence
tcctcataccaaacacgctag

SEQ ID NO: 31121 - DNA, 21 bp, Artificial sequence
  SiRNA target sequence
cctcataccaaacacgctaga

SEQ ID NO: 31122 - DNA, 21 bp, Artificial sequence
  SiRNA target sequence
ctcataccaaacacgctagag

SEQ ID NO: 31123 - DNA, 21 bp, Artificial sequence
  SiRNA target sequence
tcataccaaacacgctagaga

SEQ ID NO: 31124 - DNA, 21 bp, Artificial sequence
  SiRNA target sequence
cataccaaacacgctagagac

SEQ ID NO: 31125 - DNA, 21 bp, Artificial sequence
  SiRNA target sequence
ataccaaacacgctagagacc

SEQ ID NO: 31126 - DNA, 21 bp, Artificial sequence
  SiRNA target sequence
taccaaacacgctagagacca

SEQ ID NO: 31127 - DNA, 21 bp, Artificial sequence
  SiRNA target sequence
accaaacacgctagagaccat

SEQ ID NO: 31128 - DNA, 21 bp, Artificial sequence
  SiRNA target sequence
ccaaacacgctagagaccatg

SEQ ID NO: 31129 - DNA, 21 bp, Artificial sequence
  SiRNA target sequence
caaacacgctagagaccatgt

SEQ ID NO: 31130 - DNA, 21 bp, Artificial sequence
  SiRNA target sequence
aaacacgctagagaccatgta

SEQ ID NO: 31131 - DNA, 21 bp, Artificial sequence
  SiRNA target sequence
aacacgctagagaccatgtag

SEQ ID NO: 31132 - DNA, 21 bp, Artificial sequence
  SiRNA target sequence
acacgctagagaccatgtaga

SEQ ID NO: 31133 - DNA, 21 bp, Artificial sequence
  SiRNA target sequence
cacgctagagaccatgtagag

SEQ ID NO: 31134 - DNA, 21 bp, Artificial sequence
  SiRNA target sequence
acgctagagaccatgtagaga

SEQ ID NO: 31135 - DNA, 21 bp, Artificial sequence
  SiRNA target sequence
cgctagagaccatgtagagat

SEQ ID NO: 31136 - DNA, 21 bp, Artificial sequence
  SiRNA target sequence
gctagagaccatgtagagatt

SEQ ID NO: 31137 - DNA, 21 bp, Artificial sequence
  SiRNA target sequence
ctagagaccatgtagagattg

SEQ ID NO: 31138 - DNA, 21 bp, Artificial sequence
  SiRNA target sequence
tagagaccatgtagagattga

SEQ ID NO: 31139 - DNA, 21 bp, Artificial sequence
  SiRNA target sequence
agagaccatgtagagattgaa

SEQ ID NO: 31140 - DNA, 21 bp, Artificial sequence
  SiRNA target sequence
gagaccatgtagagattgaaa

SEQ ID NO: 31141 - DNA, 21 bp, Artificial sequence
  SiRNA target sequence
agaccatgtagagattgaaaa

SEQ ID NO: 31142 - DNA, 21 bp, Artificial sequence
  SiRNA target sequence
gaccatgtagagattgaaaag

SEQ ID NO: 31143 - DNA, 21 bp, Artificial sequence
  SiRNA target sequence
accatgtagagattgaaaaga

SEQ ID NO: 31144 - DNA, 21 bp, Artificial sequence
  SiRNA target sequence
ccatgtagagattgaaaagat

SEQ ID NO: 31145 - DNA, 21 bp, Artificial sequence
  SiRNA target sequence
catgtagagattgaaaagata

SEQ ID NO: 31146 - DNA, 21 bp, Artificial sequence
  SiRNA target sequence
atgtagagattgaaaagatag

SEQ ID NO: 31147 - DNA, 21 bp, Artificial sequence
  SiRNA target sequence
tgtagagattgaaaagataga

SEQ ID NO: 31148 - DNA, 21 bp, Artificial sequence
  SiRNA target sequence
gtagagattgaaaagatagac

SEQ ID NO: 31149 - DNA, 21 bp, Artificial sequence
  SiRNA target sequence
tagagattgaaaagatagacg

SEQ ID NO: 31150 - DNA, 21 bp, Artificial sequence
  SiRNA target sequence
agagattgaaaagatagacga

SEQ ID NO: 31151 - DNA, 21 bp, Artificial sequence
  SiRNA target sequence
gagattgaaaagatagacgac

SEQ ID NO: 31152 - DNA, 21 bp, Artificial sequence
  SiRNA target sequence
agattgaaaagatagacgacg

SEQ ID NO: 31153 - DNA, 21 bp, Artificial sequence
  SiRNA target sequence
gattgaaaagatagacgacgg

SEQ ID NO: 31154 - DNA, 21 bp, Artificial sequence
  SiRNA target sequence
attgaaaagatagacgacggc

SEQ ID NO: 31155 - DNA, 21 bp, Artificial sequence
  SiRNA target sequence
ttgaaaagatagacgacggca

SEQ ID NO: 31156 - DNA, 21 bp, Artificial sequence
  SiRNA target sequence
tgaaaagatagacgacggcat

SEQ ID NO: 31157 - DNA, 21 bp, Artificial sequence
  SiRNA target sequence
gaaaagatagacgacggcatg

SEQ ID NO: 31158 - DNA, 21 bp, Artificial sequence
  SiRNA target sequence
aaaagatagacgacggcatga

SEQ ID NO: 31159 - DNA, 21 bp, Artificial sequence
  SiRNA target sequence
aaagatagacgacggcatgat

SEQ ID NO: 31160 - DNA, 21 bp, Artificial sequence
  SiRNA target sequence
aagatagacgacggcatgata

SEQ ID NO: 31161 - DNA, 21 bp, Artificial sequence
  SiRNA target sequence
agatagacgacggcatgatag

SEQ ID NO: 31162 - DNA, 21 bp, Artificial sequence
  SiRNA target sequence
gatagacgacggcatgatagt

SEQ ID NO: 31163 - DNA, 21 bp, Artificial sequence
  SiRNA target sequence
atagacgacggcatgatagtg

SEQ ID NO: 31164 - DNA, 21 bp, Artificial sequence
  SiRNA target sequence
tagacgacggcatgatagtgg

SEQ ID NO: 31165 - DNA, 21 bp, Artificial sequence
  SiRNA target sequence
agacgacggcatgatagtggg

SEQ ID NO: 31166 - DNA, 21 bp, Artificial sequence
  SiRNA target sequence
gacgacggcatgatagtgggc

SEQ ID NO: 31167 - DNA, 21 bp, Artificial sequence
  SiRNA target sequence
acgacggcatgatagtgggct

SEQ ID NO: 31168 - DNA, 21 bp, Artificial sequence
  SiRNA target sequence
cgacggcatgatagtgggcta

SEQ ID NO: 31169 - DNA, 21 bp, Artificial sequence
  SiRNA target sequence
gacggcatgatagtgggctac

SEQ ID NO: 31170 - DNA, 21 bp, Artificial sequence
  SiRNA target sequence
acggcatgatagtgggctacg

SEQ ID NO: 31171 - DNA, 21 bp, Artificial sequence
  SiRNA target sequence
cggcatgatagtgggctacgg

SEQ ID NO: 31172 - DNA, 21 bp, Artificial sequence
  SiRNA target sequence
ggcatgatagtgggctacggt

SEQ ID NO: 31173 - DNA, 21 bp, Artificial sequence
  SiRNA target sequence
gcatgatagtgggctacggtg

SEQ ID NO: 31174 - DNA, 21 bp, Artificial sequence
  SiRNA target sequence
catgatagtgggctacggtga

SEQ ID NO: 31175 - DNA, 21 bp, Artificial sequence
  SiRNA target sequence
atgatagtgggctacggtgaa

SEQ ID NO: 31176 - DNA, 21 bp, Artificial sequence
  SiRNA target sequence
tgatagtgggctacggtgaag

SEQ ID NO: 31177 - DNA, 21 bp, Artificial sequence
  SiRNA target sequence
gatagtgggctacggtgaaga

SEQ ID NO: 31178 - DNA, 21 bp, Artificial sequence
  SiRNA target sequence
atagtgggctacggtgaagag

SEQ ID NO: 31179 - DNA, 21 bp, Artificial sequence
  SiRNA target sequence
tagtgggctacggtgaagagc

SEQ ID NO: 31180 - DNA, 21 bp, Artificial sequence
  SiRNA target sequence
agtgggctacggtgaagagca

SEQ ID NO: 31181 - DNA, 21 bp, Artificial sequence
  SiRNA target sequence
gtgggctacggtgaagagcat

SEQ ID NO: 31182 - DNA, 21 bp, Artificial sequence
  SiRNA target sequence
tgggctacggtgaagagcatt

SEQ ID NO: 31183 - DNA, 21 bp, Artificial sequence
  SiRNA target sequence
gggctacggtgaagagcattt

SEQ ID NO: 31184 - DNA, 21 bp, Artificial sequence
  SiRNA target sequence
ggctacggtgaagagcatttt

SEQ ID NO: 31185 - DNA, 21 bp, Artificial sequence
  SiRNA target sequence
gctacggtgaagagcattttt

SEQ ID NO: 31186 - DNA, 21 bp, Artificial sequence
  SiRNA target sequence
ctacggtgaagagcattttta

SEQ ID NO: 31187 - DNA, 21 bp, Artificial sequence
  SiRNA target sequence
tacggtgaagagcatttttac

SEQ ID NO: 31188 - DNA, 21 bp, Artificial sequence
  SiRNA target sequence
acggtgaagagcatttttaca

SEQ ID NO: 31189 - DNA, 21 bp, Artificial sequence
  SiRNA target sequence
cggtgaagagcatttttacat

SEQ ID NO: 31190 - DNA, 21 bp, Artificial sequence
  SiRNA target sequence
ggtgaagagcatttttacatg

SEQ ID NO: 31191 - DNA, 21 bp, Artificial sequence
  SiRNA target sequence
gtgaagagcatttttacatgc

SEQ ID NO: 31192 - DNA, 21 bp, Artificial sequence
  SiRNA target sequence
tgaagagcatttttacatgct

SEQ ID NO: 31193 - DNA, 21 bp, Artificial sequence
  SiRNA target sequence
gaagagcatttttacatgctt

SEQ ID NO: 31194 - DNA, 21 bp, Artificial sequence
  SiRNA target sequence
aagagcatttttacatgcttt

SEQ ID NO: 31195 - DNA, 21 bp, Artificial sequence
  SiRNA target sequence
agagcatttttacatgctttt

SEQ ID NO: 31196 - DNA, 21 bp, Artificial sequence
  SiRNA target sequence
gagcatttttacatgcttttt

SEQ ID NO: 31197 - DNA, 21 bp, Artificial sequence
  SiRNA target sequence
agcatttttacatgctttttc

SEQ ID NO: 31198 - DNA, 21 bp, Artificial sequence
  SiRNA target sequence
gcatttttacatgctttttct

SEQ ID NO: 31199 - DNA, 21 bp, Artificial sequence
  SiRNA target sequence
catttttacatgctttttctg

SEQ ID NO: 31200 - DNA, 21 bp, Artificial sequence
  SiRNA target sequence
atttttacatgctttttctgg

SEQ ID NO: 31201 - DNA, 21 bp, Artificial sequence
  SiRNA target sequence
tttttacatgctttttctgga

SEQ ID NO: 31202 - DNA, 21 bp, Artificial sequence
  SiRNA target sequence
ttttacatgctttttctggaa

SEQ ID NO: 31203 - DNA, 21 bp, Artificial sequence
  SiRNA target sequence
tttacatgctttttctggaag

SEQ ID NO: 31204 - DNA, 21 bp, Artificial sequence
  SiRNA target sequence
ttacatgctttttctggaagc

SEQ ID NO: 31205 - DNA, 21 bp, Artificial sequence
  SiRNA target sequence
tacatgctttttctggaagcc

SEQ ID NO: 31206 - DNA, 21 bp, Artificial sequence
  SiRNA target sequence
acatgctttttctggaagccg

SEQ ID NO: 31207 - DNA, 21 bp, Artificial sequence
  SiRNA target sequence
catgctttttctggaagccgg

SEQ ID NO: 31208 - DNA, 21 bp, Artificial sequence
  SiRNA target sequence
atgctttttctggaagccggg

SEQ ID NO: 31209 - DNA, 21 bp, Artificial sequence
  SiRNA target sequence
tgctttttctggaagccggga

SEQ ID NO: 31210 - DNA, 21 bp, Artificial sequence
  SiRNA target sequence
gctttttctggaagccgggac

SEQ ID NO: 31211 - DNA, 21 bp, Artificial sequence
  SiRNA target sequence
ctttttctggaagccgggaca

SEQ ID NO: 31212 - DNA, 21 bp, Artificial sequence
  SiRNA target sequence
tttttctggaagccgggacat

SEQ ID NO: 31213 - DNA, 21 bp, Artificial sequence
  SiRNA target sequence
ttttctggaagccgggacatc

SEQ ID NO: 31214 - DNA, 21 bp, Artificial sequence
  SiRNA target sequence
tttctggaagccgggacatct

SEQ ID NO: 31215 - DNA, 21 bp, Artificial sequence
  SiRNA target sequence
ttctggaagccgggacatctg

SEQ ID NO: 31216 - DNA, 21 bp, Artificial sequence
  SiRNA target sequence
tctggaagccgggacatctga

SEQ ID NO: 31217 - DNA, 21 bp, Artificial sequence
  SiRNA target sequence
ctggaagccgggacatctgag

SEQ ID NO: 31218 - DNA, 21 bp, Artificial sequence
  SiRNA target sequence
tggaagccgggacatctgagc

SEQ ID NO: 31219 - DNA, 21 bp, Artificial sequence
  SiRNA target sequence
ggaagccgggacatctgagcg

SEQ ID NO: 31220 - DNA, 21 bp, Artificial sequence
  SiRNA target sequence
gaagccgggacatctgagcga

SEQ ID NO: 31221 - DNA, 21 bp, Artificial sequence
  SiRNA target sequence
aagccgggacatctgagcgat

SEQ ID NO: 31222 - DNA, 21 bp, Artificial sequence
  SiRNA target sequence
agccgggacatctgagcgata

SEQ ID NO: 31223 - DNA, 21 bp, Artificial sequence
  SiRNA target sequence
gccgggacatctgagcgatat

SEQ ID NO: 31224 - DNA, 21 bp, Artificial sequence
  SiRNA target sequence
ccgggacatctgagcgatata

SEQ ID NO: 31225 - DNA, 21 bp, Artificial sequence
  SiRNA target sequence
cgggacatctgagcgatatac

SEQ ID NO: 31226 - DNA, 21 bp, Artificial sequence
  SiRNA target sequence
gggacatctgagcgatataca

SEQ ID NO: 31227 - DNA, 21 bp, Artificial sequence
  SiRNA target sequence
ggacatctgagcgatatacaa

SEQ ID NO: 31228 - DNA, 21 bp, Artificial sequence
  SiRNA target sequence
gacatctgagcgatatacaaa

SEQ ID NO: 31229 - DNA, 21 bp, Artificial sequence
  SiRNA target sequence
acatctgagcgatatacaaaa

SEQ ID NO: 31230 - DNA, 21 bp, Artificial sequence
  SiRNA target sequence
catctgagcgatatacaaaaa

SEQ ID NO: 31231 - DNA, 21 bp, Artificial sequence
  SiRNA target sequence
atctgagcgatatacaaaaac

SEQ ID NO: 31232 - DNA, 21 bp, Artificial sequence
  SiRNA target sequence
tctgagcgatatacaaaaaca

SEQ ID NO: 31233 - DNA, 21 bp, Artificial sequence
  SiRNA target sequence
ctgagcgatatacaaaaacaa

SEQ ID NO: 31234 - DNA, 21 bp, Artificial sequence
  SiRNA target sequence
tgagcgatatacaaaaacaaa

SEQ ID NO: 31235 - DNA, 21 bp, Artificial sequence
  SiRNA target sequence
gagcgatatacaaaaacaaag

SEQ ID NO: 31236 - DNA, 21 bp, Artificial sequence
  SiRNA target sequence
agcgatatacaaaaacaaaga

SEQ ID NO: 31237 - DNA, 21 bp, Artificial sequence
  SiRNA target sequence
gcgatatacaaaaacaaagaa

SEQ ID NO: 31238 - DNA, 21 bp, Artificial sequence
  SiRNA target sequence
cgatatacaaaaacaaagaaa

SEQ ID NO: 31239 - DNA, 21 bp, Artificial sequence
  SiRNA target sequence
gatatacaaaaacaaagaaat

SEQ ID NO: 31240 - DNA, 21 bp, Artificial sequence
  SiRNA target sequence
atatacaaaaacaaagaaata

SEQ ID NO: 31241 - DNA, 21 bp, Artificial sequence
  SiRNA target sequence
tatacaaaaacaaagaaatac

SEQ ID NO: 31242 - DNA, 21 bp, Artificial sequence
  SiRNA target sequence
atacaaaaacaaagaaataca

SEQ ID NO: 31243 - DNA, 21 bp, Artificial sequence
  SiRNA target sequence
tacaaaaacaaagaaatacaa

SEQ ID NO: 31244 - DNA, 21 bp, Artificial sequence
  SiRNA target sequence
acaaaaacaaagaaatacaaa

SEQ ID NO: 31245 - DNA, 21 bp, Artificial sequence
  SiRNA target sequence
caaaaacaaagaaatacaaag

SEQ ID NO: 31246 - DNA, 21 bp, Artificial sequence
  SiRNA target sequence
aaaaacaaagaaatacaaagg

SEQ ID NO: 31247 - DNA, 21 bp, Artificial sequence
  SiRNA target sequence
aaaacaaagaaatacaaaggt

SEQ ID NO: 31248 - DNA, 21 bp, Artificial sequence
  SiRNA target sequence
aaacaaagaaatacaaaggta

SEQ ID NO: 31249 - DNA, 21 bp, Artificial sequence
  SiRNA target sequence
aacaaagaaatacaaaggtaa

SEQ ID NO: 31250 - DNA, 21 bp, Artificial sequence
  SiRNA target sequence
acaaagaaatacaaaggtaaa

SEQ ID NO: 31251 - DNA, 21 bp, Artificial sequence
  SiRNA target sequence
caaagaaatacaaaggtaaag

SEQ ID NO: 31252 - DNA, 21 bp, Artificial sequence
  SiRNA target sequence
aaagaaatacaaaggtaaagt

SEQ ID NO: 31253 - DNA, 21 bp, Artificial sequence
  SiRNA target sequence
aagaaatacaaaggtaaagta

SEQ ID NO: 31254 - DNA, 21 bp, Artificial sequence
  SiRNA target sequence
agaaatacaaaggtaaagtat

SEQ ID NO: 31255 - DNA, 21 bp, Artificial sequence
  SiRNA target sequence
gaaatacaaaggtaaagtatc

SEQ ID NO: 31256 - DNA, 21 bp, Artificial sequence
  SiRNA target sequence
aaatacaaaggtaaagtatcc

SEQ ID NO: 31257 - DNA, 21 bp, Artificial sequence
  SiRNA target sequence
aatacaaaggtaaagtatccg

SEQ ID NO: 31258 - DNA, 21 bp, Artificial sequence
  SiRNA target sequence
atacaaaggtaaagtatccgc

SEQ ID NO: 31259 - DNA, 21 bp, Artificial sequence
  SiRNA target sequence
tacaaaggtaaagtatccgca

SEQ ID NO: 31260 - DNA, 21 bp, Artificial sequence
  SiRNA target sequence
acaaaggtaaagtatccgcaa

SEQ ID NO: 31261 - DNA, 21 bp, Artificial sequence
  SiRNA target sequence
caaaggtaaagtatccgcaag

SEQ ID NO: 31262 - DNA, 21 bp, Artificial sequence
  SiRNA target sequence
aaaggtaaagtatccgcaaga

SEQ ID NO: 31263 - DNA, 21 bp, Artificial sequence
  SiRNA target sequence
aaggtaaagtatccgcaagag

SEQ ID NO: 31264 - DNA, 21 bp, Artificial sequence
  SiRNA target sequence
aggtaaagtatccgcaagagg

SEQ ID NO: 31265 - DNA, 21 bp, Artificial sequence
  SiRNA target sequence
ggtaaagtatccgcaagagga

SEQ ID NO: 31266 - DNA, 21 bp, Artificial sequence
  SiRNA target sequence
gtaaagtatccgcaagaggaa

SEQ ID NO: 31267 - DNA, 21 bp, Artificial sequence
  SiRNA target sequence
taaagtatccgcaagaggaaa

SEQ ID NO: 31268 - DNA, 21 bp, Artificial sequence
  SiRNA target sequence
aaagtatccgcaagaggaaat

SEQ ID NO: 31269 - DNA, 21 bp, Artificial sequence
  SiRNA target sequence
aagtatccgcaagaggaaatg

SEQ ID NO: 31270 - DNA, 21 bp, Artificial sequence
  SiRNA target sequence
agtatccgcaagaggaaatgt

SEQ ID NO: 31271 - DNA, 21 bp, Artificial sequence
  SiRNA target sequence
gtatccgcaagaggaaatgta

SEQ ID NO: 31272 - DNA, 21 bp, Artificial sequence
  SiRNA target sequence
tatccgcaagaggaaatgtag

SEQ ID NO: 31273 - DNA, 21 bp, Artificial sequence
  SiRNA target sequence
atccgcaagaggaaatgtaga

SEQ ID NO: 31274 - DNA, 21 bp, Artificial sequence
  SiRNA target sequence
tccgcaagaggaaatgtagag

SEQ ID NO: 31275 - DNA, 21 bp, Artificial sequence
  SiRNA target sequence
ccgcaagaggaaatgtagagc

SEQ ID NO: 31276 - DNA, 21 bp, Artificial sequence
  SiRNA target sequence
cgcaagaggaaatgtagagcg

SEQ ID NO: 31277 - DNA, 21 bp, Artificial sequence
  SiRNA target sequence
gcaagaggaaatgtagagcgg

SEQ ID NO: 31278 - DNA, 21 bp, Artificial sequence
  SiRNA target sequence
caagaggaaatgtagagcgga

SEQ ID NO: 31279 - DNA, 21 bp, Artificial sequence
  SiRNA target sequence
aagaggaaatgtagagcggat

SEQ ID NO: 31280 - DNA, 21 bp, Artificial sequence
  SiRNA target sequence
agaggaaatgtagagcggatc

SEQ ID NO: 31281 - DNA, 21 bp, Artificial sequence
  SiRNA target sequence
gaggaaatgtagagcggatct

SEQ ID NO: 31282 - DNA, 21 bp, Artificial sequence
  SiRNA target sequence
aggaaatgtagagcggatcta

SEQ ID NO: 31283 - DNA, 21 bp, Artificial sequence
  SiRNA target sequence
ggaaatgtagagcggatctat

SEQ ID NO: 31284 - DNA, 21 bp, Artificial sequence
  SiRNA target sequence
gaaatgtagagcggatctata

SEQ ID NO: 31285 - DNA, 21 bp, Artificial sequence
  SiRNA target sequence
aaatgtagagcggatctataa

SEQ ID NO: 31286 - DNA, 21 bp, Artificial sequence
  SiRNA target sequence
aatgtagagcggatctataat

SEQ ID NO: 31287 - DNA, 21 bp, Artificial sequence
  SiRNA target sequence
atgtagagcggatctataata

SEQ ID NO: 31288 - DNA, 21 bp, Artificial sequence
  SiRNA target sequence
tgtagagcggatctataatag

SEQ ID NO: 31289 - DNA, 21 bp, Artificial sequence
  SiRNA target sequence
gtagagcggatctataatagc

SEQ ID NO: 31290 - DNA, 21 bp, Artificial sequence
  SiRNA target sequence
tagagcggatctataatagca

SEQ ID NO: 31291 - DNA, 21 bp, Artificial sequence
  SiRNA target sequence
agagcggatctataatagcaa

SEQ ID NO: 31292 - DNA, 21 bp, Artificial sequence
  SiRNA target sequence
gagcggatctataatagcaac

SEQ ID NO: 31293 - DNA, 21 bp, Artificial sequence
  SiRNA target sequence
agcggatctataatagcaacg

SEQ ID NO: 31294 - DNA, 21 bp, Artificial sequence
  SiRNA target sequence
gcggatctataatagcaacga

SEQ ID NO: 31295 - DNA, 21 bp, Artificial sequence
  SiRNA target sequence
cggatctataatagcaacgag

SEQ ID NO: 31296 - DNA, 21 bp, Artificial sequence
  SiRNA target sequence
ggatctataatagcaacgaga

SEQ ID NO: 31297 - DNA, 21 bp, Artificial sequence
  SiRNA target sequence
gatctataatagcaacgagaa

SEQ ID NO: 31298 - DNA, 21 bp, Artificial sequence
  SiRNA target sequence
atctataatagcaacgagaaa

SEQ ID NO: 31299 - DNA, 21 bp, Artificial sequence
  SiRNA target sequence
tctataatagcaacgagaaaa

SEQ ID NO: 31300 - DNA, 21 bp, Artificial sequence
  SiRNA target sequence
ctataatagcaacgagaaaaa

SEQ ID NO: 31301 - DNA, 21 bp, Artificial sequence
  SiRNA target sequence
tataatagcaacgagaaaaag

SEQ ID NO: 31302 - DNA, 21 bp, Artificial sequence
  SiRNA target sequence
ataatagcaacgagaaaaagg

SEQ ID NO: 31303 - DNA, 21 bp, Artificial sequence
  SiRNA target sequence
taatagcaacgagaaaaaggc

SEQ ID NO: 31304 - DNA, 21 bp, Artificial sequence
  SiRNA target sequence
aatagcaacgagaaaaaggca

SEQ ID NO: 31305 - DNA, 21 bp, Artificial sequence
  SiRNA target sequence
atagcaacgagaaaaaggcac

SEQ ID NO: 31306 - DNA, 21 bp, Artificial sequence
  SiRNA target sequence
tagcaacgagaaaaaggcact

SEQ ID NO: 31307 - DNA, 21 bp, Artificial sequence
  SiRNA target sequence
agcaacgagaaaaaggcactg

SEQ ID NO: 31308 - DNA, 21 bp, Artificial sequence
  SiRNA target sequence
gcaacgagaaaaaggcactga

SEQ ID NO: 31309 - DNA, 21 bp, Artificial sequence
  SiRNA target sequence
caacgagaaaaaggcactgaa

SEQ ID NO: 31310 - DNA, 21 bp, Artificial sequence
  SiRNA target sequence
aacgagaaaaaggcactgaaa

SEQ ID NO: 31311 - DNA, 21 bp, Artificial sequence
  SiRNA target sequence
acgagaaaaaggcactgaaag

SEQ ID NO: 31312 - DNA, 21 bp, Artificial sequence
  SiRNA target sequence
cgagaaaaaggcactgaaagc

SEQ ID NO: 31313 - DNA, 21 bp, Artificial sequence
  SiRNA target sequence
gagaaaaaggcactgaaagct

SEQ ID NO: 31314 - DNA, 21 bp, Artificial sequence
  SiRNA target sequence
agaaaaaggcactgaaagcta

SEQ ID NO: 31315 - DNA, 21 bp, Artificial sequence
  SiRNA target sequence
gaaaaaggcactgaaagctat

SEQ ID NO: 31316 - DNA, 21 bp, Artificial sequence
  SiRNA target sequence
aaaaaggcactgaaagctatg

SEQ ID NO: 31317 - DNA, 21 bp, Artificial sequence
  SiRNA target sequence
aaaaggcactgaaagctatgc

SEQ ID NO: 31318 - DNA, 21 bp, Artificial sequence
  SiRNA target sequence
aaaggcactgaaagctatgca

SEQ ID NO: 31319 - DNA, 21 bp, Artificial sequence
  SiRNA target sequence
aaggcactgaaagctatgcag

SEQ ID NO: 31320 - DNA, 21 bp, Artificial sequence
  SiRNA target sequence
aggcactgaaagctatgcagg

SEQ ID NO: 31321 - DNA, 21 bp, Artificial sequence
  SiRNA target sequence
ggcactgaaagctatgcagga

SEQ ID NO: 31322 - DNA, 21 bp, Artificial sequence
  SiRNA target sequence
gcactgaaagctatgcaggag

SEQ ID NO: 31323 - DNA, 21 bp, Artificial sequence
  SiRNA target sequence
cactgaaagctatgcaggagg

SEQ ID NO: 31324 - DNA, 21 bp, Artificial sequence
  SiRNA target sequence
actgaaagctatgcaggaggc

SEQ ID NO: 31325 - DNA, 21 bp, Artificial sequence
  SiRNA target sequence
ctgaaagctatgcaggaggcg

SEQ ID NO: 31326 - DNA, 21 bp, Artificial sequence
  SiRNA target sequence
tgaaagctatgcaggaggcgg

SEQ ID NO: 31327 - DNA, 21 bp, Artificial sequence
  SiRNA target sequence
gaaagctatgcaggaggcggt

SEQ ID NO: 31328 - DNA, 21 bp, Artificial sequence
  SiRNA target sequence
aaagctatgcaggaggcggtg

SEQ ID NO: 31329 - DNA, 21 bp, Artificial sequence
  SiRNA target sequence
aagctatgcaggaggcggtga

SEQ ID NO: 31330 - DNA, 21 bp, Artificial sequence
  SiRNA target sequence
agctatgcaggaggcggtgaa

SEQ ID NO: 31331 - DNA, 21 bp, Artificial sequence
  SiRNA target sequence
gctatgcaggaggcggtgaaa

SEQ ID NO: 31332 - DNA, 21 bp, Artificial sequence
  SiRNA target sequence
ctatgcaggaggcggtgaaac

SEQ ID NO: 31333 - DNA, 21 bp, Artificial sequence
  SiRNA target sequence
tatgcaggaggcggtgaaacg

SEQ ID NO: 31334 - DNA, 21 bp, Artificial sequence
  SiRNA target sequence
atgcaggaggcggtgaaacgt

SEQ ID NO: 31335 - DNA, 21 bp, Artificial sequence
  SiRNA target sequence
tgcaggaggcggtgaaacgtg

SEQ ID NO: 31336 - DNA, 21 bp, Artificial sequence
  SiRNA target sequence
gcaggaggcggtgaaacgtga

SEQ ID NO: 31337 - DNA, 21 bp, Artificial sequence
  SiRNA target sequence
caggaggcggtgaaacgtgag

SEQ ID NO: 31338 - DNA, 21 bp, Artificial sequence
  SiRNA target sequence
aggaggcggtgaaacgtgagt

SEQ ID NO: 31339 - DNA, 21 bp, Artificial sequence
  SiRNA target sequence
ggaggcggtgaaacgtgagtt

SEQ ID NO: 31340 - DNA, 21 bp, Artificial sequence
  SiRNA target sequence
gaggcggtgaaacgtgagttg

SEQ ID NO: 31341 - DNA, 21 bp, Artificial sequence
  SiRNA target sequence
aggcggtgaaacgtgagttga

SEQ ID NO: 31342 - DNA, 21 bp, Artificial sequence
  SiRNA target sequence
ggcggtgaaacgtgagttgaa

SEQ ID NO: 31343 - DNA, 21 bp, Artificial sequence
  SiRNA target sequence
gcggtgaaacgtgagttgaac

SEQ ID NO: 31344 - DNA, 21 bp, Artificial sequence
  SiRNA target sequence
cggtgaaacgtgagttgaacc

SEQ ID NO: 31345 - DNA, 21 bp, Artificial sequence
  SiRNA target sequence
ggtgaaacgtgagttgaacct

SEQ ID NO: 31346 - DNA, 21 bp, Artificial sequence
  SiRNA target sequence
gtgaaacgtgagttgaaccta

SEQ ID NO: 31347 - DNA, 21 bp, Artificial sequence
  SiRNA target sequence
tgaaacgtgagttgaacctat

SEQ ID NO: 31348 - DNA, 21 bp, Artificial sequence
  SiRNA target sequence
gaaacgtgagttgaacctatg

SEQ ID NO: 31349 - DNA, 21 bp, Artificial sequence
  SiRNA target sequence
aaacgtgagttgaacctatga

SEQ ID NO: 31350 - DNA, 21 bp, Artificial sequence
  SiRNA target sequence
aacgtgagttgaacctatgac

SEQ ID NO: 31351 - DNA, 21 bp, Artificial sequence
  SiRNA target sequence
acgtgagttgaacctatgacc

SEQ ID NO: 31352 - DNA, 21 bp, Artificial sequence
  SiRNA target sequence
cgtgagttgaacctatgacca

SEQ ID NO: 31353 - DNA, 21 bp, Artificial sequence
  SiRNA target sequence
gtgagttgaacctatgaccat

SEQ ID NO: 31354 - DNA, 21 bp, Artificial sequence
  SiRNA target sequence
tgagttgaacctatgaccata

SEQ ID NO: 31355 - DNA, 21 bp, Artificial sequence
  SiRNA target sequence
gagttgaacctatgaccatac

SEQ ID NO: 31356 - DNA, 21 bp, Artificial sequence
  SiRNA target sequence
agttgaacctatgaccataca

SEQ ID NO: 31357 - DNA, 21 bp, Artificial sequence
  SiRNA target sequence
gttgaacctatgaccatacaa

SEQ ID NO: 31358 - DNA, 21 bp, Artificial sequence
  SiRNA target sequence
ttgaacctatgaccatacaaa

SEQ ID NO: 31359 - DNA, 21 bp, Artificial sequence
  SiRNA target sequence
tgaacctatgaccatacaaag

SEQ ID NO: 31360 - DNA, 21 bp, Artificial sequence
  SiRNA target sequence
gaacctatgaccatacaaagt

SEQ ID NO: 31361 - DNA, 21 bp, Artificial sequence
  SiRNA target sequence
aacctatgaccatacaaagtt

SEQ ID NO: 31362 - DNA, 21 bp, Artificial sequence
  SiRNA target sequence
acctatgaccatacaaagttt

SEQ ID NO: 31363 - DNA, 21 bp, Artificial sequence
  SiRNA target sequence
cctatgaccatacaaagtttg

SEQ ID NO: 31364 - DNA, 21 bp, Artificial sequence
  SiRNA target sequence
ctatgaccatacaaagtttga

SEQ ID NO: 31365 - DNA, 21 bp, Artificial sequence
  SiRNA target sequence
tatgaccatacaaagtttgat

SEQ ID NO: 31366 - DNA, 21 bp, Artificial sequence
  SiRNA target sequence
atgaccatacaaagtttgata

SEQ ID NO: 31367 - DNA, 21 bp, Artificial sequence
  SiRNA target sequence
tgaccatacaaagtttgatac

SEQ ID NO: 31368 - DNA, 21 bp, Artificial sequence
  SiRNA target sequence
gaccatacaaagtttgatact

SEQ ID NO: 31369 - DNA, 21 bp, Artificial sequence
  SiRNA target sequence
accatacaaagtttgatactt

SEQ ID NO: 31370 - DNA, 21 bp, Artificial sequence
  SiRNA target sequence
ccatacaaagtttgatactta

SEQ ID NO: 31371 - DNA, 21 bp, Artificial sequence
  SiRNA target sequence
catacaaagtttgatacttag

SEQ ID NO: 31372 - DNA, 21 bp, Artificial sequence
  SiRNA target sequence
atacaaagtttgatacttagc

SEQ ID NO: 31373 - DNA, 21 bp, Artificial sequence
  SiRNA target sequence
tacaaagtttgatacttagca

SEQ ID NO: 31374 - DNA, 21 bp, Artificial sequence
  SiRNA target sequence
acaaagtttgatacttagcaa

SEQ ID NO: 31375 - DNA, 21 bp, Artificial sequence
  SiRNA target sequence
caaagtttgatacttagcaaa

SEQ ID NO: 31376 - DNA, 21 bp, Artificial sequence
  SiRNA target sequence
aaagtttgatacttagcaaac

SEQ ID NO: 31377 - DNA, 21 bp, Artificial sequence
  SiRNA target sequence
aagtttgatacttagcaaact

SEQ ID NO: 31378 - DNA, 21 bp, Artificial sequence
  SiRNA target sequence
agtttgatacttagcaaacta

SEQ ID NO: 31379 - DNA, 21 bp, Artificial sequence
  SiRNA target sequence
gtttgatacttagcaaactaa

SEQ ID NO: 31380 - DNA, 21 bp, Artificial sequence
  SiRNA target sequence
tttgatacttagcaaactaag

SEQ ID NO: 31381 - DNA, 21 bp, Artificial sequence
  SiRNA target sequence
ttgatacttagcaaactaagg

SEQ ID NO: 31382 - DNA, 21 bp, Artificial sequence
  SiRNA target sequence
tgatacttagcaaactaaggg

SEQ ID NO: 31383 - DNA, 21 bp, Artificial sequence
  SiRNA target sequence
gatacttagcaaactaaggga

SEQ ID NO: 31384 - DNA, 21 bp, Artificial sequence
  SiRNA target sequence
atacttagcaaactaagggaa

SEQ ID NO: 31385 - DNA, 21 bp, Artificial sequence
  SiRNA target sequence
tacttagcaaactaagggaac

SEQ ID NO: 31386 - DNA, 21 bp, Artificial sequence
  SiRNA target sequence
acttagcaaactaagggaact

SEQ ID NO: 31387 - DNA, 21 bp, Artificial sequence
  SiRNA target sequence
cttagcaaactaagggaacta

SEQ ID NO: 31388 - DNA, 21 bp, Artificial sequence
  SiRNA target sequence
ttagcaaactaagggaactac

SEQ ID NO: 31389 - DNA, 21 bp, Artificial sequence
  SiRNA target sequence
tagcaaactaagggaactacc

SEQ ID NO: 31390 - DNA, 21 bp, Artificial sequence
  SiRNA target sequence
agcaaactaagggaactaccc

SEQ ID NO: 31391 - DNA, 21 bp, Artificial sequence
  SiRNA target sequence
gcaaactaagggaactacccg

SEQ ID NO: 31392 - DNA, 21 bp, Artificial sequence
  SiRNA target sequence
caaactaagggaactacccgt

SEQ ID NO: 31393 - DNA, 21 bp, Artificial sequence
  SiRNA target sequence
aaactaagggaactacccgtt

SEQ ID NO: 31394 - DNA, 21 bp, Artificial sequence
  SiRNA target sequence
aactaagggaactacccgttc

SEQ ID NO: 31395 - DNA, 21 bp, Artificial sequence
  SiRNA target sequence
actaagggaactacccgttcc

SEQ ID NO: 31396 - DNA, 21 bp, Artificial sequence
  SiRNA target sequence
ctaagggaactacccgttcca

SEQ ID NO: 31397 - DNA, 21 bp, Artificial sequence
  SiRNA target sequence
taagggaactacccgttccag

SEQ ID NO: 31398 - DNA, 21 bp, Artificial sequence
  SiRNA target sequence
aagggaactacccgttccagt

SEQ ID NO: 31399 - DNA, 21 bp, Artificial sequence
  SiRNA target sequence
agggaactacccgttccagtg

SEQ ID NO: 31400 - DNA, 21 bp, Artificial sequence
  SiRNA target sequence
gggaactacccgttccagtgg

SEQ ID NO: 31401 - DNA, 21 bp, Artificial sequence
  SiRNA target sequence
ggaactacccgttccagtggc

SEQ ID NO: 31402 - DNA, 21 bp, Artificial sequence
  SiRNA target sequence
gaactacccgttccagtggcg

SEQ ID NO: 31403 - DNA, 21 bp, Artificial sequence
  SiRNA target sequence
aactacccgttccagtggcgt

SEQ ID NO: 31404 - DNA, 21 bp, Artificial sequence
  SiRNA target sequence
actacccgttccagtggcgtt

SEQ ID NO: 31405 - DNA, 21 bp, Artificial sequence
  SiRNA target sequence
ctacccgttccagtggcgttt

SEQ ID NO: 31406 - DNA, 21 bp, Artificial sequence
  SiRNA target sequence
tacccgttccagtggcgtttg

SEQ ID NO: 31407 - DNA, 21 bp, Artificial sequence
  SiRNA target sequence
acccgttccagtggcgtttga

SEQ ID NO: 31408 - DNA, 21 bp, Artificial sequence
  SiRNA target sequence
cccgttccagtggcgtttgag

SEQ ID NO: 31409 - DNA, 21 bp, Artificial sequence
  SiRNA target sequence
ccgttccagtggcgtttgaga

SEQ ID NO: 31410 - DNA, 21 bp, Artificial sequence
  SiRNA target sequence
cgttccagtggcgtttgagac

SEQ ID NO: 31411 - DNA, 21 bp, Artificial sequence
  SiRNA target sequence
gttccagtggcgtttgagacg

SEQ ID NO: 31412 - DNA, 21 bp, Artificial sequence
  SiRNA target sequence
ttccagtggcgtttgagacgc

SEQ ID NO: 31413 - DNA, 21 bp, Artificial sequence
  SiRNA target sequence
tccagtggcgtttgagacgca

SEQ ID NO: 31414 - DNA, 21 bp, Artificial sequence
  SiRNA target sequence
ccagtggcgtttgagacgcat

SEQ ID NO: 31415 - DNA, 21 bp, Artificial sequence
  SiRNA target sequence
cagtggcgtttgagacgcatt

SEQ ID NO: 31416 - DNA, 21 bp, Artificial sequence
  SiRNA target sequence
agtggcgtttgagacgcattt

SEQ ID NO: 31417 - DNA, 21 bp, Artificial sequence
  SiRNA target sequence
gtggcgtttgagacgcatttt

SEQ ID NO: 31418 - DNA, 21 bp, Artificial sequence
  SiRNA target sequence
tggcgtttgagacgcattttg

SEQ ID NO: 31419 - DNA, 21 bp, Artificial sequence
  SiRNA target sequence
ggcgtttgagacgcattttga

SEQ ID NO: 31420 - DNA, 21 bp, Artificial sequence
  SiRNA target sequence
gcgtttgagacgcattttgag

SEQ ID NO: 31421 - DNA, 21 bp, Artificial sequence
  SiRNA target sequence
cgtttgagacgcattttgaga

SEQ ID NO: 31422 - DNA, 21 bp, Artificial sequence
  SiRNA target sequence
gtttgagacgcattttgagaa

SEQ ID NO: 31423 - DNA, 21 bp, Artificial sequence
  SiRNA target sequence
tttgagacgcattttgagaaa

SEQ ID NO: 31424 - DNA, 21 bp, Artificial sequence
  SiRNA target sequence
ttgagacgcattttgagaaag

SEQ ID NO: 31425 - DNA, 21 bp, Artificial sequence
  SiRNA target sequence
tgagacgcattttgagaaaga

SEQ ID NO: 31426 - DNA, 21 bp, Artificial sequence
  SiRNA target sequence
gagacgcattttgagaaagag

SEQ ID NO: 31427 - DNA, 21 bp, Artificial sequence
  SiRNA target sequence
agacgcattttgagaaagaga

SEQ ID NO: 31428 - DNA, 21 bp, Artificial sequence
  SiRNA target sequence
gacgcattttgagaaagagaa

SEQ ID NO: 31429 - DNA, 21 bp, Artificial sequence
  SiRNA target sequence
acgcattttgagaaagagaat

SEQ ID NO: 31430 - DNA, 21 bp, Artificial sequence
  SiRNA target sequence
cgcattttgagaaagagaata

SEQ ID NO: 31431 - DNA, 21 bp, Artificial sequence
  SiRNA target sequence
gcattttgagaaagagaatat

SEQ ID NO: 31432 - DNA, 21 bp, Artificial sequence
  SiRNA target sequence
cattttgagaaagagaatatg

SEQ ID NO: 31433 - DNA, 21 bp, Artificial sequence
  SiRNA target sequence
attttgagaaagagaatatgt

SEQ ID NO: 31434 - DNA, 21 bp, Artificial sequence
  SiRNA target sequence
ttttgagaaagagaatatgta

SEQ ID NO: 31435 - DNA, 21 bp, Artificial sequence
  SiRNA target sequence
tttgagaaagagaatatgtat

SEQ ID NO: 31436 - DNA, 21 bp, Artificial sequence
  SiRNA target sequence
ttgagaaagagaatatgtatg

SEQ ID NO: 31437 - DNA, 21 bp, Artificial sequence
  SiRNA target sequence
tgagaaagagaatatgtatgt

SEQ ID NO: 31438 - DNA, 21 bp, Artificial sequence
  SiRNA target sequence
gagaaagagaatatgtatgtg

SEQ ID NO: 31439 - DNA, 21 bp, Artificial sequence
  SiRNA target sequence
agaaagagaatatgtatgtgg

SEQ ID NO: 31440 - DNA, 21 bp, Artificial sequence
  SiRNA target sequence
gaaagagaatatgtatgtggt

SEQ ID NO: 31441 - DNA, 21 bp, Artificial sequence
  SiRNA target sequence
aaagagaatatgtatgtggtc

SEQ ID NO: 31442 - DNA, 21 bp, Artificial sequence
  SiRNA target sequence
aagagaatatgtatgtggtct

SEQ ID NO: 31443 - DNA, 21 bp, Artificial sequence
  SiRNA target sequence
agagaatatgtatgtggtctt

SEQ ID NO: 31444 - DNA, 21 bp, Artificial sequence
  SiRNA target sequence
gagaatatgtatgtggtcttt

SEQ ID NO: 31445 - DNA, 21 bp, Artificial sequence
  SiRNA target sequence
agaatatgtatgtggtctttt

SEQ ID NO: 31446 - DNA, 21 bp, Artificial sequence
  SiRNA target sequence
gaatatgtatgtggtcttttt

SEQ ID NO: 31447 - DNA, 21 bp, Artificial sequence
  SiRNA target sequence
aatatgtatgtggtctttttt

SEQ ID NO: 31448 - DNA, 21 bp, Artificial sequence
  SiRNA target sequence
atatgtatgtggtctttttta

SEQ ID NO: 31449 - DNA, 21 bp, Artificial sequence
  SiRNA target sequence
tatgtatgtggtcttttttat

SEQ ID NO: 31450 - DNA, 21 bp, Artificial sequence
  SiRNA target sequence
atgtatgtggtcttttttatc

SEQ ID NO: 31451 - DNA, 21 bp, Artificial sequence
  SiRNA target sequence
tgtatgtggtcttttttatca

SEQ ID NO: 31452 - DNA, 21 bp, Artificial sequence
  SiRNA target sequence
gtatgtggtcttttttatcaa

SEQ ID NO: 31453 - DNA, 21 bp, Artificial sequence
  SiRNA target sequence
tatgtggtcttttttatcaac

SEQ ID NO: 31454 - DNA, 21 bp, Artificial sequence
  SiRNA target sequence
atgtggtcttttttatcaacg

SEQ ID NO: 31455 - DNA, 21 bp, Artificial sequence
  SiRNA target sequence
tgtggtcttttttatcaacga

SEQ ID NO: 31456 - DNA, 21 bp, Artificial sequence
  SiRNA target sequence
gtggtcttttttatcaacgac

SEQ ID NO: 31457 - DNA, 21 bp, Artificial sequence
  SiRNA target sequence
tggtcttttttatcaacgacg

SEQ ID NO: 31458 - DNA, 21 bp, Artificial sequence
  SiRNA target sequence
ggtcttttttatcaacgacga

SEQ ID NO: 31459 - DNA, 21 bp, Artificial sequence
  SiRNA target sequence
gtcttttttatcaacgacgaa

SEQ ID NO: 31460 - DNA, 21 bp, Artificial sequence
  SiRNA target sequence
tcttttttatcaacgacgaac

SEQ ID NO: 31461 - DNA, 21 bp, Artificial sequence
  SiRNA target sequence
cttttttatcaacgacgaacg

SEQ ID NO: 31462 - DNA, 21 bp, Artificial sequence
  SiRNA target sequence
ttttttatcaacgacgaacgc

SEQ ID NO: 31463 - DNA, 21 bp, Artificial sequence
  SiRNA target sequence
tttttatcaacgacgaacgcc

SEQ ID NO: 31464 - DNA, 21 bp, Artificial sequence
  SiRNA target sequence
ttttatcaacgacgaacgccc

SEQ ID NO: 31465 - DNA, 21 bp, Artificial sequence
  SiRNA target sequence
tttatcaacgacgaacgcccg

SEQ ID NO: 31466 - DNA, 21 bp, Artificial sequence
  SiRNA target sequence
ttatcaacgacgaacgcccgc

SEQ ID NO: 31467 - DNA, 21 bp, Artificial sequence
  SiRNA target sequence
tatcaacgacgaacgcccgct

SEQ ID NO: 31468 - DNA, 21 bp, Artificial sequence
  SiRNA target sequence
atcaacgacgaacgcccgctg

SEQ ID NO: 31469 - DNA, 21 bp, Artificial sequence
  SiRNA target sequence
tcaacgacgaacgcccgctgt

SEQ ID NO: 31470 - DNA, 21 bp, Artificial sequence
  SiRNA target sequence
caacgacgaacgcccgctgtt

SEQ ID NO: 31471 - DNA, 21 bp, Artificial sequence
  SiRNA target sequence
aacgacgaacgcccgctgttt

SEQ ID NO: 31472 - DNA, 21 bp, Artificial sequence
  SiRNA target sequence
acgacgaacgcccgctgtttt

SEQ ID NO: 31473 - DNA, 21 bp, Artificial sequence
  SiRNA target sequence
cgacgaacgcccgctgttttg

SEQ ID NO: 31474 - DNA, 21 bp, Artificial sequence
  SiRNA target sequence
gacgaacgcccgctgttttgt

SEQ ID NO: 31475 - DNA, 21 bp, Artificial sequence
  SiRNA target sequence
acgaacgcccgctgttttgtg

SEQ ID NO: 31476 - DNA, 21 bp, Artificial sequence
  SiRNA target sequence
cgaacgcccgctgttttgtgc

SEQ ID NO: 31477 - DNA, 21 bp, Artificial sequence
  SiRNA target sequence
gaacgcccgctgttttgtgca

SEQ ID NO: 31478 - DNA, 21 bp, Artificial sequence
  SiRNA target sequence
aacgcccgctgttttgtgcag

SEQ ID NO: 31479 - DNA, 21 bp, Artificial sequence
  SiRNA target sequence
acgcccgctgttttgtgcaga

SEQ ID NO: 31480 - DNA, 21 bp, Artificial sequence
  SiRNA target sequence
cgcccgctgttttgtgcagat

SEQ ID NO: 31481 - DNA, 21 bp, Artificial sequence
  SiRNA target sequence
gcccgctgttttgtgcagatg

SEQ ID NO: 31482 - DNA, 21 bp, Artificial sequence
  SiRNA target sequence
cccgctgttttgtgcagatga

SEQ ID NO: 31483 - DNA, 21 bp, Artificial sequence
  SiRNA target sequence
ccgctgttttgtgcagatgac

SEQ ID NO: 31484 - DNA, 21 bp, Artificial sequence
  SiRNA target sequence
cgctgttttgtgcagatgacg

SEQ ID NO: 31485 - DNA, 21 bp, Artificial sequence
  SiRNA target sequence
gctgttttgtgcagatgacga

SEQ ID NO: 31486 - DNA, 21 bp, Artificial sequence
  SiRNA target sequence
ctgttttgtgcagatgacgaa

SEQ ID NO: 31487 - DNA, 21 bp, Artificial sequence
  SiRNA target sequence
tgttttgtgcagatgacgaag

SEQ ID NO: 31488 - DNA, 21 bp, Artificial sequence
  SiRNA target sequence
gttttgtgcagatgacgaaga

SEQ ID NO: 31489 - DNA, 21 bp, Artificial sequence
  SiRNA target sequence
ttttgtgcagatgacgaagag

SEQ ID NO: 31490 - DNA, 21 bp, Artificial sequence
  SiRNA target sequence
tttgtgcagatgacgaagagc

SEQ ID NO: 31491 - DNA, 21 bp, Artificial sequence
  SiRNA target sequence
ttgtgcagatgacgaagagca

SEQ ID NO: 31492 - DNA, 21 bp, Artificial sequence
  SiRNA target sequence
tgtgcagatgacgaagagcaa

SEQ ID NO: 31493 - DNA, 21 bp, Artificial sequence
  SiRNA target sequence
gtgcagatgacgaagagcaac

SEQ ID NO: 31494 - DNA, 21 bp, Artificial sequence
  SiRNA target sequence
tgcagatgacgaagagcaact

SEQ ID NO: 31495 - DNA, 21 bp, Artificial sequence
  SiRNA target sequence
gcagatgacgaagagcaactg

SEQ ID NO: 31496 - DNA, 21 bp, Artificial sequence
  SiRNA target sequence
cagatgacgaagagcaactga

SEQ ID NO: 31497 - DNA, 21 bp, Artificial sequence
  SiRNA target sequence
agatgacgaagagcaactgac

SEQ ID NO: 31498 - DNA, 21 bp, Artificial sequence
  SiRNA target sequence
gatgacgaagagcaactgacc

SEQ ID NO: 31499 - DNA, 21 bp, Artificial sequence
  SiRNA target sequence
atgacgaagagcaactgacca

SEQ ID NO: 31500 - DNA, 21 bp, Artificial sequence
  SiRNA target sequence
tgacgaagagcaactgaccaa

SEQ ID NO: 31501 - DNA, 21 bp, Artificial sequence
  SiRNA target sequence
gacgaagagcaactgaccaag

SEQ ID NO: 31502 - DNA, 21 bp, Artificial sequence
  SiRNA target sequence
acgaagagcaactgaccaagt

SEQ ID NO: 31503 - DNA, 21 bp, Artificial sequence
  SiRNA target sequence
cgaagagcaactgaccaagta

SEQ ID NO: 31504 - DNA, 21 bp, Artificial sequence
  SiRNA target sequence
gaagagcaactgaccaagtac

SEQ ID NO: 31505 - DNA, 21 bp, Artificial sequence
  SiRNA target sequence
aagagcaactgaccaagtact

SEQ ID NO: 31506 - DNA, 21 bp, Artificial sequence
  SiRNA target sequence
agagcaactgaccaagtactt

SEQ ID NO: 31507 - DNA, 21 bp, Artificial sequence
  SiRNA target sequence
gagcaactgaccaagtacttt

SEQ ID NO: 31508 - DNA, 21 bp, Artificial sequence
  SiRNA target sequence
agcaactgaccaagtacttta

SEQ ID NO: 31509 - DNA, 21 bp, Artificial sequence
  SiRNA target sequence
gcaactgaccaagtactttat

SEQ ID NO: 31510 - DNA, 21 bp, Artificial sequence
  SiRNA target sequence
caactgaccaagtactttatc

SEQ ID NO: 31511 - DNA, 21 bp, Artificial sequence
  SiRNA target sequence
aactgaccaagtactttatcc

SEQ ID NO: 31512 - DNA, 21 bp, Artificial sequence
  SiRNA target sequence
actgaccaagtactttatcca

SEQ ID NO: 31513 - DNA, 21 bp, Artificial sequence
  SiRNA target sequence
ctgaccaagtactttatccag

SEQ ID NO: 31514 - DNA, 21 bp, Artificial sequence
  SiRNA target sequence
tgaccaagtactttatccagg

SEQ ID NO: 31515 - DNA, 21 bp, Artificial sequence
  SiRNA target sequence
gaccaagtactttatccaggt

SEQ ID NO: 31516 - DNA, 21 bp, Artificial sequence
  SiRNA target sequence
accaagtactttatccaggtt

SEQ ID NO: 31517 - DNA, 21 bp, Artificial sequence
  SiRNA target sequence
ccaagtactttatccaggttg

SEQ ID NO: 31518 - DNA, 21 bp, Artificial sequence
  SiRNA target sequence
caagtactttatccaggttga

SEQ ID NO: 31519 - DNA, 21 bp, Artificial sequence
  SiRNA target sequence
aagtactttatccaggttgat

SEQ ID NO: 31520 - DNA, 21 bp, Artificial sequence
  SiRNA target sequence
agtactttatccaggttgata

SEQ ID NO: 31521 - DNA, 21 bp, Artificial sequence
  SiRNA target sequence
gtactttatccaggttgatat

SEQ ID NO: 31522 - DNA, 21 bp, Artificial sequence
  SiRNA target sequence
tactttatccaggttgatatc

SEQ ID NO: 31523 - DNA, 21 bp, Artificial sequence
  SiRNA target sequence
actttatccaggttgatatct

SEQ ID NO: 31524 - DNA, 21 bp, Artificial sequence
  SiRNA target sequence
ctttatccaggttgatatctg

SEQ ID NO: 31525 - DNA, 21 bp, Artificial sequence
  SiRNA target sequence
tttatccaggttgatatctgg

SEQ ID NO: 31526 - DNA, 21 bp, Artificial sequence
  SiRNA target sequence
ttatccaggttgatatctggt

SEQ ID NO: 31527 - DNA, 21 bp, Artificial sequence
  SiRNA target sequence
tatccaggttgatatctggtc

SEQ ID NO: 31528 - DNA, 21 bp, Artificial sequence
  SiRNA target sequence
atccaggttgatatctggtca

SEQ ID NO: 31529 - DNA, 21 bp, Artificial sequence
  SiRNA target sequence
tccaggttgatatctggtcaa

SEQ ID NO: 31530 - DNA, 21 bp, Artificial sequence
  SiRNA target sequence
ccaggttgatatctggtcaaa

SEQ ID NO: 31531 - DNA, 21 bp, Artificial sequence
  SiRNA target sequence
caggttgatatctggtcaaaa

SEQ ID NO: 31532 - DNA, 21 bp, Artificial sequence
  SiRNA target sequence
aggttgatatctggtcaaaag

SEQ ID NO: 31533 - DNA, 21 bp, Artificial sequence
  SiRNA target sequence
ggttgatatctggtcaaaagg

SEQ ID NO: 31534 - DNA, 21 bp, Artificial sequence
  SiRNA target sequence
gttgatatctggtcaaaaggg

SEQ ID NO: 31535 - DNA, 21 bp, Artificial sequence
  SiRNA target sequence
ttgatatctggtcaaaagggg

SEQ ID NO: 31536 - DNA, 21 bp, Artificial sequence
  SiRNA target sequence
tgatatctggtcaaaagggga

SEQ ID NO: 31537 - DNA, 21 bp, Artificial sequence
  SiRNA target sequence
gatatctggtcaaaaggggat

SEQ ID NO: 31538 - DNA, 21 bp, Artificial sequence
  SiRNA target sequence
atatctggtcaaaaggggatt

SEQ ID NO: 31539 - DNA, 21 bp, Artificial sequence
  SiRNA target sequence
tatctggtcaaaaggggatta

SEQ ID NO: 31540 - DNA, 21 bp, Artificial sequence
  SiRNA target sequence
atctggtcaaaaggggattac

SEQ ID NO: 31541 - DNA, 21 bp, Artificial sequence
  SiRNA target sequence
tctggtcaaaaggggattaca

SEQ ID NO: 31542 - DNA, 21 bp, Artificial sequence
  SiRNA target sequence
ctggtcaaaaggggattacac

SEQ ID NO: 31543 - DNA, 21 bp, Artificial sequence
  SiRNA target sequence
tggtcaaaaggggattacacg

SEQ ID NO: 31544 - DNA, 21 bp, Artificial sequence
  SiRNA target sequence
ggtcaaaaggggattacacgg

SEQ ID NO: 31545 - DNA, 21 bp, Artificial sequence
  SiRNA target sequence
gtcaaaaggggattacacgga

SEQ ID NO: 31546 - DNA, 21 bp, Artificial sequence
  SiRNA target sequence
tcaaaaggggattacacggaa

SEQ ID NO: 31547 - DNA, 21 bp, Artificial sequence
  SiRNA target sequence
caaaaggggattacacggaaa

SEQ ID NO: 31548 - DNA, 21 bp, Artificial sequence
  SiRNA target sequence
aaaaggggattacacggaaat

SEQ ID NO: 31549 - DNA, 21 bp, Artificial sequence
  SiRNA target sequence
aaaggggattacacggaaata

SEQ ID NO: 31550 - DNA, 21 bp, Artificial sequence
  SiRNA target sequence
aaggggattacacggaaatag

SEQ ID NO: 31551 - DNA, 21 bp, Artificial sequence
  SiRNA target sequence
aggggattacacggaaataga

SEQ ID NO: 31552 - DNA, 21 bp, Artificial sequence
  SiRNA target sequence
ggggattacacggaaatagag

SEQ ID NO: 31553 - DNA, 21 bp, Artificial sequence
  SiRNA target sequence
gggattacacggaaatagaga

SEQ ID NO: 31554 - DNA, 21 bp, Artificial sequence
  SiRNA target sequence
ggattacacggaaatagagaa

SEQ ID NO: 31555 - DNA, 21 bp, Artificial sequence
  SiRNA target sequence
gattacacggaaatagagaaa

SEQ ID NO: 31556 - DNA, 21 bp, Artificial sequence
  SiRNA target sequence
attacacggaaatagagaaac

SEQ ID NO: 31557 - DNA, 21 bp, Artificial sequence
  SiRNA target sequence
ttacacggaaatagagaaaca

SEQ ID NO: 31558 - DNA, 21 bp, Artificial sequence
  SiRNA target sequence
tacacggaaatagagaaacaa

SEQ ID NO: 31559 - DNA, 21 bp, Artificial sequence
  SiRNA target sequence
acacggaaatagagaaacaag

SEQ ID NO: 31560 - DNA, 21 bp, Artificial sequence
  SiRNA target sequence
cacggaaatagagaaacaagt

SEQ ID NO: 31561 - DNA, 21 bp, Artificial sequence
  SiRNA target sequence
acggaaatagagaaacaagtt

SEQ ID NO: 31562 - DNA, 21 bp, Artificial sequence
  SiRNA target sequence
cggaaatagagaaacaagtta

SEQ ID NO: 31563 - DNA, 21 bp, Artificial sequence
  SiRNA target sequence
ggaaatagagaaacaagttaa

SEQ ID NO: 31564 - DNA, 21 bp, Artificial sequence
  SiRNA target sequence
gaaatagagaaacaagttaag

SEQ ID NO: 31565 - DNA, 21 bp, Artificial sequence
  SiRNA target sequence
aaatagagaaacaagttaagc

SEQ ID NO: 31566 - DNA, 21 bp, Artificial sequence
  SiRNA target sequence
aatagagaaacaagttaagca

SEQ ID NO: 31567 - DNA, 21 bp, Artificial sequence
  SiRNA target sequence
atagagaaacaagttaagcag

SEQ ID NO: 31568 - DNA, 21 bp, Artificial sequence
  SiRNA target sequence
tagagaaacaagttaagcaga

SEQ ID NO: 31569 - DNA, 21 bp, Artificial sequence
  SiRNA target sequence
agagaaacaagttaagcagaa

SEQ ID NO: 31570 - DNA, 21 bp, Artificial sequence
  SiRNA target sequence
gagaaacaagttaagcagaag

SEQ ID NO: 31571 - DNA, 21 bp, Artificial sequence
  SiRNA target sequence
agaaacaagttaagcagaaga

SEQ ID NO: 31572 - DNA, 21 bp, Artificial sequence
  SiRNA target sequence
gaaacaagttaagcagaagat

SEQ ID NO: 31573 - DNA, 21 bp, Artificial sequence
  SiRNA target sequence
aaacaagttaagcagaagatg

SEQ ID NO: 31574 - DNA, 21 bp, Artificial sequence
  SiRNA target sequence
aacaagttaagcagaagatgc

SEQ ID NO: 31575 - DNA, 21 bp, Artificial sequence
  SiRNA target sequence
acaagttaagcagaagatgca

SEQ ID NO: 31576 - DNA, 21 bp, Artificial sequence
  SiRNA target sequence
caagttaagcagaagatgcag

SEQ ID NO: 31577 - DNA, 21 bp, Artificial sequence
  SiRNA target sequence
aagttaagcagaagatgcagg

SEQ ID NO: 31578 - DNA, 21 bp, Artificial sequence
  SiRNA target sequence
agttaagcagaagatgcagga

SEQ ID NO: 31579 - DNA, 21 bp, Artificial sequence
  SiRNA target sequence
gttaagcagaagatgcaggag

SEQ ID NO: 31580 - DNA, 21 bp, Artificial sequence
  SiRNA target sequence
ttaagcagaagatgcaggagc

SEQ ID NO: 31581 - DNA, 21 bp, Artificial sequence
  SiRNA target sequence
taagcagaagatgcaggagct

SEQ ID NO: 31582 - DNA, 21 bp, Artificial sequence
  SiRNA target sequence
aagcagaagatgcaggagctg

SEQ ID NO: 31583 - DNA, 21 bp, Artificial sequence
  SiRNA target sequence
agcagaagatgcaggagctgg

SEQ ID NO: 31584 - DNA, 21 bp, Artificial sequence
  SiRNA target sequence
gcagaagatgcaggagctggg

SEQ ID NO: 31585 - DNA, 21 bp, Artificial sequence
  SiRNA target sequence
cagaagatgcaggagctgggt

SEQ ID NO: 31586 - DNA, 21 bp, Artificial sequence
  SiRNA target sequence
agaagatgcaggagctgggtg

SEQ ID NO: 31587 - DNA, 21 bp, Artificial sequence
  SiRNA target sequence
gaagatgcaggagctgggtgc

SEQ ID NO: 31588 - DNA, 21 bp, Artificial sequence
  SiRNA target sequence
aagatgcaggagctgggtgcc

SEQ ID NO: 31589 - DNA, 21 bp, Artificial sequence
  SiRNA target sequence
agatgcaggagctgggtgcca

SEQ ID NO: 31590 - DNA, 21 bp, Artificial sequence
  SiRNA target sequence
gatgcaggagctgggtgccat

SEQ ID NO: 31591 - DNA, 21 bp, Artificial sequence
  SiRNA target sequence
atgcaggagctgggtgccata

SEQ ID NO: 31592 - DNA, 21 bp, Artificial sequence
  SiRNA target sequence
tgcaggagctgggtgccatac

SEQ ID NO: 31593 - DNA, 21 bp, Artificial sequence
  SiRNA target sequence
gcaggagctgggtgccatacg

SEQ ID NO: 31594 - DNA, 21 bp, Artificial sequence
  SiRNA target sequence
caggagctgggtgccatacgg

SEQ ID NO: 31595 - DNA, 21 bp, Artificial sequence
  SiRNA target sequence
aggagctgggtgccatacgga

SEQ ID NO: 31596 - DNA, 21 bp, Artificial sequence
  SiRNA target sequence
ggagctgggtgccatacggac

SEQ ID NO: 31597 - DNA, 21 bp, Artificial sequence
  SiRNA target sequence
gagctgggtgccatacggaca

SEQ ID NO: 31598 - DNA, 21 bp, Artificial sequence
  SiRNA target sequence
agctgggtgccatacggacaa

SEQ ID NO: 31599 - DNA, 21 bp, Artificial sequence
  SiRNA target sequence
gctgggtgccatacggacaag

SEQ ID NO: 31600 - DNA, 21 bp, Artificial sequence
  SiRNA target sequence
ctgggtgccatacggacaagt

SEQ ID NO: 31601 - DNA, 21 bp, Artificial sequence
  SiRNA target sequence
tgggtgccatacggacaagtg

SEQ ID NO: 31602 - DNA, 21 bp, Artificial sequence
  SiRNA target sequence
gggtgccatacggacaagtgc

SEQ ID NO: 31603 - DNA, 21 bp, Artificial sequence
  SiRNA target sequence
ggtgccatacggacaagtgcg

SEQ ID NO: 31604 - DNA, 21 bp, Artificial sequence
  SiRNA target sequence
gtgccatacggacaagtgcgt

SEQ ID NO: 31605 - DNA, 21 bp, Artificial sequence
  SiRNA target sequence
tgccatacggacaagtgcgtt

SEQ ID NO: 31606 - DNA, 21 bp, Artificial sequence
  SiRNA target sequence
gccatacggacaagtgcgttt

SEQ ID NO: 31607 - DNA, 21 bp, Artificial sequence
  SiRNA target sequence
ccatacggacaagtgcgtttg

SEQ ID NO: 31608 - DNA, 21 bp, Artificial sequence
  SiRNA target sequence
catacggacaagtgcgtttgg

SEQ ID NO: 31609 - DNA, 21 bp, Artificial sequence
  SiRNA target sequence
atacggacaagtgcgtttggt

SEQ ID NO: 31610 - DNA, 21 bp, Artificial sequence
  SiRNA target sequence
tacggacaagtgcgtttggtc

SEQ ID NO: 31611 - DNA, 21 bp, Artificial sequence
  SiRNA target sequence
acggacaagtgcgtttggtct

SEQ ID NO: 31612 - DNA, 21 bp, Artificial sequence
  SiRNA target sequence
cggacaagtgcgtttggtctt

SEQ ID NO: 31613 - DNA, 21 bp, Artificial sequence
  SiRNA target sequence
ggacaagtgcgtttggtcttt

SEQ ID NO: 31614 - DNA, 21 bp, Artificial sequence
  SiRNA target sequence
gacaagtgcgtttggtcttta

SEQ ID NO: 31615 - DNA, 21 bp, Artificial sequence
  SiRNA target sequence
acaagtgcgtttggtctttat

SEQ ID NO: 31616 - DNA, 21 bp, Artificial sequence
  SiRNA target sequence
caagtgcgtttggtctttatg

SEQ ID NO: 31617 - DNA, 21 bp, Artificial sequence
  SiRNA target sequence
aagtgcgtttggtctttatgc

SEQ ID NO: 31618 - DNA, 21 bp, Artificial sequence
  SiRNA target sequence
agtgcgtttggtctttatgct

SEQ ID NO: 31619 - DNA, 21 bp, Artificial sequence
  SiRNA target sequence
gtgcgtttggtctttatgctc

SEQ ID NO: 31620 - DNA, 21 bp, Artificial sequence
  SiRNA target sequence
tgcgtttggtctttatgctcc

SEQ ID NO: 31621 - DNA, 21 bp, Artificial sequence
  SiRNA target sequence
gcgtttggtctttatgctccc

SEQ ID NO: 31622 - DNA, 21 bp, Artificial sequence
  SiRNA target sequence
cgtttggtctttatgctcccg

SEQ ID NO: 31623 - DNA, 21 bp, Artificial sequence
  SiRNA target sequence
gtttggtctttatgctcccga

SEQ ID NO: 31624 - DNA, 21 bp, Artificial sequence
  SiRNA target sequence
tttggtctttatgctcccgac

SEQ ID NO: 31625 - DNA, 21 bp, Artificial sequence
  SiRNA target sequence
ttggtctttatgctcccgaca

SEQ ID NO: 31626 - DNA, 21 bp, Artificial sequence
  SiRNA target sequence
tggtctttatgctcccgacat

SEQ ID NO: 31627 - DNA, 21 bp, Artificial sequence
  SiRNA target sequence
ggtctttatgctcccgacata

SEQ ID NO: 31628 - DNA, 21 bp, Artificial sequence
  SiRNA target sequence
gtctttatgctcccgacatac

SEQ ID NO: 31629 - DNA, 21 bp, Artificial sequence
  SiRNA target sequence
tctttatgctcccgacataca

SEQ ID NO: 31630 - DNA, 21 bp, Artificial sequence
  SiRNA target sequence
ctttatgctcccgacatacag

SEQ ID NO: 31631 - DNA, 21 bp, Artificial sequence
  SiRNA target sequence
tttatgctcccgacatacaga

SEQ ID NO: 31632 - DNA, 21 bp, Artificial sequence
  SiRNA target sequence
ttatgctcccgacatacagat

SEQ ID NO: 31633 - DNA, 21 bp, Artificial sequence
  SiRNA target sequence
tatgctcccgacatacagatg

SEQ ID NO: 31634 - DNA, 21 bp, Artificial sequence
  SiRNA target sequence
atgctcccgacatacagatgt

SEQ ID NO: 31635 - DNA, 21 bp, Artificial sequence
  SiRNA target sequence
tgctcccgacatacagatgta

SEQ ID NO: 31636 - DNA, 21 bp, Artificial sequence
  SiRNA target sequence
gctcccgacatacagatgtat

SEQ ID NO: 31637 - DNA, 21 bp, Artificial sequence
  SiRNA target sequence
ctcccgacatacagatgtatc

SEQ ID NO: 31638 - DNA, 21 bp, Artificial sequence
  SiRNA target sequence
tcccgacatacagatgtatca

SEQ ID NO: 31639 - DNA, 21 bp, Artificial sequence
  SiRNA target sequence
cccgacatacagatgtatcaa

SEQ ID NO: 31640 - DNA, 21 bp, Artificial sequence
  SiRNA target sequence
ccgacatacagatgtatcaaa

SEQ ID NO: 31641 - DNA, 21 bp, Artificial sequence
  SiRNA target sequence
cgacatacagatgtatcaaaa

SEQ ID NO: 31642 - DNA, 21 bp, Artificial sequence
  SiRNA target sequence
gacatacagatgtatcaaaaa

SEQ ID NO: 31643 - DNA, 21 bp, Artificial sequence
  SiRNA target sequence
acatacagatgtatcaaaaag

SEQ ID NO: 31644 - DNA, 21 bp, Artificial sequence
  SiRNA target sequence
catacagatgtatcaaaaagt

SEQ ID NO: 31645 - DNA, 21 bp, Artificial sequence
  SiRNA target sequence
atacagatgtatcaaaaagtc

SEQ ID NO: 31646 - DNA, 21 bp, Artificial sequence
  SiRNA target sequence
tacagatgtatcaaaaagtct

SEQ ID NO: 31647 - DNA, 21 bp, Artificial sequence
  SiRNA target sequence
acagatgtatcaaaaagtctt

SEQ ID NO: 31648 - DNA, 21 bp, Artificial sequence
  SiRNA target sequence
cagatgtatcaaaaagtcttg

SEQ ID NO: 31649 - DNA, 21 bp, Artificial sequence
  SiRNA target sequence
agatgtatcaaaaagtcttgc

SEQ ID NO: 31650 - DNA, 21 bp, Artificial sequence
  SiRNA target sequence
gatgtatcaaaaagtcttgcg

SEQ ID NO: 31651 - DNA, 21 bp, Artificial sequence
  SiRNA target sequence
atgtatcaaaaagtcttgcgt

SEQ ID NO: 31652 - DNA, 21 bp, Artificial sequence
  SiRNA target sequence
tgtatcaaaaagtcttgcgtt

SEQ ID NO: 31653 - DNA, 21 bp, Artificial sequence
  SiRNA target sequence
gtatcaaaaagtcttgcgttt

SEQ ID NO: 31654 - DNA, 21 bp, Artificial sequence
  SiRNA target sequence
tatcaaaaagtcttgcgtttt

SEQ ID NO: 31655 - DNA, 21 bp, Artificial sequence
  SiRNA target sequence
atcaaaaagtcttgcgttttg

SEQ ID NO: 31656 - DNA, 21 bp, Artificial sequence
  SiRNA target sequence
tcaaaaagtcttgcgttttgt

SEQ ID NO: 31657 - DNA, 21 bp, Artificial sequence
  SiRNA target sequence
caaaaagtcttgcgttttgtg

SEQ ID NO: 31658 - DNA, 21 bp, Artificial sequence
  SiRNA target sequence
aaaaagtcttgcgttttgtga

SEQ ID NO: 31659 - DNA, 21 bp, Artificial sequence
  SiRNA target sequence
aaaagtcttgcgttttgtgat

SEQ ID NO: 31660 - DNA, 21 bp, Artificial sequence
  SiRNA target sequence
aaagtcttgcgttttgtgatg

SEQ ID NO: 31661 - DNA, 21 bp, Artificial sequence
  SiRNA target sequence
aagtcttgcgttttgtgatga

SEQ ID NO: 31662 - DNA, 21 bp, Artificial sequence
  SiRNA target sequence
agtcttgcgttttgtgatgag

SEQ ID NO: 31663 - DNA, 21 bp, Artificial sequence
  SiRNA target sequence
gtcttgcgttttgtgatgagc

SEQ ID NO: 31664 - DNA, 21 bp, Artificial sequence
  SiRNA target sequence
tcttgcgttttgtgatgagca

SEQ ID NO: 31665 - DNA, 21 bp, Artificial sequence
  SiRNA target sequence
cttgcgttttgtgatgagcat

SEQ ID NO: 31666 - DNA, 21 bp, Artificial sequence
  SiRNA target sequence
ttgcgttttgtgatgagcatg

SEQ ID NO: 31667 - DNA, 21 bp, Artificial sequence
  SiRNA target sequence
tgcgttttgtgatgagcatgc

SEQ ID NO: 31668 - DNA, 21 bp, Artificial sequence
  SiRNA target sequence
gcgttttgtgatgagcatgcc

SEQ ID NO: 31669 - DNA, 21 bp, Artificial sequence
  SiRNA target sequence
cgttttgtgatgagcatgcct

SEQ ID NO: 31670 - DNA, 21 bp, Artificial sequence
  SiRNA target sequence
gttttgtgatgagcatgcctg

SEQ ID NO: 31671 - DNA, 21 bp, Artificial sequence
  SiRNA target sequence
ttttgtgatgagcatgcctgc

SEQ ID NO: 31672 - DNA, 21 bp, Artificial sequence
  SiRNA target sequence
tttgtgatgagcatgcctgcc

SEQ ID NO: 31673 - DNA, 21 bp, Artificial sequence
  SiRNA target sequence
ttgtgatgagcatgcctgcct

SEQ ID NO: 31674 - DNA, 21 bp, Artificial sequence
  SiRNA target sequence
tgtgatgagcatgcctgccta

SEQ ID NO: 31675 - DNA, 21 bp, Artificial sequence
  SiRNA target sequence
gtgatgagcatgcctgcctag

SEQ ID NO: 31676 - DNA, 21 bp, Artificial sequence
  SiRNA target sequence
tgatgagcatgcctgcctagg

SEQ ID NO: 31677 - DNA, 21 bp, Artificial sequence
  SiRNA target sequence
gatgagcatgcctgcctaggc

SEQ ID NO: 31678 - DNA, 21 bp, Artificial sequence
  SiRNA target sequence
atgagcatgcctgcctaggcg

SEQ ID NO: 31679 - DNA, 21 bp, Artificial sequence
  SiRNA target sequence
tgagcatgcctgcctaggcgt

SEQ ID NO: 31680 - DNA, 21 bp, Artificial sequence
  SiRNA target sequence
gagcatgcctgcctaggcgtg

SEQ ID NO: 31681 - DNA, 21 bp, Artificial sequence
  SiRNA target sequence
agcatgcctgcctaggcgtgc

SEQ ID NO: 31682 - DNA, 21 bp, Artificial sequence
  SiRNA target sequence
gcatgcctgcctaggcgtgct

SEQ ID NO: 31683 - DNA, 21 bp, Artificial sequence
  SiRNA target sequence
catgcctgcctaggcgtgctt

SEQ ID NO: 31684 - DNA, 21 bp, Artificial sequence
  SiRNA target sequence
atgcctgcctaggcgtgcttt

SEQ ID NO: 31685 - DNA, 21 bp, Artificial sequence
  SiRNA target sequence
tgcctgcctaggcgtgctttt

SEQ ID NO: 31686 - DNA, 21 bp, Artificial sequence
  SiRNA target sequence
gcctgcctaggcgtgcttttt

SEQ ID NO: 31687 - DNA, 21 bp, Artificial sequence
  SiRNA target sequence
cctgcctaggcgtgcttttta

SEQ ID NO: 31688 - DNA, 21 bp, Artificial sequence
  SiRNA target sequence
ctgcctaggcgtgctttttat

SEQ ID NO: 31689 - DNA, 21 bp, Artificial sequence
  SiRNA target sequence
tgcctaggcgtgctttttatt

SEQ ID NO: 31690 - DNA, 21 bp, Artificial sequence
  SiRNA target sequence
gcctaggcgtgctttttattt

SEQ ID NO: 31691 - DNA, 21 bp, Artificial sequence
  SiRNA target sequence
cctaggcgtgctttttatttg

SEQ ID NO: 31692 - DNA, 21 bp, Artificial sequence
  SiRNA target sequence
ctaggcgtgctttttatttgt

SEQ ID NO: 31693 - DNA, 21 bp, Artificial sequence
  SiRNA target sequence
taggcgtgctttttatttgta

SEQ ID NO: 31694 - DNA, 21 bp, Artificial sequence
  SiRNA target sequence
aggcgtgctttttatttgtaa

SEQ ID NO: 31695 - DNA, 21 bp, Artificial sequence
  SiRNA target sequence
ggcgtgctttttatttgtaaa

SEQ ID NO: 31696 - DNA, 21 bp, Artificial sequence
  SiRNA target sequence
gcgtgctttttatttgtaaac

SEQ ID NO: 31697 - DNA, 21 bp, Artificial sequence
  SiRNA target sequence
cgtgctttttatttgtaaaca

SEQ ID NO: 31698 - DNA, 21 bp, Artificial sequence
  SiRNA target sequence
gtgctttttatttgtaaacaa

SEQ ID NO: 31699 - DNA, 21 bp, Artificial sequence
  SiRNA target sequence
tgctttttatttgtaaacaag

SEQ ID NO: 31700 - DNA, 21 bp, Artificial sequence
  SiRNA target sequence
gctttttatttgtaaacaagg

SEQ ID NO: 31701 - DNA, 21 bp, Artificial sequence
  SiRNA target sequence
ctttttatttgtaaacaaggg

SEQ ID NO: 31702 - DNA, 21 bp, Artificial sequence
  SiRNA target sequence
tttttatttgtaaacaagggg

SEQ ID NO: 31703 - DNA, 21 bp, Artificial sequence
  SiRNA target sequence
ttttatttgtaaacaaggggg

SEQ ID NO: 31704 - DNA, 21 bp, Artificial sequence
  SiRNA target sequence
tttatttgtaaacaaggggga

SEQ ID NO: 31705 - DNA, 21 bp, Artificial sequence
  SiRNA target sequence
ttatttgtaaacaagggggaa

SEQ ID NO: 31706 - DNA, 21 bp, Artificial sequence
  SiRNA target sequence
tatttgtaaacaagggggaac

SEQ ID NO: 31707 - DNA, 21 bp, Artificial sequence
  SiRNA target sequence
atttgtaaacaagggggaaca

SEQ ID NO: 31708 - DNA, 21 bp, Artificial sequence
  SiRNA target sequence
tttgtaaacaagggggaacaa

SEQ ID NO: 31709 - DNA, 21 bp, Artificial sequence
  SiRNA target sequence
ttgtaaacaagggggaacaac

SEQ ID NO: 31710 - DNA, 21 bp, Artificial sequence
  SiRNA target sequence
tgtaaacaagggggaacaact

SEQ ID NO: 31711 - DNA, 21 bp, Artificial sequence
  SiRNA target sequence
gtaaacaagggggaacaacta

SEQ ID NO: 31712 - DNA, 21 bp, Artificial sequence
  SiRNA target sequence
taaacaagggggaacaactat

SEQ ID NO: 31713 - DNA, 21 bp, Artificial sequence
  SiRNA target sequence
aaacaagggggaacaactatg

SEQ ID NO: 31714 - DNA, 21 bp, Artificial sequence
  SiRNA target sequence
aacaagggggaacaactatgg

SEQ ID NO: 31715 - DNA, 21 bp, Artificial sequence
  SiRNA target sequence
acaagggggaacaactatggg

SEQ ID NO: 31716 - DNA, 21 bp, Artificial sequence
  SiRNA target sequence
caagggggaacaactatggga

SEQ ID NO: 31717 - DNA, 21 bp, Artificial sequence
  SiRNA target sequence
aagggggaacaactatgggag

SEQ ID NO: 31718 - DNA, 21 bp, Artificial sequence
  SiRNA target sequence
agggggaacaactatgggagt

SEQ ID NO: 31719 - DNA, 21 bp, Artificial sequence
  SiRNA target sequence
gggggaacaactatgggagta

SEQ ID NO: 31720 - DNA, 21 bp, Artificial sequence
  SiRNA target sequence
ggggaacaactatgggagtac

SEQ ID NO: 31721 - DNA, 21 bp, Artificial sequence
  SiRNA target sequence
gggaacaactatgggagtacc

SEQ ID NO: 31722 - DNA, 21 bp, Artificial sequence
  SiRNA target sequence
ggaacaactatgggagtaccg

SEQ ID NO: 31723 - DNA, 21 bp, Artificial sequence
  SiRNA target sequence
gaacaactatgggagtaccga

SEQ ID NO: 31724 - DNA, 21 bp, Artificial sequence
  SiRNA target sequence
aacaactatgggagtaccgat

SEQ ID NO: 31725 - DNA, 21 bp, Artificial sequence
  SiRNA target sequence
acaactatgggagtaccgatt

SEQ ID NO: 31726 - DNA, 21 bp, Artificial sequence
  SiRNA target sequence
caactatgggagtaccgattg

SEQ ID NO: 31727 - DNA, 21 bp, Artificial sequence
  SiRNA target sequence
aactatgggagtaccgattgg

SEQ ID NO: 31728 - DNA, 21 bp, Artificial sequence
  SiRNA target sequence
actatgggagtaccgattggg

SEQ ID NO: 31729 - DNA, 21 bp, Artificial sequence
  SiRNA target sequence
ctatgggagtaccgattgggg

SEQ ID NO: 31730 - DNA, 21 bp, Artificial sequence
  SiRNA target sequence
tatgggagtaccgattggggt

SEQ ID NO: 31731 - DNA, 21 bp, Artificial sequence
  SiRNA target sequence
atgggagtaccgattggggta

SEQ ID NO: 31732 - DNA, 21 bp, Artificial sequence
  SiRNA target sequence
tgggagtaccgattggggtaa

SEQ ID NO: 31733 - DNA, 21 bp, Artificial sequence
  SiRNA target sequence
gggagtaccgattggggtaag

SEQ ID NO: 31734 - DNA, 21 bp, Artificial sequence
  SiRNA target sequence
ggagtaccgattggggtaagg

SEQ ID NO: 31735 - DNA, 21 bp, Artificial sequence
  SiRNA target sequence
gagtaccgattggggtaagga

SEQ ID NO: 31736 - DNA, 21 bp, Artificial sequence
  SiRNA target sequence
agtaccgattggggtaaggaa

SEQ ID NO: 31737 - DNA, 21 bp, Artificial sequence
  SiRNA target sequence
gtaccgattggggtaaggaat

SEQ ID NO: 31738 - DNA, 21 bp, Artificial sequence
  SiRNA target sequence
taccgattggggtaaggaatt

SEQ ID NO: 31739 - DNA, 21 bp, Artificial sequence
  SiRNA target sequence
accgattggggtaaggaattt

SEQ ID NO: 31740 - DNA, 21 bp, Artificial sequence
  SiRNA target sequence
ccgattggggtaaggaattta

SEQ ID NO: 31741 - DNA, 21 bp, Artificial sequence
  SiRNA target sequence
cgattggggtaaggaatttat

SEQ ID NO: 31742 - DNA, 21 bp, Artificial sequence
  SiRNA target sequence
gattggggtaaggaatttata

SEQ ID NO: 31743 - DNA, 21 bp, Artificial sequence
  SiRNA target sequence
attggggtaaggaatttatat

SEQ ID NO: 31744 - DNA, 21 bp, Artificial sequence
  SiRNA target sequence
ttggggtaaggaatttatatg

SEQ ID NO: 31745 - DNA, 21 bp, Artificial sequence
  SiRNA target sequence
tggggtaaggaatttatatgt

SEQ ID NO: 31746 - DNA, 21 bp, Artificial sequence
  SiRNA target sequence
ggggtaaggaatttatatgta

SEQ ID NO: 31747 - DNA, 21 bp, Artificial sequence
  SiRNA target sequence
gggtaaggaatttatatgtag

SEQ ID NO: 31748 - DNA, 21 bp, Artificial sequence
  SiRNA target sequence
ggtaaggaatttatatgtagc

SEQ ID NO: 31749 - DNA, 21 bp, Artificial sequence
  SiRNA target sequence
gtaaggaatttatatgtagcc

SEQ ID NO: 31750 - DNA, 21 bp, Artificial sequence
  SiRNA target sequence
taaggaatttatatgtagcca

SEQ ID NO: 31751 - DNA, 21 bp, Artificial sequence
  SiRNA target sequence
aaggaatttatatgtagccat

SEQ ID NO: 31752 - DNA, 21 bp, Artificial sequence
  SiRNA target sequence
aggaatttatatgtagccatc

SEQ ID NO: 31753 - DNA, 21 bp, Artificial sequence
  SiRNA target sequence
ggaatttatatgtagccatct

SEQ ID NO: 31754 - DNA, 21 bp, Artificial sequence
  SiRNA target sequence
gaatttatatgtagccatctt

SEQ ID NO: 31755 - DNA, 21 bp, Artificial sequence
  SiRNA target sequence
aatttatatgtagccatctta

SEQ ID NO: 31756 - DNA, 21 bp, Artificial sequence
  SiRNA target sequence
atttatatgtagccatcttaa

SEQ ID NO: 31757 - DNA, 21 bp, Artificial sequence
  SiRNA target sequence
tttatatgtagccatcttaaa

SEQ ID NO: 31758 - DNA, 21 bp, Artificial sequence
  SiRNA target sequence
ttatatgtagccatcttaaaa

SEQ ID NO: 31759 - DNA, 21 bp, Artificial sequence
  SiRNA target sequence
tatatgtagccatcttaaaaa

SEQ ID NO: 31760 - DNA, 21 bp, Artificial sequence
  SiRNA target sequence
atatgtagccatcttaaaaac

SEQ ID NO: 31761 - DNA, 21 bp, Artificial sequence
  SiRNA target sequence
tatgtagccatcttaaaaacc

SEQ ID NO: 31762 - DNA, 21 bp, Artificial sequence
  SiRNA target sequence
atgtagccatcttaaaaaccg

SEQ ID NO: 31763 - DNA, 21 bp, Artificial sequence
  SiRNA target sequence
tgtagccatcttaaaaaccga

SEQ ID NO: 31764 - DNA, 21 bp, Artificial sequence
  SiRNA target sequence
gtagccatcttaaaaaccgat

SEQ ID NO: 31765 - DNA, 21 bp, Artificial sequence
  SiRNA target sequence
tagccatcttaaaaaccgatg

SEQ ID NO: 31766 - DNA, 21 bp, Artificial sequence
  SiRNA target sequence
agccatcttaaaaaccgatga

SEQ ID NO: 31767 - DNA, 21 bp, Artificial sequence
  SiRNA target sequence
gccatcttaaaaaccgatgat

SEQ ID NO: 31768 - DNA, 21 bp, Artificial sequence
  SiRNA target sequence
ccatcttaaaaaccgatgata

SEQ ID NO: 31769 - DNA, 21 bp, Artificial sequence
  SiRNA target sequence
catcttaaaaaccgatgataa

SEQ ID NO: 31770 - DNA, 21 bp, Artificial sequence
  SiRNA target sequence
atcttaaaaaccgatgataaa

SEQ ID NO: 31771 - DNA, 21 bp, Artificial sequence
  SiRNA target sequence
tcttaaaaaccgatgataaaa

SEQ ID NO: 31772 - DNA, 21 bp, Artificial sequence
  SiRNA target sequence
cttaaaaaccgatgataaaaa

SEQ ID NO: 31773 - DNA, 21 bp, Artificial sequence
  SiRNA target sequence
ttaaaaaccgatgataaaaat

SEQ ID NO: 31774 - DNA, 21 bp, Artificial sequence
  SiRNA target sequence
taaaaaccgatgataaaaatg

SEQ ID NO: 31775 - DNA, 21 bp, Artificial sequence
  SiRNA target sequence
aaaaaccgatgataaaaatgg

SEQ ID NO: 31776 - DNA, 21 bp, Artificial sequence
  SiRNA target sequence
aaaaccgatgataaaaatggt

SEQ ID NO: 31777 - DNA, 21 bp, Artificial sequence
  SiRNA target sequence
aaaccgatgataaaaatggtg

SEQ ID NO: 31778 - DNA, 21 bp, Artificial sequence
  SiRNA target sequence
aaccgatgataaaaatggtgc

SEQ ID NO: 31779 - DNA, 21 bp, Artificial sequence
  SiRNA target sequence
accgatgataaaaatggtgcg

SEQ ID NO: 31780 - DNA, 21 bp, Artificial sequence
  SiRNA target sequence
ccgatgataaaaatggtgcga

SEQ ID NO: 31781 - DNA, 21 bp, Artificial sequence
  SiRNA target sequence
cgatgataaaaatggtgcgac

SEQ ID NO: 31782 - DNA, 21 bp, Artificial sequence
  SiRNA target sequence
gatgataaaaatggtgcgacg

SEQ ID NO: 31783 - DNA, 21 bp, Artificial sequence
  SiRNA target sequence
atgataaaaatggtgcgacgt

SEQ ID NO: 31784 - DNA, 21 bp, Artificial sequence
  SiRNA target sequence
tgataaaaatggtgcgacgta

SEQ ID NO: 31785 - DNA, 21 bp, Artificial sequence
  SiRNA target sequence
gataaaaatggtgcgacgtac

SEQ ID NO: 31786 - DNA, 21 bp, Artificial sequence
  SiRNA target sequence
ataaaaatggtgcgacgtacg

SEQ ID NO: 31787 - DNA, 21 bp, Artificial sequence
  SiRNA target sequence
taaaaatggtgcgacgtacga

SEQ ID NO: 31788 - DNA, 21 bp, Artificial sequence
  SiRNA target sequence
aaaaatggtgcgacgtacgac

SEQ ID NO: 31789 - DNA, 21 bp, Artificial sequence
  SiRNA target sequence
aaaatggtgcgacgtacgaca

SEQ ID NO: 31790 - DNA, 21 bp, Artificial sequence
  SiRNA target sequence
aaatggtgcgacgtacgacaa

SEQ ID NO: 31791 - DNA, 21 bp, Artificial sequence
  SiRNA target sequence
aatggtgcgacgtacgacaaa

SEQ ID NO: 31792 - DNA, 21 bp, Artificial sequence
  SiRNA target sequence
atggtgcgacgtacgacaaac

SEQ ID NO: 31793 - DNA, 21 bp, Artificial sequence
  SiRNA target sequence
tggtgcgacgtacgacaaacc

SEQ ID NO: 31794 - DNA, 21 bp, Artificial sequence
  SiRNA target sequence
ggtgcgacgtacgacaaaccc

SEQ ID NO: 31795 - DNA, 21 bp, Artificial sequence
  SiRNA target sequence
gtgcgacgtacgacaaacccg

SEQ ID NO: 31796 - DNA, 21 bp, Artificial sequence
  SiRNA target sequence
tgcgacgtacgacaaacccgt

SEQ ID NO: 31797 - DNA, 21 bp, Artificial sequence
  SiRNA target sequence
gcgacgtacgacaaacccgtc

SEQ ID NO: 31798 - DNA, 21 bp, Artificial sequence
  SiRNA target sequence
cgacgtacgacaaacccgtcc

SEQ ID NO: 31799 - DNA, 21 bp, Artificial sequence
  SiRNA target sequence
gacgtacgacaaacccgtcca

SEQ ID NO: 31800 - DNA, 21 bp, Artificial sequence
  SiRNA target sequence
acgtacgacaaacccgtccac

SEQ ID NO: 31801 - DNA, 21 bp, Artificial sequence
  SiRNA target sequence
cgtacgacaaacccgtccacc

SEQ ID NO: 31802 - DNA, 21 bp, Artificial sequence
  SiRNA target sequence
gtacgacaaacccgtccacct

SEQ ID NO: 31803 - DNA, 21 bp, Artificial sequence
  SiRNA target sequence
tacgacaaacccgtccacctg

SEQ ID NO: 31804 - DNA, 21 bp, Artificial sequence
  SiRNA target sequence
acgacaaacccgtccacctgg

SEQ ID NO: 31805 - DNA, 21 bp, Artificial sequence
  SiRNA target sequence
cgacaaacccgtccacctggc

SEQ ID NO: 31806 - DNA, 21 bp, Artificial sequence
  SiRNA target sequence
gacaaacccgtccacctggct

SEQ ID NO: 31807 - DNA, 21 bp, Artificial sequence
  SiRNA target sequence
acaaacccgtccacctggcta

SEQ ID NO: 31808 - DNA, 21 bp, Artificial sequence
  SiRNA target sequence
caaacccgtccacctggctaa

SEQ ID NO: 31809 - DNA, 21 bp, Artificial sequence
  SiRNA target sequence
aaacccgtccacctggctaaa

SEQ ID NO: 31810 - DNA, 21 bp, Artificial sequence
  SiRNA target sequence
aacccgtccacctggctaaag

SEQ ID NO: 31811 - DNA, 21 bp, Artificial sequence
  SiRNA target sequence
acccgtccacctggctaaagc

SEQ ID NO: 31812 - DNA, 21 bp, Artificial sequence
  SiRNA target sequence
cccgtccacctggctaaagcg

SEQ ID NO: 31813 - DNA, 21 bp, Artificial sequence
  SiRNA target sequence
ccgtccacctggctaaagcgg

SEQ ID NO: 31814 - DNA, 21 bp, Artificial sequence
  SiRNA target sequence
cgtccacctggctaaagcggt

SEQ ID NO: 31815 - DNA, 21 bp, Artificial sequence
  SiRNA target sequence
gtccacctggctaaagcggtt

SEQ ID NO: 31816 - DNA, 21 bp, Artificial sequence
  SiRNA target sequence
tccacctggctaaagcggttg

SEQ ID NO: 31817 - DNA, 21 bp, Artificial sequence
  SiRNA target sequence
ccacctggctaaagcggttga

SEQ ID NO: 31818 - DNA, 21 bp, Artificial sequence
  SiRNA target sequence
cacctggctaaagcggttgag

SEQ ID NO: 31819 - DNA, 21 bp, Artificial sequence
  SiRNA target sequence
acctggctaaagcggttgaga

SEQ ID NO: 31820 - DNA, 21 bp, Artificial sequence
  SiRNA target sequence
cctggctaaagcggttgagat

SEQ ID NO: 31821 - DNA, 21 bp, Artificial sequence
  SiRNA target sequence
ctggctaaagcggttgagatc

SEQ ID NO: 31822 - DNA, 21 bp, Artificial sequence
  SiRNA target sequence
tggctaaagcggttgagatca

SEQ ID NO: 31823 - DNA, 21 bp, Artificial sequence
  SiRNA target sequence
ggctaaagcggttgagatcag

SEQ ID NO: 31824 - DNA, 21 bp, Artificial sequence
  SiRNA target sequence
gctaaagcggttgagatcagc

SEQ ID NO: 31825 - DNA, 21 bp, Artificial sequence
  SiRNA target sequence
ctaaagcggttgagatcagcg

SEQ ID NO: 31826 - DNA, 21 bp, Artificial sequence
  SiRNA target sequence
taaagcggttgagatcagcgt

SEQ ID NO: 31827 - DNA, 21 bp, Artificial sequence
  SiRNA target sequence
aaagcggttgagatcagcgta

SEQ ID NO: 31828 - DNA, 21 bp, Artificial sequence
  SiRNA target sequence
aagcggttgagatcagcgtaa

SEQ ID NO: 31829 - DNA, 21 bp, Artificial sequence
  SiRNA target sequence
agcggttgagatcagcgtaaa

SEQ ID NO: 31830 - DNA, 21 bp, Artificial sequence
  SiRNA target sequence
gcggttgagatcagcgtaaaa

SEQ ID NO: 31831 - DNA, 21 bp, Artificial sequence
  SiRNA target sequence
cggttgagatcagcgtaaaac

SEQ ID NO: 31832 - DNA, 21 bp, Artificial sequence
  SiRNA target sequence
ggttgagatcagcgtaaaacc

SEQ ID NO: 31833 - DNA, 21 bp, Artificial sequence
  SiRNA target sequence
gttgagatcagcgtaaaaccg

SEQ ID NO: 31834 - DNA, 21 bp, Artificial sequence
  SiRNA target sequence
ttgagatcagcgtaaaaccga

SEQ ID NO: 31835 - DNA, 21 bp, Artificial sequence
  SiRNA target sequence
tgagatcagcgtaaaaccgaa

SEQ ID NO: 31836 - DNA, 21 bp, Artificial sequence
  SiRNA target sequence
gagatcagcgtaaaaccgaat

SEQ ID NO: 31837 - DNA, 21 bp, Artificial sequence
  SiRNA target sequence
agatcagcgtaaaaccgaatg

SEQ ID NO: 31838 - DNA, 21 bp, Artificial sequence
  SiRNA target sequence
gatcagcgtaaaaccgaatgt

SEQ ID NO: 31839 - DNA, 21 bp, Artificial sequence
  SiRNA target sequence
atcagcgtaaaaccgaatgtt

SEQ ID NO: 31840 - DNA, 21 bp, Artificial sequence
  SiRNA target sequence
tcagcgtaaaaccgaatgttt

SEQ ID NO: 31841 - DNA, 21 bp, Artificial sequence
  SiRNA target sequence
cagcgtaaaaccgaatgtttc

SEQ ID NO: 31842 - DNA, 21 bp, Artificial sequence
  SiRNA target sequence
agcgtaaaaccgaatgtttca

SEQ ID NO: 31843 - DNA, 21 bp, Artificial sequence
  SiRNA target sequence
gcgtaaaaccgaatgtttcat

SEQ ID NO: 31844 - DNA, 21 bp, Artificial sequence
  SiRNA target sequence
cgtaaaaccgaatgtttcatc

SEQ ID NO: 31845 - DNA, 21 bp, Artificial sequence
  SiRNA target sequence
gtaaaaccgaatgtttcatcc

SEQ ID NO: 31846 - DNA, 21 bp, Artificial sequence
  SiRNA target sequence
taaaaccgaatgtttcatcca

SEQ ID NO: 31847 - DNA, 21 bp, Artificial sequence
  SiRNA target sequence
aaaaccgaatgtttcatccac

SEQ ID NO: 31848 - DNA, 21 bp, Artificial sequence
  SiRNA target sequence
aaaccgaatgtttcatccacc

SEQ ID NO: 31849 - DNA, 21 bp, Artificial sequence
  SiRNA target sequence
aaccgaatgtttcatccacca

SEQ ID NO: 31850 - DNA, 21 bp, Artificial sequence
  SiRNA target sequence
accgaatgtttcatccaccac

SEQ ID NO: 31851 - DNA, 21 bp, Artificial sequence
  SiRNA target sequence
ccgaatgtttcatccaccacg

SEQ ID NO: 31852 - DNA, 21 bp, Artificial sequence
  SiRNA target sequence
cgaatgtttcatccaccacgt

SEQ ID NO: 31853 - DNA, 21 bp, Artificial sequence
  SiRNA target sequence
gaatgtttcatccaccacgtt

SEQ ID NO: 31854 - DNA, 21 bp, Artificial sequence
  SiRNA target sequence
aatgtttcatccaccacgttt

SEQ ID NO: 31855 - DNA, 21 bp, Artificial sequence
  SiRNA target sequence
atgtttcatccaccacgtttt

SEQ ID NO: 31856 - DNA, 21 bp, Artificial sequence
  SiRNA target sequence
tgtttcatccaccacgtttta

SEQ ID NO: 31857 - DNA, 21 bp, Artificial sequence
  SiRNA target sequence
gtttcatccaccacgttttac

SEQ ID NO: 31858 - DNA, 21 bp, Artificial sequence
  SiRNA target sequence
tttcatccaccacgttttacg

SEQ ID NO: 31859 - DNA, 21 bp, Artificial sequence
  SiRNA target sequence
ttcatccaccacgttttacgc

SEQ ID NO: 31860 - DNA, 21 bp, Artificial sequence
  SiRNA target sequence
tcatccaccacgttttacgcg

SEQ ID NO: 31861 - DNA, 21 bp, Artificial sequence
  SiRNA target sequence
catccaccacgttttacgcgg

SEQ ID NO: 31862 - DNA, 21 bp, Artificial sequence
  SiRNA target sequence
atccaccacgttttacgcgga

SEQ ID NO: 31863 - DNA, 21 bp, Artificial sequence
  SiRNA target sequence
tccaccacgttttacgcggat

SEQ ID NO: 31864 - DNA, 21 bp, Artificial sequence
  SiRNA target sequence
ccaccacgttttacgcggatg

SEQ ID NO: 31865 - DNA, 21 bp, Artificial sequence
  SiRNA target sequence
caccacgttttacgcggatga

SEQ ID NO: 31866 - DNA, 21 bp, Artificial sequence
  SiRNA target sequence
accacgttttacgcggatgac

SEQ ID NO: 31867 - DNA, 21 bp, Artificial sequence
  SiRNA target sequence
ccacgttttacgcggatgacc

SEQ ID NO: 31868 - DNA, 21 bp, Artificial sequence
  SiRNA target sequence
cacgttttacgcggatgacca

SEQ ID NO: 31869 - DNA, 21 bp, Artificial sequence
  SiRNA target sequence
acgttttacgcggatgaccaa

SEQ ID NO: 31870 - DNA, 21 bp, Artificial sequence
  SiRNA target sequence
cgttttacgcggatgaccaag

SEQ ID NO: 31871 - DNA, 21 bp, Artificial sequence
  SiRNA target sequence
gttttacgcggatgaccaagc

SEQ ID NO: 31872 - DNA, 21 bp, Artificial sequence
  SiRNA target sequence
ttttacgcggatgaccaagca

SEQ ID NO: 31873 - DNA, 21 bp, Artificial sequence
  SiRNA target sequence
tttacgcggatgaccaagcat

SEQ ID NO: 31874 - DNA, 21 bp, Artificial sequence
  SiRNA target sequence
ttacgcggatgaccaagcatc

SEQ ID NO: 31875 - DNA, 21 bp, Artificial sequence
  SiRNA target sequence
tacgcggatgaccaagcatct

SEQ ID NO: 31876 - DNA, 21 bp, Artificial sequence
  SiRNA target sequence
acgcggatgaccaagcatctg

SEQ ID NO: 31877 - DNA, 21 bp, Artificial sequence
  SiRNA target sequence
cgcggatgaccaagcatctga

SEQ ID NO: 31878 - DNA, 21 bp, Artificial sequence
  SiRNA target sequence
gcggatgaccaagcatctgaa

SEQ ID NO: 31879 - DNA, 21 bp, Artificial sequence
  SiRNA target sequence
cggatgaccaagcatctgaat

SEQ ID NO: 31880 - DNA, 21 bp, Artificial sequence
  SiRNA target sequence
ggatgaccaagcatctgaatc

SEQ ID NO: 31881 - DNA, 21 bp, Artificial sequence
  SiRNA target sequence
gatgaccaagcatctgaatct

SEQ ID NO: 31882 - DNA, 21 bp, Artificial sequence
  SiRNA target sequence
atgaccaagcatctgaatctg

SEQ ID NO: 31883 - DNA, 21 bp, Artificial sequence
  SiRNA target sequence
tgaccaagcatctgaatctga

SEQ ID NO: 31884 - DNA, 21 bp, Artificial sequence
  SiRNA target sequence
gaccaagcatctgaatctgaa

SEQ ID NO: 31885 - DNA, 21 bp, Artificial sequence
  SiRNA target sequence
accaagcatctgaatctgaat

SEQ ID NO: 31886 - DNA, 21 bp, Artificial sequence
  SiRNA target sequence
ccaagcatctgaatctgaatc

SEQ ID NO: 31887 - DNA, 21 bp, Artificial sequence
  SiRNA target sequence
caagcatctgaatctgaatcc

SEQ ID NO: 31888 - DNA, 21 bp, Artificial sequence
  SiRNA target sequence
aagcatctgaatctgaatcca

SEQ ID NO: 31889 - DNA, 21 bp, Artificial sequence
  SiRNA target sequence
agcatctgaatctgaatccac

SEQ ID NO: 31890 - DNA, 21 bp, Artificial sequence
  SiRNA target sequence
gcatctgaatctgaatccaca

SEQ ID NO: 31891 - DNA, 21 bp, Artificial sequence
  SiRNA target sequence
catctgaatctgaatccacat

SEQ ID NO: 31892 - DNA, 21 bp, Artificial sequence
  SiRNA target sequence
atctgaatctgaatccacatt

SEQ ID NO: 31893 - DNA, 21 bp, Artificial sequence
  SiRNA target sequence
tctgaatctgaatccacattg

SEQ ID NO: 31894 - DNA, 21 bp, Artificial sequence
  SiRNA target sequence
ctgaatctgaatccacattgg

SEQ ID NO: 31895 - DNA, 21 bp, Artificial sequence
  SiRNA target sequence
tgaatctgaatccacattggc

SEQ ID NO: 31896 - DNA, 21 bp, Artificial sequence
  SiRNA target sequence
gaatctgaatccacattggcc

SEQ ID NO: 31897 - DNA, 21 bp, Artificial sequence
  SiRNA target sequence
aatctgaatccacattggccg

SEQ ID NO: 31898 - DNA, 21 bp, Artificial sequence
  SiRNA target sequence
atctgaatccacattggccga

SEQ ID NO: 31899 - DNA, 21 bp, Artificial sequence
  SiRNA target sequence
tctgaatccacattggccgac

SEQ ID NO: 31900 - DNA, 21 bp, Artificial sequence
  SiRNA target sequence
ctgaatccacattggccgaca

SEQ ID NO: 31901 - DNA, 21 bp, Artificial sequence
  SiRNA target sequence
tgaatccacattggccgacat

SEQ ID NO: 31902 - DNA, 21 bp, Artificial sequence
  SiRNA target sequence
gaatccacattggccgacatt

SEQ ID NO: 31903 - DNA, 21 bp, Artificial sequence
  SiRNA target sequence
aatccacattggccgacattg

SEQ ID NO: 31904 - DNA, 21 bp, Artificial sequence
  SiRNA target sequence
atccacattggccgacattga

SEQ ID NO: 31905 - DNA, 21 bp, Artificial sequence
  SiRNA target sequence
tccacattggccgacattgaa

SEQ ID NO: 31906 - DNA, 21 bp, Artificial sequence
  SiRNA target sequence
ccacattggccgacattgaag

SEQ ID NO: 31907 - DNA, 21 bp, Artificial sequence
  SiRNA target sequence
cacattggccgacattgaagt

SEQ ID NO: 31908 - DNA, 21 bp, Artificial sequence
  SiRNA target sequence
acattggccgacattgaagta

SEQ ID NO: 31909 - DNA, 21 bp, Artificial sequence
  SiRNA target sequence
cattggccgacattgaagtag

SEQ ID NO: 31910 - DNA, 21 bp, Artificial sequence
  SiRNA target sequence
attggccgacattgaagtaga

SEQ ID NO: 31911 - DNA, 21 bp, Artificial sequence
  SiRNA target sequence
ttggccgacattgaagtagag

SEQ ID NO: 31912 - DNA, 21 bp, Artificial sequence
  SiRNA target sequence
tggccgacattgaagtagaga

SEQ ID NO: 31913 - DNA, 21 bp, Artificial sequence
  SiRNA target sequence
ggccgacattgaagtagagat

SEQ ID NO: 31914 - DNA, 21 bp, Artificial sequence
  SiRNA target sequence
gccgacattgaagtagagatt

SEQ ID NO: 31915 - DNA, 21 bp, Artificial sequence
  SiRNA target sequence
ccgacattgaagtagagatta

SEQ ID NO: 31916 - DNA, 21 bp, Artificial sequence
  SiRNA target sequence
cgacattgaagtagagattac

SEQ ID NO: 31917 - DNA, 21 bp, Artificial sequence
  SiRNA target sequence
gacattgaagtagagattacg

SEQ ID NO: 31918 - DNA, 21 bp, Artificial sequence
  SiRNA target sequence
acattgaagtagagattacgg

SEQ ID NO: 31919 - DNA, 21 bp, Artificial sequence
  SiRNA target sequence
cattgaagtagagattacggt

SEQ ID NO: 31920 - DNA, 21 bp, Artificial sequence
  SiRNA target sequence
attgaagtagagattacggta

SEQ ID NO: 31921 - DNA, 21 bp, Artificial sequence
  SiRNA target sequence
ttgaagtagagattacggtag

SEQ ID NO: 31922 - DNA, 21 bp, Artificial sequence
  SiRNA target sequence
tgaagtagagattacggtaga

SEQ ID NO: 31923 - DNA, 21 bp, Artificial sequence
  SiRNA target sequence
gaagtagagattacggtagat

SEQ ID NO: 31924 - DNA, 21 bp, Artificial sequence
  SiRNA target sequence
aagtagagattacggtagatc

SEQ ID NO: 31925 - DNA, 21 bp, Artificial sequence
  SiRNA target sequence
agtagagattacggtagatca

SEQ ID NO: 31926 - DNA, 21 bp, Artificial sequence
  SiRNA target sequence
gtagagattacggtagatcaa

SEQ ID NO: 31927 - DNA, 21 bp, Artificial sequence
  SiRNA target sequence
tagagattacggtagatcaaa

SEQ ID NO: 31928 - DNA, 21 bp, Artificial sequence
  SiRNA target sequence
agagattacggtagatcaaat

SEQ ID NO: 31929 - DNA, 21 bp, Artificial sequence
  SiRNA target sequence
gagattacggtagatcaaatt

SEQ ID NO: 31930 - DNA, 21 bp, Artificial sequence
  SiRNA target sequence
agattacggtagatcaaattg

SEQ ID NO: 31931 - DNA, 21 bp, Artificial sequence
  SiRNA target sequence
gattacggtagatcaaattgg

SEQ ID NO: 31932 - DNA, 21 bp, Artificial sequence
  SiRNA target sequence
attacggtagatcaaattgga

SEQ ID NO: 31933 - DNA, 21 bp, Artificial sequence
  SiRNA target sequence
ttacggtagatcaaattggat

SEQ ID NO: 31934 - DNA, 21 bp, Artificial sequence
  SiRNA target sequence
tacggtagatcaaattggatc

SEQ ID NO: 31935 - DNA, 21 bp, Artificial sequence
  SiRNA target sequence
acggtagatcaaattggatct

SEQ ID NO: 31936 - DNA, 21 bp, Artificial sequence
  SiRNA target sequence
cggtagatcaaattggatcta

SEQ ID NO: 31937 - DNA, 21 bp, Artificial sequence
  SiRNA target sequence
ggtagatcaaattggatctaa

SEQ ID NO: 31938 - DNA, 21 bp, Artificial sequence
  SiRNA target sequence
gtagatcaaattggatctaaa

SEQ ID NO: 31939 - DNA, 21 bp, Artificial sequence
  SiRNA target sequence
tagatcaaattggatctaaaa

SEQ ID NO: 31940 - DNA, 21 bp, Artificial sequence
  SiRNA target sequence
agatcaaattggatctaaaaa

SEQ ID NO: 31941 - DNA, 21 bp, Artificial sequence
  SiRNA target sequence
gatcaaattggatctaaaaac

SEQ ID NO: 31942 - DNA, 21 bp, Artificial sequence
  SiRNA target sequence
atcaaattggatctaaaaacg

SEQ ID NO: 31943 - DNA, 21 bp, Artificial sequence
  SiRNA target sequence
tcaaattggatctaaaaacgc

SEQ ID NO: 31944 - DNA, 21 bp, Artificial sequence
  SiRNA target sequence
caaattggatctaaaaacgcc

SEQ ID NO: 31945 - DNA, 21 bp, Artificial sequence
  SiRNA target sequence
aaattggatctaaaaacgccg

SEQ ID NO: 31946 - DNA, 21 bp, Artificial sequence
  SiRNA target sequence
aattggatctaaaaacgccgc

SEQ ID NO: 31947 - DNA, 21 bp, Artificial sequence
  SiRNA target sequence
attggatctaaaaacgccgcc

SEQ ID NO: 31948 - DNA, 21 bp, Artificial sequence
  SiRNA target sequence
ttggatctaaaaacgccgcca

SEQ ID NO: 31949 - DNA, 21 bp, Artificial sequence
  SiRNA target sequence
tggatctaaaaacgccgccat

SEQ ID NO: 31950 - DNA, 21 bp, Artificial sequence
  SiRNA target sequence
ggatctaaaaacgccgccatg

SEQ ID NO: 31951 - DNA, 21 bp, Artificial sequence
  SiRNA target sequence
gatctaaaaacgccgccatgc

SEQ ID NO: 31952 - DNA, 21 bp, Artificial sequence
  SiRNA target sequence
atctaaaaacgccgccatgct

SEQ ID NO: 31953 - DNA, 21 bp, Artificial sequence
  SiRNA target sequence
tctaaaaacgccgccatgctt

SEQ ID NO: 31954 - DNA, 21 bp, Artificial sequence
  SiRNA target sequence
ctaaaaacgccgccatgcttc

SEQ ID NO: 31955 - DNA, 21 bp, Artificial sequence
  SiRNA target sequence
taaaaacgccgccatgcttct

SEQ ID NO: 31956 - DNA, 21 bp, Artificial sequence
  SiRNA target sequence
aaaaacgccgccatgcttctg

SEQ ID NO: 31957 - DNA, 21 bp, Artificial sequence
  SiRNA target sequence
aaaacgccgccatgcttctgg

SEQ ID NO: 31958 - DNA, 21 bp, Artificial sequence
  SiRNA target sequence
aaacgccgccatgcttctggg

SEQ ID NO: 31959 - DNA, 21 bp, Artificial sequence
  SiRNA target sequence
aacgccgccatgcttctgggg

SEQ ID NO: 31960 - DNA, 21 bp, Artificial sequence
  SiRNA target sequence
acgccgccatgcttctggggg

SEQ ID NO: 31961 - DNA, 21 bp, Artificial sequence
  SiRNA target sequence
cgccgccatgcttctgggggc

SEQ ID NO: 31962 - DNA, 21 bp, Artificial sequence
  SiRNA target sequence
gccgccatgcttctgggggct

SEQ ID NO: 31963 - DNA, 21 bp, Artificial sequence
  SiRNA target sequence
ccgccatgcttctgggggcta

SEQ ID NO: 31964 - DNA, 21 bp, Artificial sequence
  SiRNA target sequence
cgccatgcttctgggggctaa

SEQ ID NO: 31965 - DNA, 21 bp, Artificial sequence
  SiRNA target sequence
gccatgcttctgggggctaaa

SEQ ID NO: 31966 - DNA, 21 bp, Artificial sequence
  SiRNA target sequence
ccatgcttctgggggctaaag

SEQ ID NO: 31967 - DNA, 21 bp, Artificial sequence
  SiRNA target sequence
catgcttctgggggctaaagt

SEQ ID NO: 31968 - DNA, 21 bp, Artificial sequence
  SiRNA target sequence
atgcttctgggggctaaagtg

SEQ ID NO: 31969 - DNA, 21 bp, Artificial sequence
  SiRNA target sequence
tgcttctgggggctaaagtgg

SEQ ID NO: 31970 - DNA, 21 bp, Artificial sequence
  SiRNA target sequence
gcttctgggggctaaagtgga

SEQ ID NO: 31971 - DNA, 21 bp, Artificial sequence
  SiRNA target sequence
cttctgggggctaaagtggat

SEQ ID NO: 31972 - DNA, 21 bp, Artificial sequence
  SiRNA target sequence
ttctgggggctaaagtggatg

SEQ ID NO: 31973 - DNA, 21 bp, Artificial sequence
  SiRNA target sequence
tctgggggctaaagtggatga

SEQ ID NO: 31974 - DNA, 21 bp, Artificial sequence
  SiRNA target sequence
ctgggggctaaagtggatgaa

SEQ ID NO: 31975 - DNA, 21 bp, Artificial sequence
  SiRNA target sequence
tgggggctaaagtggatgaaa

SEQ ID NO: 31976 - DNA, 21 bp, Artificial sequence
  SiRNA target sequence
gggggctaaagtggatgaaaa

SEQ ID NO: 31977 - DNA, 21 bp, Artificial sequence
  SiRNA target sequence
ggggctaaagtggatgaaaac

SEQ ID NO: 31978 - DNA, 21 bp, Artificial sequence
  SiRNA target sequence
gggctaaagtggatgaaaacg

SEQ ID NO: 31979 - DNA, 21 bp, Artificial sequence
  SiRNA target sequence
ggctaaagtggatgaaaacgg

SEQ ID NO: 31980 - DNA, 21 bp, Artificial sequence
  SiRNA target sequence
gctaaagtggatgaaaacgga

SEQ ID NO: 31981 - DNA, 21 bp, Artificial sequence
  SiRNA target sequence
ctaaagtggatgaaaacggag

SEQ ID NO: 31982 - DNA, 21 bp, Artificial sequence
  SiRNA target sequence
taaagtggatgaaaacggagt

SEQ ID NO: 31983 - DNA, 21 bp, Artificial sequence
  SiRNA target sequence
aaagtggatgaaaacggagtg

SEQ ID NO: 31984 - DNA, 21 bp, Artificial sequence
  SiRNA target sequence
aagtggatgaaaacggagtgc

SEQ ID NO: 31985 - DNA, 21 bp, Artificial sequence
  SiRNA target sequence
agtggatgaaaacggagtgct

SEQ ID NO: 31986 - DNA, 21 bp, Artificial sequence
  SiRNA target sequence
gtggatgaaaacggagtgctg

SEQ ID NO: 31987 - DNA, 21 bp, Artificial sequence
  SiRNA target sequence
tggatgaaaacggagtgctgg

SEQ ID NO: 31988 - DNA, 21 bp, Artificial sequence
  SiRNA target sequence
ggatgaaaacggagtgctggt

SEQ ID NO: 31989 - DNA, 21 bp, Artificial sequence
  SiRNA target sequence
gatgaaaacggagtgctggtt

SEQ ID NO: 31990 - DNA, 21 bp, Artificial sequence
  SiRNA target sequence
atgaaaacggagtgctggttt

SEQ ID NO: 31991 - DNA, 21 bp, Artificial sequence
  SiRNA target sequence
tgaaaacggagtgctggtttg

SEQ ID NO: 31992 - DNA, 21 bp, Artificial sequence
  SiRNA target sequence
gaaaacggagtgctggtttgg

SEQ ID NO: 31993 - DNA, 21 bp, Artificial sequence
  SiRNA target sequence
aaaacggagtgctggtttgga

SEQ ID NO: 31994 - DNA, 21 bp, Artificial sequence
  SiRNA target sequence
aaacggagtgctggtttggaa

SEQ ID NO: 31995 - DNA, 21 bp, Artificial sequence
  SiRNA target sequence
aacggagtgctggtttggaac

SEQ ID NO: 31996 - DNA, 21 bp, Artificial sequence
  SiRNA target sequence
acggagtgctggtttggaaca

SEQ ID NO: 31997 - DNA, 21 bp, Artificial sequence
  SiRNA target sequence
cggagtgctggtttggaacag

SEQ ID NO: 31998 - DNA, 21 bp, Artificial sequence
  SiRNA target sequence
ggagtgctggtttggaacaga

SEQ ID NO: 31999 - DNA, 21 bp, Artificial sequence
  SiRNA target sequence
gagtgctggtttggaacagag

SEQ ID NO: 32000 - DNA, 21 bp, Artificial sequence
  SiRNA target sequence
agtgctggtttggaacagaga

SEQ ID NO: 32001 - DNA, 21 bp, Artificial sequence
  SiRNA target sequence
gtgctggtttggaacagagat

SEQ ID NO: 32002 - DNA, 21 bp, Artificial sequence
  SiRNA target sequence
tgctggtttggaacagagatg

SEQ ID NO: 32003 - DNA, 21 bp, Artificial sequence
  SiRNA target sequence
gctggtttggaacagagatga

SEQ ID NO: 32004 - DNA, 21 bp, Artificial sequence
  SiRNA target sequence
ctggtttggaacagagatgat

SEQ ID NO: 32005 - DNA, 21 bp, Artificial sequence
  SiRNA target sequence
tggtttggaacagagatgatc

SEQ ID NO: 32006 - DNA, 21 bp, Artificial sequence
  SiRNA target sequence
ggtttggaacagagatgatca

SEQ ID NO: 32007 - DNA, 21 bp, Artificial sequence
  SiRNA target sequence
gtttggaacagagatgatcaa

SEQ ID NO: 32008 - DNA, 21 bp, Artificial sequence
  SiRNA target sequence
ttatattgatactgaaacaat

SEQ ID NO: 32009 - DNA, 21 bp, Artificial sequence
  SiRNA target sequence
tatattgatactgaaacaatg

SEQ ID NO: 32010 - DNA, 21 bp, Artificial sequence
  SiRNA target sequence
atattgatactgaaacaatgc

SEQ ID NO: 32011 - DNA, 21 bp, Artificial sequence
  SiRNA target sequence
tattgatactgaaacaatgca

SEQ ID NO: 32012 - DNA, 21 bp, Artificial sequence
  SiRNA target sequence
attgatactgaaacaatgcat

SEQ ID NO: 32013 - DNA, 21 bp, Artificial sequence
  SiRNA target sequence
ttgatactgaaacaatgcatt

SEQ ID NO: 32014 - DNA, 21 bp, Artificial sequence
  SiRNA target sequence
tgatactgaaacaatgcattt

SEQ ID NO: 32015 - DNA, 21 bp, Artificial sequence
  SiRNA target sequence
gatactgaaacaatgcatttg

SEQ ID NO: 32016 - DNA, 21 bp, Artificial sequence
  SiRNA target sequence
atactgaaacaatgcatttgc

SEQ ID NO: 32017 - DNA, 21 bp, Artificial sequence
  SiRNA target sequence
tactgaaacaatgcatttgca

SEQ ID NO: 32018 - DNA, 21 bp, Artificial sequence
  SiRNA target sequence
actgaaacaatgcatttgcac

SEQ ID NO: 32019 - DNA, 21 bp, Artificial sequence
  SiRNA target sequence
ctgaaacaatgcatttgcacc

SEQ ID NO: 32020 - DNA, 21 bp, Artificial sequence
  SiRNA target sequence
tgaaacaatgcatttgcacca

SEQ ID NO: 32021 - DNA, 21 bp, Artificial sequence
  SiRNA target sequence
gaaacaatgcatttgcaccat

SEQ ID NO: 32022 - DNA, 21 bp, Artificial sequence
  SiRNA target sequence
aaacaatgcatttgcaccatg

SEQ ID NO: 32023 - DNA, 21 bp, Artificial sequence
  SiRNA target sequence
aacaatgcatttgcaccatga

SEQ ID NO: 32024 - DNA, 21 bp, Artificial sequence
  SiRNA target sequence
acaatgcatttgcaccatgat

SEQ ID NO: 32025 - DNA, 21 bp, Artificial sequence
  SiRNA target sequence
caatgcatttgcaccatgata

SEQ ID NO: 32026 - DNA, 21 bp, Artificial sequence
  SiRNA target sequence
aatgcatttgcaccatgataa

SEQ ID NO: 32027 - DNA, 21 bp, Artificial sequence
  SiRNA target sequence
atgcatttgcaccatgataaa

SEQ ID NO: 32028 - DNA, 21 bp, Artificial sequence
  SiRNA target sequence
tgcatttgcaccatgataaac

SEQ ID NO: 32029 - DNA, 21 bp, Artificial sequence
  SiRNA target sequence
gcatttgcaccatgataaaca

SEQ ID NO: 32030 - DNA, 21 bp, Artificial sequence
  SiRNA target sequence
catttgcaccatgataaacat

SEQ ID NO: 32031 - DNA, 21 bp, Artificial sequence
  SiRNA target sequence
atttgcaccatgataaacatc

SEQ ID NO: 32032 - DNA, 21 bp, Artificial sequence
  SiRNA target sequence
tttgcaccatgataaacatca

SEQ ID NO: 32033 - DNA, 21 bp, Artificial sequence
  SiRNA target sequence
ttgcaccatgataaacatcat

SEQ ID NO: 32034 - DNA, 21 bp, Artificial sequence
  SiRNA target sequence
tgcaccatgataaacatcata

SEQ ID NO: 32035 - DNA, 21 bp, Artificial sequence
  SiRNA target sequence
gcaccatgataaacatcataa

SEQ ID NO: 32036 - DNA, 21 bp, Artificial sequence
  SiRNA target sequence
caccatgataaacatcataat

SEQ ID NO: 32037 - DNA, 21 bp, Artificial sequence
  SiRNA target sequence
accatgataaacatcataata

SEQ ID NO: 32038 - DNA, 21 bp, Artificial sequence
  SiRNA target sequence
ccatgataaacatcataatac

SEQ ID NO: 32039 - DNA, 21 bp, Artificial sequence
  SiRNA target sequence
catgataaacatcataatact

SEQ ID NO: 32040 - DNA, 21 bp, Artificial sequence
  SiRNA target sequence
atgataaacatcataatactt

SEQ ID NO: 32041 - DNA, 21 bp, Artificial sequence
  SiRNA target sequence
tgataaacatcataatactta

SEQ ID NO: 32042 - DNA, 21 bp, Artificial sequence
  SiRNA target sequence
gataaacatcataatacttat

SEQ ID NO: 32043 - DNA, 21 bp, Artificial sequence
  SiRNA target sequence
ataaacatcataatacttatg

SEQ ID NO: 32044 - DNA, 21 bp, Artificial sequence
  SiRNA target sequence
taaacatcataatacttatgt

SEQ ID NO: 32045 - DNA, 21 bp, Artificial sequence
  SiRNA target sequence
aaacatcataatacttatgta

SEQ ID NO: 32046 - DNA, 21 bp, Artificial sequence
  SiRNA target sequence
aacatcataatacttatgtaa

SEQ ID NO: 32047 - DNA, 21 bp, Artificial sequence
  SiRNA target sequence
acatcataatacttatgtaac

SEQ ID NO: 32048 - DNA, 21 bp, Artificial sequence
  SiRNA target sequence
catcataatacttatgtaact

SEQ ID NO: 32049 - DNA, 21 bp, Artificial sequence
  SiRNA target sequence
atcataatacttatgtaacta

SEQ ID NO: 32050 - DNA, 21 bp, Artificial sequence
  SiRNA target sequence
tcataatacttatgtaactaa

SEQ ID NO: 32051 - DNA, 21 bp, Artificial sequence
  SiRNA target sequence
cataatacttatgtaactaaa

SEQ ID NO: 32052 - DNA, 21 bp, Artificial sequence
  SiRNA target sequence
ataatacttatgtaactaaat

SEQ ID NO: 32053 - DNA, 21 bp, Artificial sequence
  SiRNA target sequence
taatacttatgtaactaaatt

SEQ ID NO: 32054 - DNA, 21 bp, Artificial sequence
  SiRNA target sequence
aatacttatgtaactaaattg

SEQ ID NO: 32055 - DNA, 21 bp, Artificial sequence
  SiRNA target sequence
atacttatgtaactaaattga

SEQ ID NO: 32056 - DNA, 21 bp, Artificial sequence
  SiRNA target sequence
tacttatgtaactaaattgaa

SEQ ID NO: 32057 - DNA, 21 bp, Artificial sequence
  SiRNA target sequence
acttatgtaactaaattgaat

SEQ ID NO: 32058 - DNA, 21 bp, Artificial sequence
  SiRNA target sequence
cttatgtaactaaattgaatg

SEQ ID NO: 32059 - DNA, 21 bp, Artificial sequence
  SiRNA target sequence
ttatgtaactaaattgaatga

SEQ ID NO: 32060 - DNA, 21 bp, Artificial sequence
  SiRNA target sequence
tatgtaactaaattgaatgaa

SEQ ID NO: 32061 - DNA, 21 bp, Artificial sequence
  SiRNA target sequence
atgtaactaaattgaatgaag

SEQ ID NO: 32062 - DNA, 21 bp, Artificial sequence
  SiRNA target sequence
tgtaactaaattgaatgaagc

SEQ ID NO: 32063 - DNA, 21 bp, Artificial sequence
  SiRNA target sequence
gtaactaaattgaatgaagca

SEQ ID NO: 32064 - DNA, 21 bp, Artificial sequence
  SiRNA target sequence
taactaaattgaatgaagcaa

SEQ ID NO: 32065 - DNA, 21 bp, Artificial sequence
  SiRNA target sequence
aactaaattgaatgaagcaat

SEQ ID NO: 32066 - DNA, 21 bp, Artificial sequence
  SiRNA target sequence
actaaattgaatgaagcaatt

SEQ ID NO: 32067 - DNA, 21 bp, Artificial sequence
  SiRNA target sequence
ctaaattgaatgaagcaattg

SEQ ID NO: 32068 - DNA, 21 bp, Artificial sequence
  SiRNA target sequence
taaattgaatgaagcaattga

SEQ ID NO: 32069 - DNA, 21 bp, Artificial sequence
  SiRNA target sequence
aaattgaatgaagcaattgaa

SEQ ID NO: 32070 - DNA, 21 bp, Artificial sequence
  SiRNA target sequence
aattgaatgaagcaattgaaa

SEQ ID NO: 32071 - DNA, 21 bp, Artificial sequence
  SiRNA target sequence
attgaatgaagcaattgaaaa

SEQ ID NO: 32072 - DNA, 21 bp, Artificial sequence
  SiRNA target sequence
ttgaatgaagcaattgaaaaa

SEQ ID NO: 32073 - DNA, 21 bp, Artificial sequence
  SiRNA target sequence
tgaatgaagcaattgaaaaac

SEQ ID NO: 32074 - DNA, 21 bp, Artificial sequence
  SiRNA target sequence
gaatgaagcaattgaaaaaca

SEQ ID NO: 32075 - DNA, 21 bp, Artificial sequence
  SiRNA target sequence
aatgaagcaattgaaaaacat

SEQ ID NO: 32076 - DNA, 21 bp, Artificial sequence
  SiRNA target sequence
atgaagcaattgaaaaacatc

SEQ ID NO: 32077 - DNA, 21 bp, Artificial sequence
  SiRNA target sequence
tgaagcaattgaaaaacatcc

SEQ ID NO: 32078 - DNA, 21 bp, Artificial sequence
  SiRNA target sequence
gaagcaattgaaaaacatcct

SEQ ID NO: 32079 - DNA, 21 bp, Artificial sequence
  SiRNA target sequence
aagcaattgaaaaacatcctg

SEQ ID NO: 32080 - DNA, 21 bp, Artificial sequence
  SiRNA target sequence
agcaattgaaaaacatcctga

SEQ ID NO: 32081 - DNA, 21 bp, Artificial sequence
  SiRNA target sequence
gcaattgaaaaacatcctgaa

SEQ ID NO: 32082 - DNA, 21 bp, Artificial sequence
  SiRNA target sequence
caattgaaaaacatcctgaac

SEQ ID NO: 32083 - DNA, 21 bp, Artificial sequence
  SiRNA target sequence
aattgaaaaacatcctgaact

SEQ ID NO: 32084 - DNA, 21 bp, Artificial sequence
  SiRNA target sequence
attgaaaaacatcctgaactt

SEQ ID NO: 32085 - DNA, 21 bp, Artificial sequence
  SiRNA target sequence
ttgaaaaacatcctgaacttg

SEQ ID NO: 32086 - DNA, 21 bp, Artificial sequence
  SiRNA target sequence
tgaaaaacatcctgaacttgg

SEQ ID NO: 32087 - DNA, 21 bp, Artificial sequence
  SiRNA target sequence
gaaaaacatcctgaacttgga

SEQ ID NO: 32088 - DNA, 21 bp, Artificial sequence
  SiRNA target sequence
aaaaacatcctgaacttggaa

SEQ ID NO: 32089 - DNA, 21 bp, Artificial sequence
  SiRNA target sequence
aaaacatcctgaacttggaaa

SEQ ID NO: 32090 - DNA, 21 bp, Artificial sequence
  SiRNA target sequence
aaacatcctgaacttggaaat

SEQ ID NO: 32091 - DNA, 21 bp, Artificial sequence
  SiRNA target sequence
aacatcctgaacttggaaatc

SEQ ID NO: 32092 - DNA, 21 bp, Artificial sequence
  SiRNA target sequence
acatcctgaacttggaaatca

SEQ ID NO: 32093 - DNA, 21 bp, Artificial sequence
  SiRNA target sequence
catcctgaacttggaaatcaa

SEQ ID NO: 32094 - DNA, 21 bp, Artificial sequence
  SiRNA target sequence
atcctgaacttggaaatcaat

SEQ ID NO: 32095 - DNA, 21 bp, Artificial sequence
  SiRNA target sequence
tcctgaacttggaaatcaatc

SEQ ID NO: 32096 - DNA, 21 bp, Artificial sequence
  SiRNA target sequence
cctgaacttggaaatcaatct

SEQ ID NO: 32097 - DNA, 21 bp, Artificial sequence
  SiRNA target sequence
ctgaacttggaaatcaatctg

SEQ ID NO: 32098 - DNA, 21 bp, Artificial sequence
  SiRNA target sequence
tgaacttggaaatcaatctgt

SEQ ID NO: 32099 - DNA, 21 bp, Artificial sequence
  SiRNA target sequence
gaacttggaaatcaatctgtt

SEQ ID NO: 32100 - DNA, 21 bp, Artificial sequence
  SiRNA target sequence
aacttggaaatcaatctgttg

SEQ ID NO: 32101 - DNA, 21 bp, Artificial sequence
  SiRNA target sequence
acttggaaatcaatctgttga

SEQ ID NO: 32102 - DNA, 21 bp, Artificial sequence
  SiRNA target sequence
cttggaaatcaatctgttgag

SEQ ID NO: 32103 - DNA, 21 bp, Artificial sequence
  SiRNA target sequence
ttggaaatcaatctgttgagg

SEQ ID NO: 32104 - DNA, 21 bp, Artificial sequence
  SiRNA target sequence
tggaaatcaatctgttgagga

SEQ ID NO: 32105 - DNA, 21 bp, Artificial sequence
  SiRNA target sequence
ggaaatcaatctgttgaggaa

SEQ ID NO: 32106 - DNA, 21 bp, Artificial sequence
  SiRNA target sequence
gaaatcaatctgttgaggaat

SEQ ID NO: 32107 - DNA, 21 bp, Artificial sequence
  SiRNA target sequence
aaatcaatctgttgaggaatt

SEQ ID NO: 32108 - DNA, 21 bp, Artificial sequence
  SiRNA target sequence
aatcaatctgttgaggaatta

SEQ ID NO: 32109 - DNA, 21 bp, Artificial sequence
  SiRNA target sequence
atcaatctgttgaggaattaa

SEQ ID NO: 32110 - DNA, 21 bp, Artificial sequence
  SiRNA target sequence
tcaatctgttgaggaattaat

SEQ ID NO: 32111 - DNA, 21 bp, Artificial sequence
  SiRNA target sequence
caatctgttgaggaattaatt

SEQ ID NO: 32112 - DNA, 21 bp, Artificial sequence
  SiRNA target sequence
aatctgttgaggaattaatta

SEQ ID NO: 32113 - DNA, 21 bp, Artificial sequence
  SiRNA target sequence
atctgttgaggaattaattac

SEQ ID NO: 32114 - DNA, 21 bp, Artificial sequence
  SiRNA target sequence
tctgttgaggaattaattaca

SEQ ID NO: 32115 - DNA, 21 bp, Artificial sequence
  SiRNA target sequence
ctgttgaggaattaattacaa

SEQ ID NO: 32116 - DNA, 21 bp, Artificial sequence
  SiRNA target sequence
tgttgaggaattaattacaaa

SEQ ID NO: 32117 - DNA, 21 bp, Artificial sequence
  SiRNA target sequence
gttgaggaattaattacaaat

SEQ ID NO: 32118 - DNA, 21 bp, Artificial sequence
  SiRNA target sequence
ttgaggaattaattacaaata

SEQ ID NO: 32119 - DNA, 21 bp, Artificial sequence
  SiRNA target sequence
tgaggaattaattacaaatat

SEQ ID NO: 32120 - DNA, 21 bp, Artificial sequence
  SiRNA target sequence
gaggaattaattacaaatatg

SEQ ID NO: 32121 - DNA, 21 bp, Artificial sequence
  SiRNA target sequence
aggaattaattacaaatatga

SEQ ID NO: 32122 - DNA, 21 bp, Artificial sequence
  SiRNA target sequence
ggaattaattacaaatatgaa

SEQ ID NO: 32123 - DNA, 21 bp, Artificial sequence
  SiRNA target sequence
gaattaattacaaatatgaat

SEQ ID NO: 32124 - DNA, 21 bp, Artificial sequence
  SiRNA target sequence
aattaattacaaatatgaatg

SEQ ID NO: 32125 - DNA, 21 bp, Artificial sequence
  SiRNA target sequence
attaattacaaatatgaatgc

SEQ ID NO: 32126 - DNA, 21 bp, Artificial sequence
  SiRNA target sequence
ttaattacaaatatgaatgcg

SEQ ID NO: 32127 - DNA, 21 bp, Artificial sequence
  SiRNA target sequence
taattacaaatatgaatgcga

SEQ ID NO: 32128 - DNA, 21 bp, Artificial sequence
  SiRNA target sequence
aattacaaatatgaatgcgat

SEQ ID NO: 32129 - DNA, 21 bp, Artificial sequence
  SiRNA target sequence
attacaaatatgaatgcgatt

SEQ ID NO: 32130 - DNA, 21 bp, Artificial sequence
  SiRNA target sequence
ttacaaatatgaatgcgattc

SEQ ID NO: 32131 - DNA, 21 bp, Artificial sequence
  SiRNA target sequence
tacaaatatgaatgcgattcc

SEQ ID NO: 32132 - DNA, 21 bp, Artificial sequence
  SiRNA target sequence
acaaatatgaatgcgattccc

SEQ ID NO: 32133 - DNA, 21 bp, Artificial sequence
  SiRNA target sequence
caaatatgaatgcgattcccg

SEQ ID NO: 32134 - DNA, 21 bp, Artificial sequence
  SiRNA target sequence
aaatatgaatgcgattcccga

SEQ ID NO: 32135 - DNA, 21 bp, Artificial sequence
  SiRNA target sequence
aatatgaatgcgattcccgaa

SEQ ID NO: 32136 - DNA, 21 bp, Artificial sequence
  SiRNA target sequence
atatgaatgcgattcccgaag

SEQ ID NO: 32137 - DNA, 21 bp, Artificial sequence
  SiRNA target sequence
tatgaatgcgattcccgaaga

SEQ ID NO: 32138 - DNA, 21 bp, Artificial sequence
  SiRNA target sequence
atgaatgcgattcccgaagat

SEQ ID NO: 32139 - DNA, 21 bp, Artificial sequence
  SiRNA target sequence
tgaatgcgattcccgaagata

SEQ ID NO: 32140 - DNA, 21 bp, Artificial sequence
  SiRNA target sequence
gaatgcgattcccgaagatat

SEQ ID NO: 32141 - DNA, 21 bp, Artificial sequence
  SiRNA target sequence
aatgcgattcccgaagatatt

SEQ ID NO: 32142 - DNA, 21 bp, Artificial sequence
  SiRNA target sequence
atgcgattcccgaagatattc

SEQ ID NO: 32143 - DNA, 21 bp, Artificial sequence
  SiRNA target sequence
tgcgattcccgaagatattcg

SEQ ID NO: 32144 - DNA, 21 bp, Artificial sequence
  SiRNA target sequence
gcgattcccgaagatattcgt

SEQ ID NO: 32145 - DNA, 21 bp, Artificial sequence
  SiRNA target sequence
cgattcccgaagatattcgtt

SEQ ID NO: 32146 - DNA, 21 bp, Artificial sequence
  SiRNA target sequence
gattcccgaagatattcgttt

SEQ ID NO: 32147 - DNA, 21 bp, Artificial sequence
  SiRNA target sequence
attcccgaagatattcgttta

SEQ ID NO: 32148 - DNA, 21 bp, Artificial sequence
  SiRNA target sequence
ttcccgaagatattcgtttag

SEQ ID NO: 32149 - DNA, 21 bp, Artificial sequence
  SiRNA target sequence
tcccgaagatattcgtttagc

SEQ ID NO: 32150 - DNA, 21 bp, Artificial sequence
  SiRNA target sequence
cccgaagatattcgtttagct

SEQ ID NO: 32151 - DNA, 21 bp, Artificial sequence
  SiRNA target sequence
ccgaagatattcgtttagctg

SEQ ID NO: 32152 - DNA, 21 bp, Artificial sequence
  SiRNA target sequence
cgaagatattcgtttagctgt

SEQ ID NO: 32153 - DNA, 21 bp, Artificial sequence
  SiRNA target sequence
gaagatattcgtttagctgtt

SEQ ID NO: 32154 - DNA, 21 bp, Artificial sequence
  SiRNA target sequence
aagatattcgtttagctgttc

SEQ ID NO: 32155 - DNA, 21 bp, Artificial sequence
  SiRNA target sequence
agatattcgtttagctgttcg

SEQ ID NO: 32156 - DNA, 21 bp, Artificial sequence
  SiRNA target sequence
gatattcgtttagctgttcgc

SEQ ID NO: 32157 - DNA, 21 bp, Artificial sequence
  SiRNA target sequence
atattcgtttagctgttcgca

SEQ ID NO: 32158 - DNA, 21 bp, Artificial sequence
  SiRNA target sequence
tattcgtttagctgttcgcaa

SEQ ID NO: 32159 - DNA, 21 bp, Artificial sequence
  SiRNA target sequence
attcgtttagctgttcgcaat

SEQ ID NO: 32160 - DNA, 21 bp, Artificial sequence
  SiRNA target sequence
ttcgtttagctgttcgcaata

SEQ ID NO: 32161 - DNA, 21 bp, Artificial sequence
  SiRNA target sequence
tcgtttagctgttcgcaataa

SEQ ID NO: 32162 - DNA, 21 bp, Artificial sequence
  SiRNA target sequence
cgtttagctgttcgcaataat

SEQ ID NO: 32163 - DNA, 21 bp, Artificial sequence
  SiRNA target sequence
gtttagctgttcgcaataatg

SEQ ID NO: 32164 - DNA, 21 bp, Artificial sequence
  SiRNA target sequence
tttagctgttcgcaataatgg

SEQ ID NO: 32165 - DNA, 21 bp, Artificial sequence
  SiRNA target sequence
ttagctgttcgcaataatggt

SEQ ID NO: 32166 - DNA, 21 bp, Artificial sequence
  SiRNA target sequence
tagctgttcgcaataatggtg

SEQ ID NO: 32167 - DNA, 21 bp, Artificial sequence
  SiRNA target sequence
agctgttcgcaataatggtgg

SEQ ID NO: 32168 - DNA, 21 bp, Artificial sequence
  SiRNA target sequence
gctgttcgcaataatggtggg

SEQ ID NO: 32169 - DNA, 21 bp, Artificial sequence
  SiRNA target sequence
ctgttcgcaataatggtgggg

SEQ ID NO: 32170 - DNA, 21 bp, Artificial sequence
  SiRNA target sequence
tgttcgcaataatggtggggg

SEQ ID NO: 32171 - DNA, 21 bp, Artificial sequence
  SiRNA target sequence
gttcgcaataatggtgggggg

SEQ ID NO: 32172 - DNA, 21 bp, Artificial sequence
  SiRNA target sequence
ttcgcaataatggtggggggc

SEQ ID NO: 32173 - DNA, 21 bp, Artificial sequence
  SiRNA target sequence
tcgcaataatggtggggggca

SEQ ID NO: 32174 - DNA, 21 bp, Artificial sequence
  SiRNA target sequence
cgcaataatggtggggggcat

SEQ ID NO: 32175 - DNA, 21 bp, Artificial sequence
  SiRNA target sequence
gcaataatggtggggggcatg

SEQ ID NO: 32176 - DNA, 21 bp, Artificial sequence
  SiRNA target sequence
caataatggtggggggcatgt

SEQ ID NO: 32177 - DNA, 21 bp, Artificial sequence
  SiRNA target sequence
aataatggtggggggcatgtg

SEQ ID NO: 32178 - DNA, 21 bp, Artificial sequence
  SiRNA target sequence
ataatggtggggggcatgtga

SEQ ID NO: 32179 - DNA, 21 bp, Artificial sequence
  SiRNA target sequence
taatggtggggggcatgtgaa

SEQ ID NO: 32180 - DNA, 21 bp, Artificial sequence
  SiRNA target sequence
aatggtggggggcatgtgaat

SEQ ID NO: 32181 - DNA, 21 bp, Artificial sequence
  SiRNA target sequence
atggtggggggcatgtgaatc

SEQ ID NO: 32182 - DNA, 21 bp, Artificial sequence
  SiRNA target sequence
tggtggggggcatgtgaatca

SEQ ID NO: 32183 - DNA, 21 bp, Artificial sequence
  SiRNA target sequence
ggtggggggcatgtgaatcat

SEQ ID NO: 32184 - DNA, 21 bp, Artificial sequence
  SiRNA target sequence
gtggggggcatgtgaatcatt

SEQ ID NO: 32185 - DNA, 21 bp, Artificial sequence
  SiRNA target sequence
tggggggcatgtgaatcattc

SEQ ID NO: 32186 - DNA, 21 bp, Artificial sequence
  SiRNA target sequence
ggggggcatgtgaatcattca

SEQ ID NO: 32187 - DNA, 21 bp, Artificial sequence
  SiRNA target sequence
gggggcatgtgaatcattcat

SEQ ID NO: 32188 - DNA, 21 bp, Artificial sequence
  SiRNA target sequence
ggggcatgtgaatcattcatt

SEQ ID NO: 32189 - DNA, 21 bp, Artificial sequence
  SiRNA target sequence
gggcatgtgaatcattcattt

SEQ ID NO: 32190 - DNA, 21 bp, Artificial sequence
  SiRNA target sequence
ggcatgtgaatcattcatttt

SEQ ID NO: 32191 - DNA, 21 bp, Artificial sequence
  SiRNA target sequence
gcatgtgaatcattcattttt

SEQ ID NO: 32192 - DNA, 21 bp, Artificial sequence
  SiRNA target sequence
catgtgaatcattcatttttc

SEQ ID NO: 32193 - DNA, 21 bp, Artificial sequence
  SiRNA target sequence
atgtgaatcattcatttttct

SEQ ID NO: 32194 - DNA, 21 bp, Artificial sequence
  SiRNA target sequence
tgtgaatcattcatttttctg

SEQ ID NO: 32195 - DNA, 21 bp, Artificial sequence
  SiRNA target sequence
gtgaatcattcatttttctgg

SEQ ID NO: 32196 - DNA, 21 bp, Artificial sequence
  SiRNA target sequence
tgaatcattcatttttctgga

SEQ ID NO: 32197 - DNA, 21 bp, Artificial sequence
  SiRNA target sequence
gaatcattcatttttctggaa

SEQ ID NO: 32198 - DNA, 21 bp, Artificial sequence
  SiRNA target sequence
aatcattcatttttctggaaa

SEQ ID NO: 32199 - DNA, 21 bp, Artificial sequence
  SiRNA target sequence
atcattcatttttctggaaag

SEQ ID NO: 32200 - DNA, 21 bp, Artificial sequence
  SiRNA target sequence
tcattcatttttctggaaagt

SEQ ID NO: 32201 - DNA, 21 bp, Artificial sequence
  SiRNA target sequence
cattcatttttctggaaagtt

SEQ ID NO: 32202 - DNA, 21 bp, Artificial sequence
  SiRNA target sequence
attcatttttctggaaagtta

SEQ ID NO: 32203 - DNA, 21 bp, Artificial sequence
  SiRNA target sequence
ttcatttttctggaaagttat

SEQ ID NO: 32204 - DNA, 21 bp, Artificial sequence
  SiRNA target sequence
tcatttttctggaaagttatg

SEQ ID NO: 32205 - DNA, 21 bp, Artificial sequence
  SiRNA target sequence
catttttctggaaagttatgg

SEQ ID NO: 32206 - DNA, 21 bp, Artificial sequence
  SiRNA target sequence
atttttctggaaagttatggg

SEQ ID NO: 32207 - DNA, 21 bp, Artificial sequence
  SiRNA target sequence
tttttctggaaagttatgggg

SEQ ID NO: 32208 - DNA, 21 bp, Artificial sequence
  SiRNA target sequence
ttttctggaaagttatggggc

SEQ ID NO: 32209 - DNA, 21 bp, Artificial sequence
  SiRNA target sequence
tttctggaaagttatggggcc

SEQ ID NO: 32210 - DNA, 21 bp, Artificial sequence
  SiRNA target sequence
ttctggaaagttatggggcca

SEQ ID NO: 32211 - DNA, 21 bp, Artificial sequence
  SiRNA target sequence
tctggaaagttatggggccaa

SEQ ID NO: 32212 - DNA, 21 bp, Artificial sequence
  SiRNA target sequence
ctggaaagttatggggccaaa

SEQ ID NO: 32213 - DNA, 21 bp, Artificial sequence
  SiRNA target sequence
tggaaagttatggggccaaat

SEQ ID NO: 32214 - DNA, 21 bp, Artificial sequence
  SiRNA target sequence
ggaaagttatggggccaaatg

SEQ ID NO: 32215 - DNA, 21 bp, Artificial sequence
  SiRNA target sequence
gaaagttatggggccaaatgc

SEQ ID NO: 32216 - DNA, 21 bp, Artificial sequence
  SiRNA target sequence
aaagttatggggccaaatgct

SEQ ID NO: 32217 - DNA, 21 bp, Artificial sequence
  SiRNA target sequence
aagttatggggccaaatgctg

SEQ ID NO: 32218 - DNA, 21 bp, Artificial sequence
  SiRNA target sequence
agttatggggccaaatgctgg

SEQ ID NO: 32219 - DNA, 21 bp, Artificial sequence
  SiRNA target sequence
gttatggggccaaatgctggt

SEQ ID NO: 32220 - DNA, 21 bp, Artificial sequence
  SiRNA target sequence
ttatggggccaaatgctggtg

SEQ ID NO: 32221 - DNA, 21 bp, Artificial sequence
  SiRNA target sequence
tatggggccaaatgctggtgg

SEQ ID NO: 32222 - DNA, 21 bp, Artificial sequence
  SiRNA target sequence
atggggccaaatgctggtggt

SEQ ID NO: 32223 - DNA, 21 bp, Artificial sequence
  SiRNA target sequence
tggggccaaatgctggtggtg

SEQ ID NO: 32224 - DNA, 21 bp, Artificial sequence
  SiRNA target sequence
ggggccaaatgctggtggtga

SEQ ID NO: 32225 - DNA, 21 bp, Artificial sequence
  SiRNA target sequence
gggccaaatgctggtggtgaa

SEQ ID NO: 32226 - DNA, 21 bp, Artificial sequence
  SiRNA target sequence
ggccaaatgctggtggtgaac

SEQ ID NO: 32227 - DNA, 21 bp, Artificial sequence
  SiRNA target sequence
gccaaatgctggtggtgaacc

SEQ ID NO: 32228 - DNA, 21 bp, Artificial sequence
  SiRNA target sequence
ccaaatgctggtggtgaacca

SEQ ID NO: 32229 - DNA, 21 bp, Artificial sequence
  SiRNA target sequence
caaatgctggtggtgaaccaa

SEQ ID NO: 32230 - DNA, 21 bp, Artificial sequence
  SiRNA target sequence
aaatgctggtggtgaaccaac

SEQ ID NO: 32231 - DNA, 21 bp, Artificial sequence
  SiRNA target sequence
aatgctggtggtgaaccaact

SEQ ID NO: 32232 - DNA, 21 bp, Artificial sequence
  SiRNA target sequence
atgctggtggtgaaccaactg

SEQ ID NO: 32233 - DNA, 21 bp, Artificial sequence
  SiRNA target sequence
tgctggtggtgaaccaactgg

SEQ ID NO: 32234 - DNA, 21 bp, Artificial sequence
  SiRNA target sequence
gctggtggtgaaccaactggt

SEQ ID NO: 32235 - DNA, 21 bp, Artificial sequence
  SiRNA target sequence
ctggtggtgaaccaactggtg

SEQ ID NO: 32236 - DNA, 21 bp, Artificial sequence
  SiRNA target sequence
tggtggtgaaccaactggtgc

SEQ ID NO: 32237 - DNA, 21 bp, Artificial sequence
  SiRNA target sequence
ggtggtgaaccaactggtgct

SEQ ID NO: 32238 - DNA, 21 bp, Artificial sequence
  SiRNA target sequence
gtggtgaaccaactggtgctg

SEQ ID NO: 32239 - DNA, 21 bp, Artificial sequence
  SiRNA target sequence
tggtgaaccaactggtgctgt

SEQ ID NO: 32240 - DNA, 21 bp, Artificial sequence
  SiRNA target sequence
ggtgaaccaactggtgctgta

SEQ ID NO: 32241 - DNA, 21 bp, Artificial sequence
  SiRNA target sequence
gtgaaccaactggtgctgtaa

SEQ ID NO: 32242 - DNA, 21 bp, Artificial sequence
  SiRNA target sequence
tgaaccaactggtgctgtaaa

SEQ ID NO: 32243 - DNA, 21 bp, Artificial sequence
  SiRNA target sequence
gaaccaactggtgctgtaaaa

SEQ ID NO: 32244 - DNA, 21 bp, Artificial sequence
  SiRNA target sequence
aaccaactggtgctgtaaaag

SEQ ID NO: 32245 - DNA, 21 bp, Artificial sequence
  SiRNA target sequence
accaactggtgctgtaaaaga

SEQ ID NO: 32246 - DNA, 21 bp, Artificial sequence
  SiRNA target sequence
ccaactggtgctgtaaaagaa

SEQ ID NO: 32247 - DNA, 21 bp, Artificial sequence
  SiRNA target sequence
caactggtgctgtaaaagaag

SEQ ID NO: 32248 - DNA, 21 bp, Artificial sequence
  SiRNA target sequence
aactggtgctgtaaaagaagc

SEQ ID NO: 32249 - DNA, 21 bp, Artificial sequence
  SiRNA target sequence
actggtgctgtaaaagaagct

SEQ ID NO: 32250 - DNA, 21 bp, Artificial sequence
  SiRNA target sequence
ctggtgctgtaaaagaagcta

SEQ ID NO: 32251 - DNA, 21 bp, Artificial sequence
  SiRNA target sequence
tggtgctgtaaaagaagctat

SEQ ID NO: 32252 - DNA, 21 bp, Artificial sequence
  SiRNA target sequence
ggtgctgtaaaagaagctatt

SEQ ID NO: 32253 - DNA, 21 bp, Artificial sequence
  SiRNA target sequence
gtgctgtaaaagaagctatta

SEQ ID NO: 32254 - DNA, 21 bp, Artificial sequence
  SiRNA target sequence
tgctgtaaaagaagctattaa

SEQ ID NO: 32255 - DNA, 21 bp, Artificial sequence
  SiRNA target sequence
gctgtaaaagaagctattaat

SEQ ID NO: 32256 - DNA, 21 bp, Artificial sequence
  SiRNA target sequence
ctgtaaaagaagctattaatc

SEQ ID NO: 32257 - DNA, 21 bp, Artificial sequence
  SiRNA target sequence
tgtaaaagaagctattaatca

SEQ ID NO: 32258 - DNA, 21 bp, Artificial sequence
  SiRNA target sequence
gtaaaagaagctattaatcaa

SEQ ID NO: 32259 - DNA, 21 bp, Artificial sequence
  SiRNA target sequence
taaaagaagctattaatcaaa

SEQ ID NO: 32260 - DNA, 21 bp, Artificial sequence
  SiRNA target sequence
aaaagaagctattaatcaaac

SEQ ID NO: 32261 - DNA, 21 bp, Artificial sequence
  SiRNA target sequence
aaagaagctattaatcaaact

SEQ ID NO: 32262 - DNA, 21 bp, Artificial sequence
  SiRNA target sequence
aagaagctattaatcaaactt

SEQ ID NO: 32263 - DNA, 21 bp, Artificial sequence
  SiRNA target sequence
agaagctattaatcaaacttt

SEQ ID NO: 32264 - DNA, 21 bp, Artificial sequence
  SiRNA target sequence
gaagctattaatcaaactttt

SEQ ID NO: 32265 - DNA, 21 bp, Artificial sequence
  SiRNA target sequence
aagctattaatcaaacttttg

SEQ ID NO: 32266 - DNA, 21 bp, Artificial sequence
  SiRNA target sequence
agctattaatcaaacttttgg

SEQ ID NO: 32267 - DNA, 21 bp, Artificial sequence
  SiRNA target sequence
gctattaatcaaacttttggt

SEQ ID NO: 32268 - DNA, 21 bp, Artificial sequence
  SiRNA target sequence
ctattaatcaaacttttggta

SEQ ID NO: 32269 - DNA, 21 bp, Artificial sequence
  SiRNA target sequence
tattaatcaaacttttggtag

SEQ ID NO: 32270 - DNA, 21 bp, Artificial sequence
  SiRNA target sequence
attaatcaaacttttggtagt

SEQ ID NO: 32271 - DNA, 21 bp, Artificial sequence
  SiRNA target sequence
ttaatcaaacttttggtagtt

SEQ ID NO: 32272 - DNA, 21 bp, Artificial sequence
  SiRNA target sequence
taatcaaacttttggtagttt

SEQ ID NO: 32273 - DNA, 21 bp, Artificial sequence
  SiRNA target sequence
aatcaaacttttggtagtttc

SEQ ID NO: 32274 - DNA, 21 bp, Artificial sequence
  SiRNA target sequence
atcaaacttttggtagtttcg

SEQ ID NO: 32275 - DNA, 21 bp, Artificial sequence
  SiRNA target sequence
tcaaacttttggtagtttcga

SEQ ID NO: 32276 - DNA, 21 bp, Artificial sequence
  SiRNA target sequence
caaacttttggtagtttcgaa

SEQ ID NO: 32277 - DNA, 21 bp, Artificial sequence
  SiRNA target sequence
aaacttttggtagtttcgaaa

SEQ ID NO: 32278 - DNA, 21 bp, Artificial sequence
  SiRNA target sequence
aacttttggtagtttcgaaaa

SEQ ID NO: 32279 - DNA, 21 bp, Artificial sequence
  SiRNA target sequence
acttttggtagtttcgaaaaa

SEQ ID NO: 32280 - DNA, 21 bp, Artificial sequence
  SiRNA target sequence
cttttggtagtttcgaaaaaa

SEQ ID NO: 32281 - DNA, 21 bp, Artificial sequence
  SiRNA target sequence
ttttggtagtttcgaaaaaat

SEQ ID NO: 32282 - DNA, 21 bp, Artificial sequence
  SiRNA target sequence
tttggtagtttcgaaaaaatg

SEQ ID NO: 32283 - DNA, 21 bp, Artificial sequence
  SiRNA target sequence
ttggtagtttcgaaaaaatga

SEQ ID NO: 32284 - DNA, 21 bp, Artificial sequence
  SiRNA target sequence
tggtagtttcgaaaaaatgaa

SEQ ID NO: 32285 - DNA, 21 bp, Artificial sequence
  SiRNA target sequence
ggtagtttcgaaaaaatgaag

SEQ ID NO: 32286 - DNA, 21 bp, Artificial sequence
  SiRNA target sequence
gtagtttcgaaaaaatgaagg

SEQ ID NO: 32287 - DNA, 21 bp, Artificial sequence
  SiRNA target sequence
tagtttcgaaaaaatgaagga

SEQ ID NO: 32288 - DNA, 21 bp, Artificial sequence
  SiRNA target sequence
agtttcgaaaaaatgaaggaa

SEQ ID NO: 32289 - DNA, 21 bp, Artificial sequence
  SiRNA target sequence
gtttcgaaaaaatgaaggaac

SEQ ID NO: 32290 - DNA, 21 bp, Artificial sequence
  SiRNA target sequence
tttcgaaaaaatgaaggaaca

SEQ ID NO: 32291 - DNA, 21 bp, Artificial sequence
  SiRNA target sequence
ttcgaaaaaatgaaggaacaa

SEQ ID NO: 32292 - DNA, 21 bp, Artificial sequence
  SiRNA target sequence
tcgaaaaaatgaaggaacaat

SEQ ID NO: 32293 - DNA, 21 bp, Artificial sequence
  SiRNA target sequence
cgaaaaaatgaaggaacaatt

SEQ ID NO: 32294 - DNA, 21 bp, Artificial sequence
  SiRNA target sequence
gaaaaaatgaaggaacaattc

SEQ ID NO: 32295 - DNA, 21 bp, Artificial sequence
  SiRNA target sequence
aaaaaatgaaggaacaattca

SEQ ID NO: 32296 - DNA, 21 bp, Artificial sequence
  SiRNA target sequence
aaaaatgaaggaacaattcaa

SEQ ID NO: 32297 - DNA, 21 bp, Artificial sequence
  SiRNA target sequence
aaaatgaaggaacaattcaat

SEQ ID NO: 32298 - DNA, 21 bp, Artificial sequence
  SiRNA target sequence
aaatgaaggaacaattcaatg

SEQ ID NO: 32299 - DNA, 21 bp, Artificial sequence
  SiRNA target sequence
aatgaaggaacaattcaatgc

SEQ ID NO: 32300 - DNA, 21 bp, Artificial sequence
  SiRNA target sequence
atgaaggaacaattcaatgca

SEQ ID NO: 32301 - DNA, 21 bp, Artificial sequence
  SiRNA target sequence
tgaaggaacaattcaatgcag

SEQ ID NO: 32302 - DNA, 21 bp, Artificial sequence
  SiRNA target sequence
gaaggaacaattcaatgcagc

SEQ ID NO: 32303 - DNA, 21 bp, Artificial sequence
  SiRNA target sequence
aaggaacaattcaatgcagct

SEQ ID NO: 32304 - DNA, 21 bp, Artificial sequence
  SiRNA target sequence
aggaacaattcaatgcagctg

SEQ ID NO: 32305 - DNA, 21 bp, Artificial sequence
  SiRNA target sequence
ggaacaattcaatgcagctgc

SEQ ID NO: 32306 - DNA, 21 bp, Artificial sequence
  SiRNA target sequence
gaacaattcaatgcagctgca

SEQ ID NO: 32307 - DNA, 21 bp, Artificial sequence
  SiRNA target sequence
aacaattcaatgcagctgcag

SEQ ID NO: 32308 - DNA, 21 bp, Artificial sequence
  SiRNA target sequence
acaattcaatgcagctgcagc

SEQ ID NO: 32309 - DNA, 21 bp, Artificial sequence
  SiRNA target sequence
caattcaatgcagctgcagct

SEQ ID NO: 32310 - DNA, 21 bp, Artificial sequence
  SiRNA target sequence
aattcaatgcagctgcagcta

SEQ ID NO: 32311 - DNA, 21 bp, Artificial sequence
  SiRNA target sequence
attcaatgcagctgcagctag

SEQ ID NO: 32312 - DNA, 21 bp, Artificial sequence
  SiRNA target sequence
ttcaatgcagctgcagctagt

SEQ ID NO: 32313 - DNA, 21 bp, Artificial sequence
  SiRNA target sequence
tcaatgcagctgcagctagtc

SEQ ID NO: 32314 - DNA, 21 bp, Artificial sequence
  SiRNA target sequence
caatgcagctgcagctagtcg

SEQ ID NO: 32315 - DNA, 21 bp, Artificial sequence
  SiRNA target sequence
aatgcagctgcagctagtcgg

SEQ ID NO: 32316 - DNA, 21 bp, Artificial sequence
  SiRNA target sequence
atgcagctgcagctagtcggt

SEQ ID NO: 32317 - DNA, 21 bp, Artificial sequence
  SiRNA target sequence
tgcagctgcagctagtcggtt

SEQ ID NO: 32318 - DNA, 21 bp, Artificial sequence
  SiRNA target sequence
gcagctgcagctagtcggttt

SEQ ID NO: 32319 - DNA, 21 bp, Artificial sequence
  SiRNA target sequence
cagctgcagctagtcggtttg

SEQ ID NO: 32320 - DNA, 21 bp, Artificial sequence
  SiRNA target sequence
agctgcagctagtcggtttgg

SEQ ID NO: 32321 - DNA, 21 bp, Artificial sequence
  SiRNA target sequence
gctgcagctagtcggtttggt

SEQ ID NO: 32322 - DNA, 21 bp, Artificial sequence
  SiRNA target sequence
ctgcagctagtcggtttggtt

SEQ ID NO: 32323 - DNA, 21 bp, Artificial sequence
  SiRNA target sequence
tgcagctagtcggtttggttc

SEQ ID NO: 32324 - DNA, 21 bp, Artificial sequence
  SiRNA target sequence
gcagctagtcggtttggttcc

SEQ ID NO: 32325 - DNA, 21 bp, Artificial sequence
  SiRNA target sequence
cagctagtcggtttggttccg

SEQ ID NO: 32326 - DNA, 21 bp, Artificial sequence
  SiRNA target sequence
agctagtcggtttggttccgg

SEQ ID NO: 32327 - DNA, 21 bp, Artificial sequence
  SiRNA target sequence
gctagtcggtttggttccggt

SEQ ID NO: 32328 - DNA, 21 bp, Artificial sequence
  SiRNA target sequence
ctagtcggtttggttccggtt

SEQ ID NO: 32329 - DNA, 21 bp, Artificial sequence
  SiRNA target sequence
tagtcggtttggttccggttg

SEQ ID NO: 32330 - DNA, 21 bp, Artificial sequence
  SiRNA target sequence
agtcggtttggttccggttgg

SEQ ID NO: 32331 - DNA, 21 bp, Artificial sequence
  SiRNA target sequence
gtcggtttggttccggttggg

SEQ ID NO: 32332 - DNA, 21 bp, Artificial sequence
  SiRNA target sequence
tcggtttggttccggttgggc

SEQ ID NO: 32333 - DNA, 21 bp, Artificial sequence
  SiRNA target sequence
cggtttggttccggttgggct

SEQ ID NO: 32334 - DNA, 21 bp, Artificial sequence
  SiRNA target sequence
ggtttggttccggttgggctt

SEQ ID NO: 32335 - DNA, 21 bp, Artificial sequence
  SiRNA target sequence
gtttggttccggttgggcttg

SEQ ID NO: 32336 - DNA, 21 bp, Artificial sequence
  SiRNA target sequence
tttggttccggttgggcttgg

SEQ ID NO: 32337 - DNA, 21 bp, Artificial sequence
  SiRNA target sequence
ttggttccggttgggcttggt

SEQ ID NO: 32338 - DNA, 21 bp, Artificial sequence
  SiRNA target sequence
tggttccggttgggcttggtt

SEQ ID NO: 32339 - DNA, 21 bp, Artificial sequence
  SiRNA target sequence
ggttccggttgggcttggttg

SEQ ID NO: 32340 - DNA, 21 bp, Artificial sequence
  SiRNA target sequence
gttccggttgggcttggttgg

SEQ ID NO: 32341 - DNA, 21 bp, Artificial sequence
  SiRNA target sequence
ttccggttgggcttggttggt

SEQ ID NO: 32342 - DNA, 21 bp, Artificial sequence
  SiRNA target sequence
tccggttgggcttggttggtc

SEQ ID NO: 32343 - DNA, 21 bp, Artificial sequence
  SiRNA target sequence
ccggttgggcttggttggtcg

SEQ ID NO: 32344 - DNA, 21 bp, Artificial sequence
  SiRNA target sequence
cggttgggcttggttggtcgt

SEQ ID NO: 32345 - DNA, 21 bp, Artificial sequence
  SiRNA target sequence
ggttgggcttggttggtcgtt

SEQ ID NO: 32346 - DNA, 21 bp, Artificial sequence
  SiRNA target sequence
gttgggcttggttggtcgttg

SEQ ID NO: 32347 - DNA, 21 bp, Artificial sequence
  SiRNA target sequence
ttgggcttggttggtcgttga

SEQ ID NO: 32348 - DNA, 21 bp, Artificial sequence
  SiRNA target sequence
tgggcttggttggtcgttgac

SEQ ID NO: 32349 - DNA, 21 bp, Artificial sequence
  SiRNA target sequence
gggcttggttggtcgttgaca

SEQ ID NO: 32350 - DNA, 21 bp, Artificial sequence
  SiRNA target sequence
ggcttggttggtcgttgacaa

SEQ ID NO: 32351 - DNA, 21 bp, Artificial sequence
  SiRNA target sequence
gcttggttggtcgttgacaaa

SEQ ID NO: 32352 - DNA, 21 bp, Artificial sequence
  SiRNA target sequence
cttggttggtcgttgacaaaa

SEQ ID NO: 32353 - DNA, 21 bp, Artificial sequence
  SiRNA target sequence
ttggttggtcgttgacaaaaa

SEQ ID NO: 32354 - DNA, 21 bp, Artificial sequence
  SiRNA target sequence
tggttggtcgttgacaaaaac

SEQ ID NO: 32355 - DNA, 21 bp, Artificial sequence
  SiRNA target sequence
ggttggtcgttgacaaaaaca

SEQ ID NO: 32356 - DNA, 21 bp, Artificial sequence
  SiRNA target sequence
gttggtcgttgacaaaaacaa

SEQ ID NO: 32357 - DNA, 21 bp, Artificial sequence
  SiRNA target sequence
ttggtcgttgacaaaaacaaa

SEQ ID NO: 32358 - DNA, 21 bp, Artificial sequence
  SiRNA target sequence
tggtcgttgacaaaaacaaaa

SEQ ID NO: 32359 - DNA, 21 bp, Artificial sequence
  SiRNA target sequence
ggtcgttgacaaaaacaaaaa

SEQ ID NO: 32360 - DNA, 21 bp, Artificial sequence
  SiRNA target sequence
gtcgttgacaaaaacaaaaaa

SEQ ID NO: 32361 - DNA, 21 bp, Artificial sequence
  SiRNA target sequence
tcgttgacaaaaacaaaaaat

SEQ ID NO: 32362 - DNA, 21 bp, Artificial sequence
  SiRNA target sequence
cgttgacaaaaacaaaaaatt

SEQ ID NO: 32363 - DNA, 21 bp, Artificial sequence
  SiRNA target sequence
gttgacaaaaacaaaaaattg

SEQ ID NO: 32364 - DNA, 21 bp, Artificial sequence
  SiRNA target sequence
ttgacaaaaacaaaaaattgt

SEQ ID NO: 32365 - DNA, 21 bp, Artificial sequence
  SiRNA target sequence
tgacaaaaacaaaaaattgtc

SEQ ID NO: 32366 - DNA, 21 bp, Artificial sequence
  SiRNA target sequence
gacaaaaacaaaaaattgtca

SEQ ID NO: 32367 - DNA, 21 bp, Artificial sequence
  SiRNA target sequence
acaaaaacaaaaaattgtcaa

SEQ ID NO: 32368 - DNA, 21 bp, Artificial sequence
  SiRNA target sequence
caaaaacaaaaaattgtcaat

SEQ ID NO: 32369 - DNA, 21 bp, Artificial sequence
  SiRNA target sequence
aaaaacaaaaaattgtcaatt

SEQ ID NO: 32370 - DNA, 21 bp, Artificial sequence
  SiRNA target sequence
aaaacaaaaaattgtcaattc

SEQ ID NO: 32371 - DNA, 21 bp, Artificial sequence
  SiRNA target sequence
aaacaaaaaattgtcaattct

SEQ ID NO: 32372 - DNA, 21 bp, Artificial sequence
  SiRNA target sequence
aacaaaaaattgtcaattcta

SEQ ID NO: 32373 - DNA, 21 bp, Artificial sequence
  SiRNA target sequence
acaaaaaattgtcaattctat

SEQ ID NO: 32374 - DNA, 21 bp, Artificial sequence
  SiRNA target sequence
caaaaaattgtcaattctatc

SEQ ID NO: 32375 - DNA, 21 bp, Artificial sequence
  SiRNA target sequence
aaaaaattgtcaattctatct

SEQ ID NO: 32376 - DNA, 21 bp, Artificial sequence
  SiRNA target sequence
aaaaattgtcaattctatcta

SEQ ID NO: 32377 - DNA, 21 bp, Artificial sequence
  SiRNA target sequence
aaaattgtcaattctatctac

SEQ ID NO: 32378 - DNA, 21 bp, Artificial sequence
  SiRNA target sequence
aaattgtcaattctatctaca

SEQ ID NO: 32379 - DNA, 21 bp, Artificial sequence
  SiRNA target sequence
aattgtcaattctatctacag

SEQ ID NO: 32380 - DNA, 21 bp, Artificial sequence
  SiRNA target sequence
attgtcaattctatctacagc

SEQ ID NO: 32381 - DNA, 21 bp, Artificial sequence
  SiRNA target sequence
ttgtcaattctatctacagcc

SEQ ID NO: 32382 - DNA, 21 bp, Artificial sequence
  SiRNA target sequence
tgtcaattctatctacagcca

SEQ ID NO: 32383 - DNA, 21 bp, Artificial sequence
  SiRNA target sequence
gtcaattctatctacagccaa

SEQ ID NO: 32384 - DNA, 21 bp, Artificial sequence
  SiRNA target sequence
tcaattctatctacagccaac

SEQ ID NO: 32385 - DNA, 21 bp, Artificial sequence
  SiRNA target sequence
caattctatctacagccaacc

SEQ ID NO: 32386 - DNA, 21 bp, Artificial sequence
  SiRNA target sequence
aattctatctacagccaacca

SEQ ID NO: 32387 - DNA, 21 bp, Artificial sequence
  SiRNA target sequence
attctatctacagccaaccaa

SEQ ID NO: 32388 - DNA, 21 bp, Artificial sequence
  SiRNA target sequence
ttctatctacagccaaccaag

SEQ ID NO: 32389 - DNA, 21 bp, Artificial sequence
  SiRNA target sequence
tctatctacagccaaccaaga

SEQ ID NO: 32390 - DNA, 21 bp, Artificial sequence
  SiRNA target sequence
ctatctacagccaaccaagat

SEQ ID NO: 32391 - DNA, 21 bp, Artificial sequence
  SiRNA target sequence
tatctacagccaaccaagatt

SEQ ID NO: 32392 - DNA, 21 bp, Artificial sequence
  SiRNA target sequence
atctacagccaaccaagattc

SEQ ID NO: 32393 - DNA, 21 bp, Artificial sequence
  SiRNA target sequence
tctacagccaaccaagattca

SEQ ID NO: 32394 - DNA, 21 bp, Artificial sequence
  SiRNA target sequence
ctacagccaaccaagattcac

SEQ ID NO: 32395 - DNA, 21 bp, Artificial sequence
  SiRNA target sequence
tacagccaaccaagattcacc

SEQ ID NO: 32396 - DNA, 21 bp, Artificial sequence
  SiRNA target sequence
acagccaaccaagattcacca

SEQ ID NO: 32397 - DNA, 21 bp, Artificial sequence
  SiRNA target sequence
cagccaaccaagattcaccac

SEQ ID NO: 32398 - DNA, 21 bp, Artificial sequence
  SiRNA target sequence
agccaaccaagattcaccact

SEQ ID NO: 32399 - DNA, 21 bp, Artificial sequence
  SiRNA target sequence
gccaaccaagattcaccacta

SEQ ID NO: 32400 - DNA, 21 bp, Artificial sequence
  SiRNA target sequence
ccaaccaagattcaccactaa

SEQ ID NO: 32401 - DNA, 21 bp, Artificial sequence
  SiRNA target sequence
caaccaagattcaccactaat

SEQ ID NO: 32402 - DNA, 21 bp, Artificial sequence
  SiRNA target sequence
aaccaagattcaccactaatg

SEQ ID NO: 32403 - DNA, 21 bp, Artificial sequence
  SiRNA target sequence
accaagattcaccactaatgg

SEQ ID NO: 32404 - DNA, 21 bp, Artificial sequence
  SiRNA target sequence
ccaagattcaccactaatgga

SEQ ID NO: 32405 - DNA, 21 bp, Artificial sequence
  SiRNA target sequence
caagattcaccactaatggaa

SEQ ID NO: 32406 - DNA, 21 bp, Artificial sequence
  SiRNA target sequence
aagattcaccactaatggaag

SEQ ID NO: 32407 - DNA, 21 bp, Artificial sequence
  SiRNA target sequence
agattcaccactaatggaagg

SEQ ID NO: 32408 - DNA, 21 bp, Artificial sequence
  SiRNA target sequence
gattcaccactaatggaagga

SEQ ID NO: 32409 - DNA, 21 bp, Artificial sequence
  SiRNA target sequence
attcaccactaatggaaggaa

SEQ ID NO: 32410 - DNA, 21 bp, Artificial sequence
  SiRNA target sequence
ttcaccactaatggaaggaaa

SEQ ID NO: 32411 - DNA, 21 bp, Artificial sequence
  SiRNA target sequence
tcaccactaatggaaggaaaa

SEQ ID NO: 32412 - DNA, 21 bp, Artificial sequence
  SiRNA target sequence
caccactaatggaaggaaaaa

SEQ ID NO: 32413 - DNA, 21 bp, Artificial sequence
  SiRNA target sequence
accactaatggaaggaaaaac

SEQ ID NO: 32414 - DNA, 21 bp, Artificial sequence
  SiRNA target sequence
ccactaatggaaggaaaaaca

SEQ ID NO: 32415 - DNA, 21 bp, Artificial sequence
  SiRNA target sequence
cactaatggaaggaaaaacac

SEQ ID NO: 32416 - DNA, 21 bp, Artificial sequence
  SiRNA target sequence
actaatggaaggaaaaacacc

SEQ ID NO: 32417 - DNA, 21 bp, Artificial sequence
  SiRNA target sequence
ctaatggaaggaaaaacacca

SEQ ID NO: 32418 - DNA, 21 bp, Artificial sequence
  SiRNA target sequence
taatggaaggaaaaacaccaa

SEQ ID NO: 32419 - DNA, 21 bp, Artificial sequence
  SiRNA target sequence
aatggaaggaaaaacaccaat

SEQ ID NO: 32420 - DNA, 21 bp, Artificial sequence
  SiRNA target sequence
atggaaggaaaaacaccaatt

SEQ ID NO: 32421 - DNA, 21 bp, Artificial sequence
  SiRNA target sequence
tggaaggaaaaacaccaattt

SEQ ID NO: 32422 - DNA, 21 bp, Artificial sequence
  SiRNA target sequence
ggaaggaaaaacaccaatttt

SEQ ID NO: 32423 - DNA, 21 bp, Artificial sequence
  SiRNA target sequence
gaaggaaaaacaccaatttta

SEQ ID NO: 32424 - DNA, 21 bp, Artificial sequence
  SiRNA target sequence
aaggaaaaacaccaattttag

SEQ ID NO: 32425 - DNA, 21 bp, Artificial sequence
  SiRNA target sequence
aggaaaaacaccaattttagg

SEQ ID NO: 32426 - DNA, 21 bp, Artificial sequence
  SiRNA target sequence
ggaaaaacaccaattttagga

SEQ ID NO: 32427 - DNA, 21 bp, Artificial sequence
  SiRNA target sequence
gaaaaacaccaattttaggat

SEQ ID NO: 32428 - DNA, 21 bp, Artificial sequence
  SiRNA target sequence
aaaaacaccaattttaggatt

SEQ ID NO: 32429 - DNA, 21 bp, Artificial sequence
  SiRNA target sequence
aaaacaccaattttaggatta

SEQ ID NO: 32430 - DNA, 21 bp, Artificial sequence
  SiRNA target sequence
cccgtcaaaataacaacttat

SEQ ID NO: 32431 - DNA, 21 bp, Artificial sequence
  SiRNA target sequence
ccgtcaaaataacaacttata

SEQ ID NO: 32432 - DNA, 21 bp, Artificial sequence
  SiRNA target sequence
cgtcaaaataacaacttataa

SEQ ID NO: 32433 - DNA, 21 bp, Artificial sequence
  SiRNA target sequence
gtcaaaataacaacttataac

SEQ ID NO: 32434 - DNA, 21 bp, Artificial sequence
  SiRNA target sequence
tcaaaataacaacttataaca

SEQ ID NO: 32435 - DNA, 21 bp, Artificial sequence
  SiRNA target sequence
caaaataacaacttataacac

SEQ ID NO: 32436 - DNA, 21 bp, Artificial sequence
  SiRNA target sequence
aaaataacaacttataacacg

SEQ ID NO: 32437 - DNA, 21 bp, Artificial sequence
  SiRNA target sequence
aaataacaacttataacacga

SEQ ID NO: 32438 - DNA, 21 bp, Artificial sequence
  SiRNA target sequence
aataacaacttataacacgat

SEQ ID NO: 32439 - DNA, 21 bp, Artificial sequence
  SiRNA target sequence
ataacaacttataacacgatg

SEQ ID NO: 32440 - DNA, 21 bp, Artificial sequence
  SiRNA target sequence
taacaacttataacacgatgt

SEQ ID NO: 32441 - DNA, 21 bp, Artificial sequence
  SiRNA target sequence
aacaacttataacacgatgtt

SEQ ID NO: 32442 - DNA, 21 bp, Artificial sequence
  SiRNA target sequence
acaacttataacacgatgtta

SEQ ID NO: 32443 - DNA, 21 bp, Artificial sequence
  SiRNA target sequence
caacttataacacgatgttac

SEQ ID NO: 32444 - DNA, 21 bp, Artificial sequence
  SiRNA target sequence
aacttataacacgatgttacc

SEQ ID NO: 32445 - DNA, 21 bp, Artificial sequence
  SiRNA target sequence
acttataacacgatgttaccc

SEQ ID NO: 32446 - DNA, 21 bp, Artificial sequence
  SiRNA target sequence
cttataacacgatgttacccg

SEQ ID NO: 32447 - DNA, 21 bp, Artificial sequence
  SiRNA target sequence
ttataacacgatgttacccga

SEQ ID NO: 32448 - DNA, 21 bp, Artificial sequence
  SiRNA target sequence
tataacacgatgttacccgaa

SEQ ID NO: 32449 - DNA, 21 bp, Artificial sequence
  SiRNA target sequence
ataacacgatgttacccgaag

SEQ ID NO: 32450 - DNA, 21 bp, Artificial sequence
  SiRNA target sequence
taacacgatgttacccgaaga

SEQ ID NO: 32451 - DNA, 21 bp, Artificial sequence
  SiRNA target sequence
aacacgatgttacccgaagaa

SEQ ID NO: 32452 - DNA, 21 bp, Artificial sequence
  SiRNA target sequence
acacgatgttacccgaagaaa

SEQ ID NO: 32453 - DNA, 21 bp, Artificial sequence
  SiRNA target sequence
cacgatgttacccgaagaaac

SEQ ID NO: 32454 - DNA, 21 bp, Artificial sequence
  SiRNA target sequence
acgatgttacccgaagaaacc

SEQ ID NO: 32455 - DNA, 21 bp, Artificial sequence
  SiRNA target sequence
cgatgttacccgaagaaacca

SEQ ID NO: 32456 - DNA, 21 bp, Artificial sequence
  SiRNA target sequence
gatgttacccgaagaaaccat

SEQ ID NO: 32457 - DNA, 21 bp, Artificial sequence
  SiRNA target sequence
atgttacccgaagaaaccatt

SEQ ID NO: 32458 - DNA, 21 bp, Artificial sequence
  SiRNA target sequence
tgttacccgaagaaaccattt

SEQ ID NO: 32459 - DNA, 21 bp, Artificial sequence
  SiRNA target sequence
gttacccgaagaaaccatttt

SEQ ID NO: 32460 - DNA, 21 bp, Artificial sequence
  SiRNA target sequence
ttacccgaagaaaccatttta

SEQ ID NO: 32461 - DNA, 21 bp, Artificial sequence
  SiRNA target sequence
tacccgaagaaaccattttag

SEQ ID NO: 32462 - DNA, 21 bp, Artificial sequence
  SiRNA target sequence
acccgaagaaaccattttagt

SEQ ID NO: 32463 - DNA, 21 bp, Artificial sequence
  SiRNA target sequence
cccgaagaaaccattttagtg

SEQ ID NO: 32464 - DNA, 21 bp, Artificial sequence
  SiRNA target sequence
ccgaagaaaccattttagtgt

SEQ ID NO: 32465 - DNA, 21 bp, Artificial sequence
  SiRNA target sequence
cgaagaaaccattttagtgta

SEQ ID NO: 32466 - DNA, 21 bp, Artificial sequence
  SiRNA target sequence
gaagaaaccattttagtgtaa

SEQ ID NO: 32467 - DNA, 21 bp, Artificial sequence
  SiRNA target sequence
aagaaaccattttagtgtaac

SEQ ID NO: 32468 - DNA, 21 bp, Artificial sequence
  SiRNA target sequence
agaaaccattttagtgtaaca

SEQ ID NO: 32469 - DNA, 21 bp, Artificial sequence
  SiRNA target sequence
gaaaccattttagtgtaacat

SEQ ID NO: 32470 - DNA, 21 bp, Artificial sequence
  SiRNA target sequence
aaaccattttagtgtaacatt

SEQ ID NO: 32471 - DNA, 21 bp, Artificial sequence
  SiRNA target sequence
aaccattttagtgtaacattt

SEQ ID NO: 32472 - DNA, 21 bp, Artificial sequence
  SiRNA target sequence
accattttagtgtaacattta

SEQ ID NO: 32473 - DNA, 21 bp, Artificial sequence
  SiRNA target sequence
ccattttagtgtaacatttaa

SEQ ID NO: 32474 - DNA, 21 bp, Artificial sequence
  SiRNA target sequence
cattttagtgtaacatttaag

SEQ ID NO: 32475 - DNA, 21 bp, Artificial sequence
  SiRNA target sequence
attttagtgtaacatttaaga

SEQ ID NO: 32476 - DNA, 21 bp, Artificial sequence
  SiRNA target sequence
ttttagtgtaacatttaagat

SEQ ID NO: 32477 - DNA, 21 bp, Artificial sequence
  SiRNA target sequence
tttagtgtaacatttaagatt

SEQ ID NO: 32478 - DNA, 21 bp, Artificial sequence
  SiRNA target sequence
ttagtgtaacatttaagatta

SEQ ID NO: 32479 - DNA, 21 bp, Artificial sequence
  SiRNA target sequence
tagtgtaacatttaagattag

SEQ ID NO: 32480 - DNA, 21 bp, Artificial sequence
  SiRNA target sequence
agtgtaacatttaagattaga

SEQ ID NO: 32481 - DNA, 21 bp, Artificial sequence
  SiRNA target sequence
gtgtaacatttaagattagaa

SEQ ID NO: 32482 - DNA, 21 bp, Artificial sequence
  SiRNA target sequence
tgtaacatttaagattagaag

SEQ ID NO: 32483 - DNA, 21 bp, Artificial sequence
  SiRNA target sequence
gtaacatttaagattagaagt

SEQ ID NO: 32484 - DNA, 21 bp, Artificial sequence
  SiRNA target sequence
taacatttaagattagaagta

SEQ ID NO: 32485 - DNA, 21 bp, Artificial sequence
  SiRNA target sequence
aacatttaagattagaagtag

SEQ ID NO: 32486 - DNA, 21 bp, Artificial sequence
  SiRNA target sequence
acatttaagattagaagtagt

SEQ ID NO: 32487 - DNA, 21 bp, Artificial sequence
  SiRNA target sequence
catttaagattagaagtagtt

SEQ ID NO: 32488 - DNA, 21 bp, Artificial sequence
  SiRNA target sequence
atttaagattagaagtagttc

SEQ ID NO: 32489 - DNA, 21 bp, Artificial sequence
  SiRNA target sequence
tttaagattagaagtagttca

SEQ ID NO: 32490 - DNA, 21 bp, Artificial sequence
  SiRNA target sequence
ttaagattagaagtagttcat

SEQ ID NO: 32491 - DNA, 21 bp, Artificial sequence
  SiRNA target sequence
taagattagaagtagttcatc

SEQ ID NO: 32492 - DNA, 21 bp, Artificial sequence
  SiRNA target sequence
aagattagaagtagttcatct

SEQ ID NO: 32493 - DNA, 21 bp, Artificial sequence
  SiRNA target sequence
agattagaagtagttcatcta

SEQ ID NO: 32494 - DNA, 21 bp, Artificial sequence
  SiRNA target sequence
gattagaagtagttcatctaa

SEQ ID NO: 32495 - DNA, 21 bp, Artificial sequence
  SiRNA target sequence
attagaagtagttcatctaat

SEQ ID NO: 32496 - DNA, 21 bp, Artificial sequence
  SiRNA target sequence
ttagaagtagttcatctaata

SEQ ID NO: 32497 - DNA, 21 bp, Artificial sequence
  SiRNA target sequence
tagaagtagttcatctaatag

SEQ ID NO: 32498 - DNA, 21 bp, Artificial sequence
  SiRNA target sequence
agaagtagttcatctaataga

SEQ ID NO: 32499 - DNA, 21 bp, Artificial sequence
  SiRNA target sequence
gaagtagttcatctaatagag

SEQ ID NO: 32500 - DNA, 21 bp, Artificial sequence
  SiRNA target sequence
aagtagttcatctaatagaga

SEQ ID NO: 32501 - DNA, 21 bp, Artificial sequence
  SiRNA target sequence
agtagttcatctaatagagat

SEQ ID NO: 32502 - DNA, 21 bp, Artificial sequence
  SiRNA target sequence
gtagttcatctaatagagata

SEQ ID NO: 32503 - DNA, 21 bp, Artificial sequence
  SiRNA target sequence
tagttcatctaatagagatag

SEQ ID NO: 32504 - DNA, 21 bp, Artificial sequence
  SiRNA target sequence
agttcatctaatagagatagg

SEQ ID NO: 32505 - DNA, 21 bp, Artificial sequence
  SiRNA target sequence
gttcatctaatagagataggc

SEQ ID NO: 32506 - DNA, 21 bp, Artificial sequence
  SiRNA target sequence
ttcatctaatagagataggca

SEQ ID NO: 32507 - DNA, 21 bp, Artificial sequence
  SiRNA target sequence
tcatctaatagagataggcac

SEQ ID NO: 32508 - DNA, 21 bp, Artificial sequence
  SiRNA target sequence
catctaatagagataggcact

SEQ ID NO: 32509 - DNA, 21 bp, Artificial sequence
  SiRNA target sequence
atctaatagagataggcacta

SEQ ID NO: 32510 - DNA, 21 bp, Artificial sequence
  SiRNA target sequence
tctaatagagataggcactat

SEQ ID NO: 32511 - DNA, 21 bp, Artificial sequence
  SiRNA target sequence
ctaatagagataggcactatt

SEQ ID NO: 32512 - DNA, 21 bp, Artificial sequence
  SiRNA target sequence
taatagagataggcactatta

SEQ ID NO: 32513 - DNA, 21 bp, Artificial sequence
  SiRNA target sequence
aatagagataggcactattag

SEQ ID NO: 32514 - DNA, 21 bp, Artificial sequence
  SiRNA target sequence
atagagataggcactattaga

SEQ ID NO: 32515 - DNA, 21 bp, Artificial sequence
  SiRNA target sequence
tagagataggcactattagaa

SEQ ID NO: 32516 - DNA, 21 bp, Artificial sequence
  SiRNA target sequence
agagataggcactattagaag

SEQ ID NO: 32517 - DNA, 21 bp, Artificial sequence
  SiRNA target sequence
gagataggcactattagaagg

SEQ ID NO: 32518 - DNA, 21 bp, Artificial sequence
  SiRNA target sequence
agataggcactattagaagga

SEQ ID NO: 32519 - DNA, 21 bp, Artificial sequence
  SiRNA target sequence
gataggcactattagaaggag

SEQ ID NO: 32520 - DNA, 21 bp, Artificial sequence
  SiRNA target sequence
ataggcactattagaaggagg

SEQ ID NO: 32521 - DNA, 21 bp, Artificial sequence
  SiRNA target sequence
taggcactattagaaggaggc

SEQ ID NO: 32522 - DNA, 21 bp, Artificial sequence
  SiRNA target sequence
aggcactattagaaggaggcc

SEQ ID NO: 32523 - DNA, 21 bp, Artificial sequence
  SiRNA target sequence
ggcactattagaaggaggcct

SEQ ID NO: 32524 - DNA, 21 bp, Artificial sequence
  SiRNA target sequence
gcactattagaaggaggcctt

SEQ ID NO: 32525 - DNA, 21 bp, Artificial sequence
  SiRNA target sequence
cactattagaaggaggccttt

SEQ ID NO: 32526 - DNA, 21 bp, Artificial sequence
  SiRNA target sequence
actattagaaggaggcctttt

SEQ ID NO: 32527 - DNA, 21 bp, Artificial sequence
  SiRNA target sequence
ctattagaaggaggccttttc

SEQ ID NO: 32528 - DNA, 21 bp, Artificial sequence
  SiRNA target sequence
tattagaaggaggccttttct

SEQ ID NO: 32529 - DNA, 21 bp, Artificial sequence
  SiRNA target sequence
attagaaggaggccttttcta

SEQ ID NO: 32530 - DNA, 21 bp, Artificial sequence
  SiRNA target sequence
ttagaaggaggccttttctaa

SEQ ID NO: 32531 - DNA, 21 bp, Artificial sequence
  SiRNA target sequence
tagaaggaggccttttctaaa

SEQ ID NO: 32532 - DNA, 21 bp, Artificial sequence
  SiRNA target sequence
agaaggaggccttttctaaag

SEQ ID NO: 32533 - DNA, 21 bp, Artificial sequence
  SiRNA target sequence
gaaggaggccttttctaaagg

SEQ ID NO: 32534 - DNA, 21 bp, Artificial sequence
  SiRNA target sequence
aaggaggccttttctaaagga

SEQ ID NO: 32535 - DNA, 21 bp, Artificial sequence
  SiRNA target sequence
aggaggccttttctaaaggag

SEQ ID NO: 32536 - DNA, 21 bp, Artificial sequence
  SiRNA target sequence
ggaggccttttctaaaggagc

SEQ ID NO: 32537 - DNA, 21 bp, Artificial sequence
  SiRNA target sequence
gaggccttttctaaaggagcc

SEQ ID NO: 32538 - DNA, 21 bp, Artificial sequence
  SiRNA target sequence
aggccttttctaaaggagccg

SEQ ID NO: 32539 - DNA, 21 bp, Artificial sequence
  SiRNA target sequence
ggccttttctaaaggagccgt

SEQ ID NO: 32540 - DNA, 21 bp, Artificial sequence
  SiRNA target sequence
gccttttctaaaggagccgtt

SEQ ID NO: 32541 - DNA, 21 bp, Artificial sequence
  SiRNA target sequence
ccttttctaaaggagccgtta

SEQ ID NO: 32542 - DNA, 21 bp, Artificial sequence
  SiRNA target sequence
cttttctaaaggagccgttag

SEQ ID NO: 32543 - DNA, 21 bp, Artificial sequence
  SiRNA target sequence
ttttctaaaggagccgttagt

SEQ ID NO: 32544 - DNA, 21 bp, Artificial sequence
  SiRNA target sequence
tttctaaaggagccgttagtc

SEQ ID NO: 32545 - DNA, 21 bp, Artificial sequence
  SiRNA target sequence
ttctaaaggagccgttagtca

SEQ ID NO: 32546 - DNA, 21 bp, Artificial sequence
  SiRNA target sequence
tctaaaggagccgttagtcag

SEQ ID NO: 32547 - DNA, 21 bp, Artificial sequence
  SiRNA target sequence
ctaaaggagccgttagtcagc

SEQ ID NO: 32548 - DNA, 21 bp, Artificial sequence
  SiRNA target sequence
taaaggagccgttagtcagcc

SEQ ID NO: 32549 - DNA, 21 bp, Artificial sequence
  SiRNA target sequence
aaaggagccgttagtcagccc

SEQ ID NO: 32550 - DNA, 21 bp, Artificial sequence
  SiRNA target sequence
aaggagccgttagtcagccca

SEQ ID NO: 32551 - DNA, 21 bp, Artificial sequence
  SiRNA target sequence
aggagccgttagtcagcccag

SEQ ID NO: 32552 - DNA, 21 bp, Artificial sequence
  SiRNA target sequence
ggagccgttagtcagcccaga

SEQ ID NO: 32553 - DNA, 21 bp, Artificial sequence
  SiRNA target sequence
gagccgttagtcagcccagac

SEQ ID NO: 32554 - DNA, 21 bp, Artificial sequence
  SiRNA target sequence
agccgttagtcagcccagaca

SEQ ID NO: 32555 - DNA, 21 bp, Artificial sequence
  SiRNA target sequence
gccgttagtcagcccagacaa

SEQ ID NO: 32556 - DNA, 21 bp, Artificial sequence
  SiRNA target sequence
ccgttagtcagcccagacaag

SEQ ID NO: 32557 - DNA, 21 bp, Artificial sequence
  SiRNA target sequence
cgttagtcagcccagacaagc

SEQ ID NO: 32558 - DNA, 21 bp, Artificial sequence
  SiRNA target sequence
gttagtcagcccagacaagcg

SEQ ID NO: 32559 - DNA, 21 bp, Artificial sequence
  SiRNA target sequence
ttagtcagcccagacaagcgc

SEQ ID NO: 32560 - DNA, 21 bp, Artificial sequence
  SiRNA target sequence
tagtcagcccagacaagcgca

SEQ ID NO: 32561 - DNA, 21 bp, Artificial sequence
  SiRNA target sequence
agtcagcccagacaagcgcag

SEQ ID NO: 32562 - DNA, 21 bp, Artificial sequence
  SiRNA target sequence
gtcagcccagacaagcgcagt

SEQ ID NO: 32563 - DNA, 21 bp, Artificial sequence
  SiRNA target sequence
tcagcccagacaagcgcagta

SEQ ID NO: 32564 - DNA, 21 bp, Artificial sequence
  SiRNA target sequence
cagcccagacaagcgcagtac

SEQ ID NO: 32565 - DNA, 21 bp, Artificial sequence
  SiRNA target sequence
agcccagacaagcgcagtact

SEQ ID NO: 32566 - DNA, 21 bp, Artificial sequence
  SiRNA target sequence
gcccagacaagcgcagtactt

SEQ ID NO: 32567 - DNA, 21 bp, Artificial sequence
  SiRNA target sequence
cccagacaagcgcagtacttt

SEQ ID NO: 32568 - DNA, 21 bp, Artificial sequence
  SiRNA target sequence
ccagacaagcgcagtacttta

SEQ ID NO: 32569 - DNA, 21 bp, Artificial sequence
  SiRNA target sequence
cagacaagcgcagtactttag

SEQ ID NO: 32570 - DNA, 21 bp, Artificial sequence
  SiRNA target sequence
agacaagcgcagtactttaga

SEQ ID NO: 32571 - DNA, 21 bp, Artificial sequence
  SiRNA target sequence
gacaagcgcagtactttagaa

SEQ ID NO: 32572 - DNA, 21 bp, Artificial sequence
  SiRNA target sequence
acaagcgcagtactttagaag

SEQ ID NO: 32573 - DNA, 21 bp, Artificial sequence
  SiRNA target sequence
caagcgcagtactttagaaga

SEQ ID NO: 32574 - DNA, 21 bp, Artificial sequence
  SiRNA target sequence
aagcgcagtactttagaagag

SEQ ID NO: 32575 - DNA, 21 bp, Artificial sequence
  SiRNA target sequence
agcgcagtactttagaagaga

SEQ ID NO: 32576 - DNA, 21 bp, Artificial sequence
  SiRNA target sequence
gcgcagtactttagaagagag

SEQ ID NO: 32577 - DNA, 21 bp, Artificial sequence
  SiRNA target sequence
cgcagtactttagaagagaga

SEQ ID NO: 32578 - DNA, 21 bp, Artificial sequence
  SiRNA target sequence
gcagtactttagaagagagaa

SEQ ID NO: 32579 - DNA, 21 bp, Artificial sequence
  SiRNA target sequence
cagtactttagaagagagaag

SEQ ID NO: 32580 - DNA, 21 bp, Artificial sequence
  SiRNA target sequence
agtactttagaagagagaagt

SEQ ID NO: 32581 - DNA, 21 bp, Artificial sequence
  SiRNA target sequence
gtactttagaagagagaagtt

SEQ ID NO: 32582 - DNA, 21 bp, Artificial sequence
  SiRNA target sequence
tactttagaagagagaagttc

SEQ ID NO: 32583 - DNA, 21 bp, Artificial sequence
  SiRNA target sequence
actttagaagagagaagttcc

SEQ ID NO: 32584 - DNA, 21 bp, Artificial sequence
  SiRNA target sequence
ctttagaagagagaagttccc

SEQ ID NO: 32585 - DNA, 21 bp, Artificial sequence
  SiRNA target sequence
tttagaagagagaagttcccc

SEQ ID NO: 32586 - DNA, 21 bp, Artificial sequence
  SiRNA target sequence
ttagaagagagaagttccccg

SEQ ID NO: 32587 - DNA, 21 bp, Artificial sequence
  SiRNA target sequence
tagaagagagaagttccccga

SEQ ID NO: 32588 - DNA, 21 bp, Artificial sequence
  SiRNA target sequence
agaagagagaagttccccgat

SEQ ID NO: 32589 - DNA, 21 bp, Artificial sequence
  SiRNA target sequence
gaagagagaagttccccgata

SEQ ID NO: 32590 - DNA, 21 bp, Artificial sequence
  SiRNA target sequence
aagagagaagttccccgatag

SEQ ID NO: 32591 - DNA, 21 bp, Artificial sequence
  SiRNA target sequence
agagagaagttccccgatagc

SEQ ID NO: 32592 - DNA, 21 bp, Artificial sequence
  SiRNA target sequence
gagagaagttccccgatagcg

SEQ ID NO: 32593 - DNA, 21 bp, Artificial sequence
  SiRNA target sequence
agagaagttccccgatagcga

SEQ ID NO: 32594 - DNA, 21 bp, Artificial sequence
  SiRNA target sequence
gagaagttccccgatagcgac

SEQ ID NO: 32595 - DNA, 21 bp, Artificial sequence
  SiRNA target sequence
agaagttccccgatagcgacc

SEQ ID NO: 32596 - DNA, 21 bp, Artificial sequence
  SiRNA target sequence
gaagttccccgatagcgaccg

SEQ ID NO: 32597 - DNA, 21 bp, Artificial sequence
  SiRNA target sequence
aagttccccgatagcgaccga

SEQ ID NO: 32598 - DNA, 21 bp, Artificial sequence
  SiRNA target sequence
agttccccgatagcgaccgaa

SEQ ID NO: 32599 - DNA, 21 bp, Artificial sequence
  SiRNA target sequence
gttccccgatagcgaccgaaa

SEQ ID NO: 32600 - DNA, 21 bp, Artificial sequence
  SiRNA target sequence
ttccccgatagcgaccgaaaa

SEQ ID NO: 32601 - DNA, 21 bp, Artificial sequence
  SiRNA target sequence
tccccgatagcgaccgaaaag

SEQ ID NO: 32602 - DNA, 21 bp, Artificial sequence
  SiRNA target sequence
ccccgatagcgaccgaaaaga

SEQ ID NO: 32603 - DNA, 21 bp, Artificial sequence
  SiRNA target sequence
cccgatagcgaccgaaaagac

SEQ ID NO: 32604 - DNA, 21 bp, Artificial sequence
  SiRNA target sequence
ccgatagcgaccgaaaagacg

SEQ ID NO: 32605 - DNA, 21 bp, Artificial sequence
  SiRNA target sequence
cgatagcgaccgaaaagacgc

SEQ ID NO: 32606 - DNA, 21 bp, Artificial sequence
  SiRNA target sequence
gatagcgaccgaaaagacgcg

SEQ ID NO: 32607 - DNA, 21 bp, Artificial sequence
  SiRNA target sequence
atagcgaccgaaaagacgcgt

SEQ ID NO: 32608 - DNA, 21 bp, Artificial sequence
  SiRNA target sequence
tagcgaccgaaaagacgcgtt

SEQ ID NO: 32609 - DNA, 21 bp, Artificial sequence
  SiRNA target sequence
agcgaccgaaaagacgcgttt

SEQ ID NO: 32610 - DNA, 21 bp, Artificial sequence
  SiRNA target sequence
gcgaccgaaaagacgcgtttt

SEQ ID NO: 32611 - DNA, 21 bp, Artificial sequence
  SiRNA target sequence
cgaccgaaaagacgcgttttc

SEQ ID NO: 32612 - DNA, 21 bp, Artificial sequence
  SiRNA target sequence
gaccgaaaagacgcgttttcc

SEQ ID NO: 32613 - DNA, 21 bp, Artificial sequence
  SiRNA target sequence
accgaaaagacgcgttttccg

SEQ ID NO: 32614 - DNA, 21 bp, Artificial sequence
  SiRNA target sequence
ccgaaaagacgcgttttccgt

SEQ ID NO: 32615 - DNA, 21 bp, Artificial sequence
  SiRNA target sequence
cgaaaagacgcgttttccgtg

SEQ ID NO: 32616 - DNA, 21 bp, Artificial sequence
  SiRNA target sequence
gaaaagacgcgttttccgtgc

SEQ ID NO: 32617 - DNA, 21 bp, Artificial sequence
  SiRNA target sequence
aaaagacgcgttttccgtgct

SEQ ID NO: 32618 - DNA, 21 bp, Artificial sequence
  SiRNA target sequence
aaagacgcgttttccgtgcta

SEQ ID NO: 32619 - DNA, 21 bp, Artificial sequence
  SiRNA target sequence
aagacgcgttttccgtgctaa

SEQ ID NO: 32620 - DNA, 21 bp, Artificial sequence
  SiRNA target sequence
agacgcgttttccgtgctaac

SEQ ID NO: 32621 - DNA, 21 bp, Artificial sequence
  SiRNA target sequence
gacgcgttttccgtgctaact

SEQ ID NO: 32622 - DNA, 21 bp, Artificial sequence
  SiRNA target sequence
acgcgttttccgtgctaacta

SEQ ID NO: 32623 - DNA, 21 bp, Artificial sequence
  SiRNA target sequence
cgcgttttccgtgctaactaa

SEQ ID NO: 32624 - DNA, 21 bp, Artificial sequence
  SiRNA target sequence
gcgttttccgtgctaactaat

SEQ ID NO: 32625 - DNA, 21 bp, Artificial sequence
  SiRNA target sequence
cgttttccgtgctaactaatt

SEQ ID NO: 32626 - DNA, 21 bp, Artificial sequence
  SiRNA target sequence
gttttccgtgctaactaattt

SEQ ID NO: 32627 - DNA, 21 bp, Artificial sequence
  SiRNA target sequence
ttttccgtgctaactaattta

SEQ ID NO: 32628 - DNA, 21 bp, Artificial sequence
  SiRNA target sequence
tttccgtgctaactaatttaa

SEQ ID NO: 32629 - DNA, 21 bp, Artificial sequence
  SiRNA target sequence
ttccgtgctaactaatttaaa

SEQ ID NO: 32630 - DNA, 21 bp, Artificial sequence
  SiRNA target sequence
tccgtgctaactaatttaaat

SEQ ID NO: 32631 - DNA, 21 bp, Artificial sequence
  SiRNA target sequence
ccgtgctaactaatttaaatg

SEQ ID NO: 32632 - DNA, 21 bp, Artificial sequence
  SiRNA target sequence
cgtgctaactaatttaaatgt

SEQ ID NO: 32633 - DNA, 21 bp, Artificial sequence
  SiRNA target sequence
gtgctaactaatttaaatgtg

SEQ ID NO: 32634 - DNA, 21 bp, Artificial sequence
  SiRNA target sequence
tgctaactaatttaaatgtgg

SEQ ID NO: 32635 - DNA, 21 bp, Artificial sequence
  SiRNA target sequence
gctaactaatttaaatgtggg

SEQ ID NO: 32636 - DNA, 21 bp, Artificial sequence
  SiRNA target sequence
ctaactaatttaaatgtggga

SEQ ID NO: 32637 - DNA, 21 bp, Artificial sequence
  SiRNA target sequence
taactaatttaaatgtgggaa

SEQ ID NO: 32638 - DNA, 21 bp, Artificial sequence
  SiRNA target sequence
aactaatttaaatgtgggaac

SEQ ID NO: 32639 - DNA, 21 bp, Artificial sequence
  SiRNA target sequence
actaatttaaatgtgggaacg

SEQ ID NO: 32640 - DNA, 21 bp, Artificial sequence
  SiRNA target sequence
ctaatttaaatgtgggaacga

SEQ ID NO: 32641 - DNA, 21 bp, Artificial sequence
  SiRNA target sequence
taatttaaatgtgggaacgaa

SEQ ID NO: 32642 - DNA, 21 bp, Artificial sequence
  SiRNA target sequence
aatttaaatgtgggaacgaat

SEQ ID NO: 32643 - DNA, 21 bp, Artificial sequence
  SiRNA target sequence
atttaaatgtgggaacgaata

SEQ ID NO: 32644 - DNA, 21 bp, Artificial sequence
  SiRNA target sequence
tttaaatgtgggaacgaatat

SEQ ID NO: 32645 - DNA, 21 bp, Artificial sequence
  SiRNA target sequence
ttaaatgtgggaacgaatatt

SEQ ID NO: 32646 - DNA, 21 bp, Artificial sequence
  SiRNA target sequence
taaatgtgggaacgaatatta

SEQ ID NO: 32647 - DNA, 21 bp, Artificial sequence
  SiRNA target sequence
aaatgtgggaacgaatattat

SEQ ID NO: 32648 - DNA, 21 bp, Artificial sequence
  SiRNA target sequence
aatgtgggaacgaatattatt

SEQ ID NO: 32649 - DNA, 21 bp, Artificial sequence
  SiRNA target sequence
atgtgggaacgaatattatta

SEQ ID NO: 32650 - DNA, 21 bp, Artificial sequence
  SiRNA target sequence
tgtgggaacgaatattattat

SEQ ID NO: 32651 - DNA, 21 bp, Artificial sequence
  SiRNA target sequence
gtgggaacgaatattattatt

SEQ ID NO: 32652 - DNA, 21 bp, Artificial sequence
  SiRNA target sequence
tgggaacgaatattattattg

SEQ ID NO: 32653 - DNA, 21 bp, Artificial sequence
  SiRNA target sequence
gggaacgaatattattattga

SEQ ID NO: 32654 - DNA, 21 bp, Artificial sequence
  SiRNA target sequence
ggaacgaatattattattgaa

SEQ ID NO: 32655 - DNA, 21 bp, Artificial sequence
  SiRNA target sequence
gaacgaatattattattgaaa

SEQ ID NO: 32656 - DNA, 21 bp, Artificial sequence
  SiRNA target sequence
aacgaatattattattgaaat

SEQ ID NO: 32657 - DNA, 21 bp, Artificial sequence
  SiRNA target sequence
acgaatattattattgaaatt

SEQ ID NO: 32658 - DNA, 21 bp, Artificial sequence
  SiRNA target sequence
cgaatattattattgaaatta

SEQ ID NO: 32659 - DNA, 21 bp, Artificial sequence
  SiRNA target sequence
gaatattattattgaaattat

SEQ ID NO: 32660 - DNA, 21 bp, Artificial sequence
  SiRNA target sequence
aatattattattgaaattatg

SEQ ID NO: 32661 - DNA, 21 bp, Artificial sequence
  SiRNA target sequence
atattattattgaaattatgt

SEQ ID NO: 32662 - DNA, 21 bp, Artificial sequence
  SiRNA target sequence
tattattattgaaattatgtg

SEQ ID NO: 32663 - DNA, 21 bp, Artificial sequence
  SiRNA target sequence
attattattgaaattatgtga

SEQ ID NO: 32664 - DNA, 21 bp, Artificial sequence
  SiRNA target sequence
ttattattgaaattatgtgag

SEQ ID NO: 32665 - DNA, 21 bp, Artificial sequence
  SiRNA target sequence
tattattgaaattatgtgagc

SEQ ID NO: 32666 - DNA, 21 bp, Artificial sequence
  SiRNA target sequence
attattgaaattatgtgagcc

SEQ ID NO: 32667 - DNA, 21 bp, Artificial sequence
  SiRNA target sequence
ttattgaaattatgtgagcca

SEQ ID NO: 32668 - DNA, 21 bp, Artificial sequence
  SiRNA target sequence
tattgaaattatgtgagccac

SEQ ID NO: 32669 - DNA, 21 bp, Artificial sequence
  SiRNA target sequence
attgaaattatgtgagccacg

SEQ ID NO: 32670 - DNA, 21 bp, Artificial sequence
  SiRNA target sequence
ttgaaattatgtgagccacgt

SEQ ID NO: 32671 - DNA, 21 bp, Artificial sequence
  SiRNA target sequence
tgaaattatgtgagccacgta

SEQ ID NO: 32672 - DNA, 21 bp, Artificial sequence
  SiRNA target sequence
gaaattatgtgagccacgtag

SEQ ID NO: 32673 - DNA, 21 bp, Artificial sequence
  SiRNA target sequence
aaattatgtgagccacgtagc

SEQ ID NO: 32674 - DNA, 21 bp, Artificial sequence
  SiRNA target sequence
aattatgtgagccacgtagca

SEQ ID NO: 32675 - DNA, 21 bp, Artificial sequence
  SiRNA target sequence
attatgtgagccacgtagcaa

SEQ ID NO: 32676 - DNA, 21 bp, Artificial sequence
  SiRNA target sequence
ttatgtgagccacgtagcaat

SEQ ID NO: 32677 - DNA, 21 bp, Artificial sequence
  SiRNA target sequence
tatgtgagccacgtagcaatc

SEQ ID NO: 32678 - DNA, 21 bp, Artificial sequence
  SiRNA target sequence
atgtgagccacgtagcaatca

SEQ ID NO: 32679 - DNA, 21 bp, Artificial sequence
  SiRNA target sequence
tgtgagccacgtagcaatcaa

SEQ ID NO: 32680 - DNA, 21 bp, Artificial sequence
  SiRNA target sequence
gtgagccacgtagcaatcaag

SEQ ID NO: 32681 - DNA, 21 bp, Artificial sequence
  SiRNA target sequence
tgagccacgtagcaatcaagt

SEQ ID NO: 32682 - DNA, 21 bp, Artificial sequence
  SiRNA target sequence
gagccacgtagcaatcaagtc

SEQ ID NO: 32683 - DNA, 21 bp, Artificial sequence
  SiRNA target sequence
agccacgtagcaatcaagtca

SEQ ID NO: 32684 - DNA, 21 bp, Artificial sequence
  SiRNA target sequence
gccacgtagcaatcaagtcat

SEQ ID NO: 32685 - DNA, 21 bp, Artificial sequence
  SiRNA target sequence
ccacgtagcaatcaagtcatg

SEQ ID NO: 32686 - DNA, 21 bp, Artificial sequence
  SiRNA target sequence
cacgtagcaatcaagtcatgt

SEQ ID NO: 32687 - DNA, 21 bp, Artificial sequence
  SiRNA target sequence
acgtagcaatcaagtcatgtt

SEQ ID NO: 32688 - DNA, 21 bp, Artificial sequence
  SiRNA target sequence
cgtagcaatcaagtcatgttt

SEQ ID NO: 32689 - DNA, 21 bp, Artificial sequence
  SiRNA target sequence
gtagcaatcaagtcatgtttt

SEQ ID NO: 32690 - DNA, 21 bp, Artificial sequence
  SiRNA target sequence
tagcaatcaagtcatgttttt

SEQ ID NO: 32691 - DNA, 21 bp, Artificial sequence
  SiRNA target sequence
agcaatcaagtcatgtttttg

SEQ ID NO: 32692 - DNA, 21 bp, Artificial sequence
  SiRNA target sequence
gcaatcaagtcatgtttttgt

SEQ ID NO: 32693 - DNA, 21 bp, Artificial sequence
  SiRNA target sequence
caatcaagtcatgtttttgtc

SEQ ID NO: 32694 - DNA, 21 bp, Artificial sequence
  SiRNA target sequence
aatcaagtcatgtttttgtca

SEQ ID NO: 32695 - DNA, 21 bp, Artificial sequence
  SiRNA target sequence
atcaagtcatgtttttgtcac

SEQ ID NO: 32696 - DNA, 21 bp, Artificial sequence
  SiRNA target sequence
tcaagtcatgtttttgtcact

SEQ ID NO: 32697 - DNA, 21 bp, Artificial sequence
  SiRNA target sequence
caagtcatgtttttgtcacta

SEQ ID NO: 32698 - DNA, 21 bp, Artificial sequence
  SiRNA target sequence
aagtcatgtttttgtcactac

SEQ ID NO: 32699 - DNA, 21 bp, Artificial sequence
  SiRNA target sequence
agtcatgtttttgtcactacg

SEQ ID NO: 32700 - DNA, 21 bp, Artificial sequence
  SiRNA target sequence
gtcatgtttttgtcactacgt

SEQ ID NO: 32701 - DNA, 21 bp, Artificial sequence
  SiRNA target sequence
tcatgtttttgtcactacgtt

SEQ ID NO: 32702 - DNA, 21 bp, Artificial sequence
  SiRNA target sequence
catgtttttgtcactacgttt

SEQ ID NO: 32703 - DNA, 21 bp, Artificial sequence
  SiRNA target sequence
atgtttttgtcactacgttta

SEQ ID NO: 32704 - DNA, 21 bp, Artificial sequence
  SiRNA target sequence
tgtttttgtcactacgtttac

SEQ ID NO: 32705 - DNA, 21 bp, Artificial sequence
  SiRNA target sequence
gtttttgtcactacgtttact

SEQ ID NO: 32706 - DNA, 21 bp, Artificial sequence
  SiRNA target sequence
tttttgtcactacgtttactc

SEQ ID NO: 32707 - DNA, 21 bp, Artificial sequence
  SiRNA target sequence
ttttgtcactacgtttactca

SEQ ID NO: 32708 - DNA, 21 bp, Artificial sequence
  SiRNA target sequence
tttgtcactacgtttactcat

SEQ ID NO: 32709 - DNA, 21 bp, Artificial sequence
  SiRNA target sequence
ttgtcactacgtttactcatc

SEQ ID NO: 32710 - DNA, 21 bp, Artificial sequence
  SiRNA target sequence
tgtcactacgtttactcatct

SEQ ID NO: 32711 - DNA, 21 bp, Artificial sequence
  SiRNA target sequence
gtcactacgtttactcatcta

SEQ ID NO: 32712 - DNA, 21 bp, Artificial sequence
  SiRNA target sequence
tcactacgtttactcatctaa

SEQ ID NO: 32713 - DNA, 21 bp, Artificial sequence
  SiRNA target sequence
cactacgtttactcatctaat

SEQ ID NO: 32714 - DNA, 21 bp, Artificial sequence
  SiRNA target sequence
actacgtttactcatctaatg

SEQ ID NO: 32715 - DNA, 21 bp, Artificial sequence
  SiRNA target sequence
ctacgtttactcatctaatgt

SEQ ID NO: 32716 - DNA, 21 bp, Artificial sequence
  SiRNA target sequence
tacgtttactcatctaatgta

SEQ ID NO: 32717 - DNA, 21 bp, Artificial sequence
  SiRNA target sequence
acgtttactcatctaatgtag

SEQ ID NO: 32718 - DNA, 21 bp, Artificial sequence
  SiRNA target sequence
cgtttactcatctaatgtaga

SEQ ID NO: 32719 - DNA, 21 bp, Artificial sequence
  SiRNA target sequence
gtttactcatctaatgtagat

SEQ ID NO: 32720 - DNA, 21 bp, Artificial sequence
  SiRNA target sequence
tttactcatctaatgtagata

SEQ ID NO: 32721 - DNA, 21 bp, Artificial sequence
  SiRNA target sequence
ttactcatctaatgtagataa

SEQ ID NO: 32722 - DNA, 21 bp, Artificial sequence
  SiRNA target sequence
tactcatctaatgtagataat

SEQ ID NO: 32723 - DNA, 21 bp, Artificial sequence
  SiRNA target sequence
actcatctaatgtagataatt

SEQ ID NO: 32724 - DNA, 21 bp, Artificial sequence
  SiRNA target sequence
ctcatctaatgtagataattt

SEQ ID NO: 32725 - DNA, 21 bp, Artificial sequence
  SiRNA target sequence
tcatctaatgtagataatttt

SEQ ID NO: 32726 - DNA, 21 bp, Artificial sequence
  SiRNA target sequence
catctaatgtagataattttg

SEQ ID NO: 32727 - DNA, 21 bp, Artificial sequence
  SiRNA target sequence
atctaatgtagataattttgt

SEQ ID NO: 32728 - DNA, 21 bp, Artificial sequence
  SiRNA target sequence
tctaatgtagataattttgtt

SEQ ID NO: 32729 - DNA, 21 bp, Artificial sequence
  SiRNA target sequence
ctaatgtagataattttgttt

SEQ ID NO: 32730 - DNA, 21 bp, Artificial sequence
  SiRNA target sequence
taatgtagataattttgttta

SEQ ID NO: 32731 - DNA, 21 bp, Artificial sequence
  SiRNA target sequence
aatgtagataattttgtttaa

SEQ ID NO: 32732 - DNA, 21 bp, Artificial sequence
  SiRNA target sequence
atgtagataattttgtttaag

SEQ ID NO: 32733 - DNA, 21 bp, Artificial sequence
  SiRNA target sequence
tgtagataattttgtttaagt

SEQ ID NO: 32734 - DNA, 21 bp, Artificial sequence
  SiRNA target sequence
gtagataattttgtttaagta

SEQ ID NO: 32735 - DNA, 21 bp, Artificial sequence
  SiRNA target sequence
tagataattttgtttaagtac

SEQ ID NO: 32736 - DNA, 21 bp, Artificial sequence
  SiRNA target sequence
agataattttgtttaagtacc

SEQ ID NO: 32737 - DNA, 21 bp, Artificial sequence
  SiRNA target sequence
gataattttgtttaagtacct

SEQ ID NO: 32738 - DNA, 21 bp, Artificial sequence
  SiRNA target sequence
ataattttgtttaagtaccta

SEQ ID NO: 32739 - DNA, 21 bp, Artificial sequence
  SiRNA target sequence
taattttgtttaagtacctat

SEQ ID NO: 32740 - DNA, 21 bp, Artificial sequence
  SiRNA target sequence
aattttgtttaagtacctatt

SEQ ID NO: 32741 - DNA, 21 bp, Artificial sequence
  SiRNA target sequence
attttgtttaagtacctattt

SEQ ID NO: 32742 - DNA, 21 bp, Artificial sequence
  SiRNA target sequence
ttttgtttaagtacctattta

SEQ ID NO: 32743 - DNA, 21 bp, Artificial sequence
  SiRNA target sequence
tttgtttaagtacctatttag

SEQ ID NO: 32744 - DNA, 21 bp, Artificial sequence
  SiRNA target sequence
ttgtttaagtacctatttagg

SEQ ID NO: 32745 - DNA, 21 bp, Artificial sequence
  SiRNA target sequence
tgtttaagtacctatttaggt

SEQ ID NO: 32746 - DNA, 21 bp, Artificial sequence
  SiRNA target sequence
gtttaagtacctatttaggtg

SEQ ID NO: 32747 - DNA, 21 bp, Artificial sequence
  SiRNA target sequence
tttaagtacctatttaggtgt

SEQ ID NO: 32748 - DNA, 21 bp, Artificial sequence
  SiRNA target sequence
ttaagtacctatttaggtgtc

SEQ ID NO: 32749 - DNA, 21 bp, Artificial sequence
  SiRNA target sequence
taagtacctatttaggtgtca

SEQ ID NO: 32750 - DNA, 21 bp, Artificial sequence
  SiRNA target sequence
aagtacctatttaggtgtcat

SEQ ID NO: 32751 - DNA, 21 bp, Artificial sequence
  SiRNA target sequence
agtacctatttaggtgtcatc

SEQ ID NO: 32752 - DNA, 21 bp, Artificial sequence
  SiRNA target sequence
gtacctatttaggtgtcatcc

SEQ ID NO: 32753 - DNA, 21 bp, Artificial sequence
  SiRNA target sequence
tacctatttaggtgtcatccc

SEQ ID NO: 32754 - DNA, 21 bp, Artificial sequence
  SiRNA target sequence
acctatttaggtgtcatccca

SEQ ID NO: 32755 - DNA, 21 bp, Artificial sequence
  SiRNA target sequence
cctatttaggtgtcatcccac

SEQ ID NO: 32756 - DNA, 21 bp, Artificial sequence
  SiRNA target sequence
ctatttaggtgtcatcccacc

SEQ ID NO: 32757 - DNA, 21 bp, Artificial sequence
  SiRNA target sequence
tatttaggtgtcatcccacca

SEQ ID NO: 32758 - DNA, 21 bp, Artificial sequence
  SiRNA target sequence
atttaggtgtcatcccaccag

SEQ ID NO: 32759 - DNA, 21 bp, Artificial sequence
  SiRNA target sequence
tttaggtgtcatcccaccaga

SEQ ID NO: 32760 - DNA, 21 bp, Artificial sequence
  SiRNA target sequence
ttaggtgtcatcccaccagag

SEQ ID NO: 32761 - DNA, 21 bp, Artificial sequence
  SiRNA target sequence
taggtgtcatcccaccagaga

SEQ ID NO: 32762 - DNA, 21 bp, Artificial sequence
  SiRNA target sequence
aggtgtcatcccaccagagaa

SEQ ID NO: 32763 - DNA, 21 bp, Artificial sequence
  SiRNA target sequence
ggtgtcatcccaccagagaag

SEQ ID NO: 32764 - DNA, 21 bp, Artificial sequence
  SiRNA target sequence
gtgtcatcccaccagagaaga

SEQ ID NO: 32765 - DNA, 21 bp, Artificial sequence
  SiRNA target sequence
tgtcatcccaccagagaagaa

SEQ ID NO: 32766 - DNA, 21 bp, Artificial sequence
  SiRNA target sequence
gtcatcccaccagagaagaaa

SEQ ID NO: 32767 - DNA, 21 bp, Artificial sequence
  SiRNA target sequence
tcatcccaccagagaagaaat

SEQ ID NO: 32768 - DNA, 21 bp, Artificial sequence
  SiRNA target sequence
catcccaccagagaagaaata

SEQ ID NO: 32769 - DNA, 21 bp, Artificial sequence
  SiRNA target sequence
atcccaccagagaagaaataa

SEQ ID NO: 32770 - DNA, 21 bp, Artificial sequence
  SiRNA target sequence
tcccaccagagaagaaataat

SEQ ID NO: 32771 - DNA, 21 bp, Artificial sequence
  SiRNA target sequence
cccaccagagaagaaataata

SEQ ID NO: 32772 - DNA, 21 bp, Artificial sequence
  SiRNA target sequence
ccaccagagaagaaataatac

SEQ ID NO: 32773 - DNA, 21 bp, Artificial sequence
  SiRNA target sequence
caccagagaagaaataatacg

SEQ ID NO: 32774 - DNA, 21 bp, Artificial sequence
  SiRNA target sequence
accagagaagaaataatacgt

SEQ ID NO: 32775 - DNA, 21 bp, Artificial sequence
  SiRNA target sequence
ccagagaagaaataatacgta

SEQ ID NO: 32776 - DNA, 21 bp, Artificial sequence
  SiRNA target sequence
cagagaagaaataatacgtac

SEQ ID NO: 32777 - DNA, 21 bp, Artificial sequence
  SiRNA target sequence
agagaagaaataatacgtacc

SEQ ID NO: 32778 - DNA, 21 bp, Artificial sequence
  SiRNA target sequence
gagaagaaataatacgtaccg

SEQ ID NO: 32779 - DNA, 21 bp, Artificial sequence
  SiRNA target sequence
agaagaaataatacgtaccgg

SEQ ID NO: 32780 - DNA, 21 bp, Artificial sequence
  SiRNA target sequence
gaagaaataatacgtaccgga

SEQ ID NO: 32781 - DNA, 21 bp, Artificial sequence
  SiRNA target sequence
aagaaataatacgtaccggaa

SEQ ID NO: 32782 - DNA, 21 bp, Artificial sequence
  SiRNA target sequence
agaaataatacgtaccggaac

SEQ ID NO: 32783 - DNA, 21 bp, Artificial sequence
  SiRNA target sequence
gaaataatacgtaccggaacc

SEQ ID NO: 32784 - DNA, 21 bp, Artificial sequence
  SiRNA target sequence
aaataatacgtaccggaaccc

SEQ ID NO: 32785 - DNA, 21 bp, Artificial sequence
  SiRNA target sequence
aataatacgtaccggaaccca

SEQ ID NO: 32786 - DNA, 21 bp, Artificial sequence
  SiRNA target sequence
ataatacgtaccggaacccag

SEQ ID NO: 32787 - DNA, 21 bp, Artificial sequence
  SiRNA target sequence
taatacgtaccggaacccaga

SEQ ID NO: 32788 - DNA, 21 bp, Artificial sequence
  SiRNA target sequence
aatacgtaccggaacccagag

SEQ ID NO: 32789 - DNA, 21 bp, Artificial sequence
  SiRNA target sequence
atacgtaccggaacccagagt

SEQ ID NO: 32790 - DNA, 21 bp, Artificial sequence
  SiRNA target sequence
tacgtaccggaacccagagta

SEQ ID NO: 32791 - DNA, 21 bp, Artificial sequence
  SiRNA target sequence
acgtaccggaacccagagtac

SEQ ID NO: 32792 - DNA, 21 bp, Artificial sequence
  SiRNA target sequence
cgtaccggaacccagagtaca

SEQ ID NO: 32793 - DNA, 21 bp, Artificial sequence
  SiRNA target sequence
gtaccggaacccagagtacac

SEQ ID NO: 32794 - DNA, 21 bp, Artificial sequence
  SiRNA target sequence
taccggaacccagagtacacc

SEQ ID NO: 32795 - DNA, 21 bp, Artificial sequence
  SiRNA target sequence
accggaacccagagtacaccc

SEQ ID NO: 32796 - DNA, 21 bp, Artificial sequence
  SiRNA target sequence
ccggaacccagagtacacccc

SEQ ID NO: 32797 - DNA, 21 bp, Artificial sequence
  SiRNA target sequence
cggaacccagagtacacccct

SEQ ID NO: 32798 - DNA, 21 bp, Artificial sequence
  SiRNA target sequence
ggaacccagagtacacccctt

SEQ ID NO: 32799 - DNA, 21 bp, Artificial sequence
  SiRNA target sequence
gaacccagagtacacccctta

SEQ ID NO: 32800 - DNA, 21 bp, Artificial sequence
  SiRNA target sequence
aacccagagtacaccccttat

SEQ ID NO: 32801 - DNA, 21 bp, Artificial sequence
  SiRNA target sequence
acccagagtacaccccttatt

SEQ ID NO: 32802 - DNA, 21 bp, Artificial sequence
  SiRNA target sequence
cccagagtacaccccttattt

SEQ ID NO: 32803 - DNA, 21 bp, Artificial sequence
  SiRNA target sequence
ccagagtacaccccttatttt

SEQ ID NO: 32804 - DNA, 21 bp, Artificial sequence
  SiRNA target sequence
cagagtacaccccttatttta

SEQ ID NO: 32805 - DNA, 21 bp, Artificial sequence
  SiRNA target sequence
agagtacaccccttattttaa

SEQ ID NO: 32806 - DNA, 21 bp, Artificial sequence
  SiRNA target sequence
gagtacaccccttattttaag

SEQ ID NO: 32807 - DNA, 21 bp, Artificial sequence
  SiRNA target sequence
agtacaccccttattttaagc

SEQ ID NO: 32808 - DNA, 21 bp, Artificial sequence
  SiRNA target sequence
gtacaccccttattttaagcc

SEQ ID NO: 32809 - DNA, 21 bp, Artificial sequence
  SiRNA target sequence
tacaccccttattttaagcct

SEQ ID NO: 32810 - DNA, 21 bp, Artificial sequence
  SiRNA target sequence
acaccccttattttaagcctt

SEQ ID NO: 32811 - DNA, 21 bp, Artificial sequence
  SiRNA target sequence
caccccttattttaagcctta

SEQ ID NO: 32812 - DNA, 21 bp, Artificial sequence
  SiRNA target sequence
accccttattttaagccttac

SEQ ID NO: 32813 - DNA, 21 bp, Artificial sequence
  SiRNA target sequence
ccccttattttaagccttact

SEQ ID NO: 32814 - DNA, 21 bp, Artificial sequence
  SiRNA target sequence
cccttattttaagccttactg

SEQ ID NO: 32815 - DNA, 21 bp, Artificial sequence
  SiRNA target sequence
ccttattttaagccttactgg

SEQ ID NO: 32816 - DNA, 21 bp, Artificial sequence
  SiRNA target sequence
cttattttaagccttactggg

SEQ ID NO: 32817 - DNA, 21 bp, Artificial sequence
  SiRNA target sequence
ttattttaagccttactgggc

SEQ ID NO: 32818 - DNA, 21 bp, Artificial sequence
  SiRNA target sequence
tattttaagccttactgggct

SEQ ID NO: 32819 - DNA, 21 bp, Artificial sequence
  SiRNA target sequence
attttaagccttactgggctt

SEQ ID NO: 32820 - DNA, 21 bp, Artificial sequence
  SiRNA target sequence
ttttaagccttactgggcttc

SEQ ID NO: 32821 - DNA, 21 bp, Artificial sequence
  SiRNA target sequence
tttaagccttactgggcttct

SEQ ID NO: 32822 - DNA, 21 bp, Artificial sequence
  SiRNA target sequence
ttaagccttactgggcttctc

SEQ ID NO: 32823 - DNA, 21 bp, Artificial sequence
  SiRNA target sequence
taagccttactgggcttctct

SEQ ID NO: 32824 - DNA, 21 bp, Artificial sequence
  SiRNA target sequence
aagccttactgggcttctctg

SEQ ID NO: 32825 - DNA, 21 bp, Artificial sequence
  SiRNA target sequence
agccttactgggcttctctgt

SEQ ID NO: 32826 - DNA, 21 bp, Artificial sequence
  SiRNA target sequence
gccttactgggcttctctgtt

SEQ ID NO: 32827 - DNA, 21 bp, Artificial sequence
  SiRNA target sequence
ccttactgggcttctctgtta

SEQ ID NO: 32828 - DNA, 21 bp, Artificial sequence
  SiRNA target sequence
cttactgggcttctctgttag

SEQ ID NO: 32829 - DNA, 21 bp, Artificial sequence
  SiRNA target sequence
ttactgggcttctctgttagt

SEQ ID NO: 32830 - DNA, 21 bp, Artificial sequence
  SiRNA target sequence
tactgggcttctctgttagtt

SEQ ID NO: 32831 - DNA, 21 bp, Artificial sequence
  SiRNA target sequence
actgggcttctctgttagtta

SEQ ID NO: 32832 - DNA, 21 bp, Artificial sequence
  SiRNA target sequence
ctgggcttctctgttagttag

SEQ ID NO: 32833 - DNA, 21 bp, Artificial sequence
  SiRNA target sequence
tgggcttctctgttagttagt

SEQ ID NO: 32834 - DNA, 21 bp, Artificial sequence
  SiRNA target sequence
gggcttctctgttagttagta

SEQ ID NO: 32835 - DNA, 21 bp, Artificial sequence
  SiRNA target sequence
ggcttctctgttagttagtaa

SEQ ID NO: 32836 - DNA, 21 bp, Artificial sequence
  SiRNA target sequence
gcttctctgttagttagtaat

SEQ ID NO: 32837 - DNA, 21 bp, Artificial sequence
  SiRNA target sequence
cttctctgttagttagtaatc

SEQ ID NO: 32838 - DNA, 21 bp, Artificial sequence
  SiRNA target sequence
ttctctgttagttagtaatct

SEQ ID NO: 32839 - DNA, 21 bp, Artificial sequence
  SiRNA target sequence
tctctgttagttagtaatctg

SEQ ID NO: 32840 - DNA, 21 bp, Artificial sequence
  SiRNA target sequence
ctctgttagttagtaatctgg

SEQ ID NO: 32841 - DNA, 21 bp, Artificial sequence
  SiRNA target sequence
tctgttagttagtaatctggc

SEQ ID NO: 32842 - DNA, 21 bp, Artificial sequence
  SiRNA target sequence
ctgttagttagtaatctggcc

SEQ ID NO: 32843 - DNA, 21 bp, Artificial sequence
  SiRNA target sequence
tgttagttagtaatctggccc

SEQ ID NO: 32844 - DNA, 21 bp, Artificial sequence
  SiRNA target sequence
gttagttagtaatctggccca

SEQ ID NO: 32845 - DNA, 21 bp, Artificial sequence
  SiRNA target sequence
ttagttagtaatctggcccac

SEQ ID NO: 32846 - DNA, 21 bp, Artificial sequence
  SiRNA target sequence
tagttagtaatctggcccacg

SEQ ID NO: 32847 - DNA, 21 bp, Artificial sequence
  SiRNA target sequence
agttagtaatctggcccacgt

SEQ ID NO: 32848 - DNA, 21 bp, Artificial sequence
  SiRNA target sequence
gttagtaatctggcccacgtt

SEQ ID NO: 32849 - DNA, 21 bp, Artificial sequence
  SiRNA target sequence
ttagtaatctggcccacgttt

SEQ ID NO: 32850 - DNA, 21 bp, Artificial sequence
  SiRNA target sequence
tagtaatctggcccacgtttt

SEQ ID NO: 32851 - DNA, 21 bp, Artificial sequence
  SiRNA target sequence
agtaatctggcccacgttttg

SEQ ID NO: 32852 - DNA, 21 bp, Artificial sequence
  SiRNA target sequence
gtaatctggcccacgttttgc

SEQ ID NO: 32853 - DNA, 21 bp, Artificial sequence
  SiRNA target sequence
taatctggcccacgttttgcg

SEQ ID NO: 32854 - DNA, 21 bp, Artificial sequence
  SiRNA target sequence
aatctggcccacgttttgcgt

SEQ ID NO: 32855 - DNA, 21 bp, Artificial sequence
  SiRNA target sequence
atctggcccacgttttgcgtt

SEQ ID NO: 32856 - DNA, 21 bp, Artificial sequence
  SiRNA target sequence
tctggcccacgttttgcgttg

SEQ ID NO: 32857 - DNA, 21 bp, Artificial sequence
  SiRNA target sequence
ctggcccacgttttgcgttga

SEQ ID NO: 32858 - DNA, 21 bp, Artificial sequence
  SiRNA target sequence
tggcccacgttttgcgttgag

SEQ ID NO: 32859 - DNA, 21 bp, Artificial sequence
  SiRNA target sequence
ggcccacgttttgcgttgagt

SEQ ID NO: 32860 - DNA, 21 bp, Artificial sequence
  SiRNA target sequence
gcccacgttttgcgttgagtg

SEQ ID NO: 32861 - DNA, 21 bp, Artificial sequence
  SiRNA target sequence
cccacgttttgcgttgagtgg

SEQ ID NO: 32862 - DNA, 21 bp, Artificial sequence
  SiRNA target sequence
ccacgttttgcgttgagtggg

SEQ ID NO: 32863 - DNA, 21 bp, Artificial sequence
  SiRNA target sequence
cacgttttgcgttgagtgggg

SEQ ID NO: 32864 - DNA, 21 bp, Artificial sequence
  SiRNA target sequence
acgttttgcgttgagtggggt

SEQ ID NO: 32865 - DNA, 21 bp, Artificial sequence
  SiRNA target sequence
cgttttgcgttgagtggggtc

SEQ ID NO: 32866 - DNA, 21 bp, Artificial sequence
  SiRNA target sequence
gttttgcgttgagtggggtcc

SEQ ID NO: 32867 - DNA, 21 bp, Artificial sequence
  SiRNA target sequence
ttttgcgttgagtggggtccc

SEQ ID NO: 32868 - DNA, 21 bp, Artificial sequence
  SiRNA target sequence
tttgcgttgagtggggtccca

SEQ ID NO: 32869 - DNA, 21 bp, Artificial sequence
  SiRNA target sequence
ttgcgttgagtggggtcccaa

SEQ ID NO: 32870 - DNA, 21 bp, Artificial sequence
  SiRNA target sequence
tgcgttgagtggggtcccaac

SEQ ID NO: 32871 - DNA, 21 bp, Artificial sequence
  SiRNA target sequence
gcgttgagtggggtcccaaca

SEQ ID NO: 32872 - DNA, 21 bp, Artificial sequence
  SiRNA target sequence
cgttgagtggggtcccaacag

SEQ ID NO: 32873 - DNA, 21 bp, Artificial sequence
  SiRNA target sequence
gttgagtggggtcccaacagt

SEQ ID NO: 32874 - DNA, 21 bp, Artificial sequence
  SiRNA target sequence
ttgagtggggtcccaacagta

SEQ ID NO: 32875 - DNA, 21 bp, Artificial sequence
  SiRNA target sequence
tgagtggggtcccaacagtag

SEQ ID NO: 32876 - DNA, 21 bp, Artificial sequence
  SiRNA target sequence
gagtggggtcccaacagtagg

SEQ ID NO: 32877 - DNA, 21 bp, Artificial sequence
  SiRNA target sequence
agtggggtcccaacagtagga

SEQ ID NO: 32878 - DNA, 21 bp, Artificial sequence
  SiRNA target sequence
gtggggtcccaacagtaggaa

SEQ ID NO: 32879 - DNA, 21 bp, Artificial sequence
  SiRNA target sequence
tggggtcccaacagtaggaat

SEQ ID NO: 32880 - DNA, 21 bp, Artificial sequence
  SiRNA target sequence
ggggtcccaacagtaggaatt

SEQ ID NO: 32881 - DNA, 21 bp, Artificial sequence
  SiRNA target sequence
gggtcccaacagtaggaattc

SEQ ID NO: 32882 - DNA, 21 bp, Artificial sequence
  SiRNA target sequence
ggtcccaacagtaggaattcg

SEQ ID NO: 32883 - DNA, 21 bp, Artificial sequence
  SiRNA target sequence
gtcccaacagtaggaattcga

SEQ ID NO: 32884 - DNA, 21 bp, Artificial sequence
  SiRNA target sequence
tcccaacagtaggaattcgac

SEQ ID NO: 32885 - DNA, 21 bp, Artificial sequence
  SiRNA target sequence
cccaacagtaggaattcgacg

SEQ ID NO: 32886 - DNA, 21 bp, Artificial sequence
  SiRNA target sequence
ccaacagtaggaattcgacgg

SEQ ID NO: 32887 - DNA, 21 bp, Artificial sequence
  SiRNA target sequence
caacagtaggaattcgacgga

SEQ ID NO: 32888 - DNA, 21 bp, Artificial sequence
  SiRNA target sequence
aacagtaggaattcgacggac

SEQ ID NO: 32889 - DNA, 21 bp, Artificial sequence
  SiRNA target sequence
acagtaggaattcgacggaca

SEQ ID NO: 32890 - DNA, 21 bp, Artificial sequence
  SiRNA target sequence
cagtaggaattcgacggacaa

SEQ ID NO: 32891 - DNA, 21 bp, Artificial sequence
  SiRNA target sequence
agtaggaattcgacggacaag

SEQ ID NO: 32892 - DNA, 21 bp, Artificial sequence
  SiRNA target sequence
gtaggaattcgacggacaagt

SEQ ID NO: 32893 - DNA, 21 bp, Artificial sequence
  SiRNA target sequence
taggaattcgacggacaagta

SEQ ID NO: 32894 - DNA, 21 bp, Artificial sequence
  SiRNA target sequence
aggaattcgacggacaagtag

SEQ ID NO: 32895 - DNA, 21 bp, Artificial sequence
  SiRNA target sequence
ggaattcgacggacaagtagc

SEQ ID NO: 32896 - DNA, 21 bp, Artificial sequence
  SiRNA target sequence
gaattcgacggacaagtagca

SEQ ID NO: 32897 - DNA, 21 bp, Artificial sequence
  SiRNA target sequence
aattcgacggacaagtagcaa

SEQ ID NO: 32898 - DNA, 21 bp, Artificial sequence
  SiRNA target sequence
attcgacggacaagtagcaag

SEQ ID NO: 32899 - DNA, 21 bp, Artificial sequence
  SiRNA target sequence
ttcgacggacaagtagcaagc

SEQ ID NO: 32900 - DNA, 21 bp, Artificial sequence
  SiRNA target sequence
tcgacggacaagtagcaagcg

SEQ ID NO: 32901 - DNA, 21 bp, Artificial sequence
  SiRNA target sequence
cgacggacaagtagcaagcga

SEQ ID NO: 32902 - DNA, 21 bp, Artificial sequence
  SiRNA target sequence
gacggacaagtagcaagcgag

SEQ ID NO: 32903 - DNA, 21 bp, Artificial sequence
  SiRNA target sequence
acggacaagtagcaagcgagt

SEQ ID NO: 32904 - DNA, 21 bp, Artificial sequence
  SiRNA target sequence
cggacaagtagcaagcgagtc

SEQ ID NO: 32905 - DNA, 21 bp, Artificial sequence
  SiRNA target sequence
ggacaagtagcaagcgagtcg

SEQ ID NO: 32906 - DNA, 21 bp, Artificial sequence
  SiRNA target sequence
gacaagtagcaagcgagtcgg

SEQ ID NO: 32907 - DNA, 21 bp, Artificial sequence
  SiRNA target sequence
acaagtagcaagcgagtcggt

SEQ ID NO: 32908 - DNA, 21 bp, Artificial sequence
  SiRNA target sequence
caagtagcaagcgagtcggta

SEQ ID NO: 32909 - DNA, 21 bp, Artificial sequence
  SiRNA target sequence
aagtagcaagcgagtcggtac

SEQ ID NO: 32910 - DNA, 21 bp, Artificial sequence
  SiRNA target sequence
agtagcaagcgagtcggtacc

SEQ ID NO: 32911 - DNA, 21 bp, Artificial sequence
  SiRNA target sequence
gtagcaagcgagtcggtacca

SEQ ID NO: 32912 - DNA, 21 bp, Artificial sequence
  SiRNA target sequence
tagcaagcgagtcggtaccaa

SEQ ID NO: 32913 - DNA, 21 bp, Artificial sequence
  SiRNA target sequence
agcaagcgagtcggtaccaat

SEQ ID NO: 32914 - DNA, 21 bp, Artificial sequence
  SiRNA target sequence
gcaagcgagtcggtaccaatt

SEQ ID NO: 32915 - DNA, 21 bp, Artificial sequence
  SiRNA target sequence
caagcgagtcggtaccaattg

SEQ ID NO: 32916 - DNA, 21 bp, Artificial sequence
  SiRNA target sequence
aagcgagtcggtaccaattgg

SEQ ID NO: 32917 - DNA, 21 bp, Artificial sequence
  SiRNA target sequence
agcgagtcggtaccaattggt

SEQ ID NO: 32918 - DNA, 21 bp, Artificial sequence
  SiRNA target sequence
gcgagtcggtaccaattggtt

SEQ ID NO: 32919 - DNA, 21 bp, Artificial sequence
  SiRNA target sequence
cgagtcggtaccaattggttt

SEQ ID NO: 32920 - DNA, 21 bp, Artificial sequence
  SiRNA target sequence
gagtcggtaccaattggttta

SEQ ID NO: 32921 - DNA, 21 bp, Artificial sequence
  SiRNA target sequence
agtcggtaccaattggtttag

SEQ ID NO: 32922 - DNA, 21 bp, Artificial sequence
  SiRNA target sequence
gtcggtaccaattggtttagc

SEQ ID NO: 32923 - DNA, 21 bp, Artificial sequence
  SiRNA target sequence
tcggtaccaattggtttagcc

SEQ ID NO: 32924 - DNA, 21 bp, Artificial sequence
  SiRNA target sequence
cggtaccaattggtttagcct

SEQ ID NO: 32925 - DNA, 21 bp, Artificial sequence
  SiRNA target sequence
ggtaccaattggtttagcctt

SEQ ID NO: 32926 - DNA, 21 bp, Artificial sequence
  SiRNA target sequence
gtaccaattggtttagccttc

SEQ ID NO: 32927 - DNA, 21 bp, Artificial sequence
  SiRNA target sequence
taccaattggtttagccttcg

SEQ ID NO: 32928 - DNA, 21 bp, Artificial sequence
  SiRNA target sequence
accaattggtttagccttcga

SEQ ID NO: 32929 - DNA, 21 bp, Artificial sequence
  SiRNA target sequence
ccaattggtttagccttcgaa

SEQ ID NO: 32930 - DNA, 21 bp, Artificial sequence
  SiRNA target sequence
caattggtttagccttcgaaa

SEQ ID NO: 32931 - DNA, 21 bp, Artificial sequence
  SiRNA target sequence
aattggtttagccttcgaaat

SEQ ID NO: 32932 - DNA, 21 bp, Artificial sequence
  SiRNA target sequence
attggtttagccttcgaaatt

SEQ ID NO: 32933 - DNA, 21 bp, Artificial sequence
  SiRNA target sequence
ttggtttagccttcgaaatta

SEQ ID NO: 32934 - DNA, 21 bp, Artificial sequence
  SiRNA target sequence
tggtttagccttcgaaattac

SEQ ID NO: 32935 - DNA, 21 bp, Artificial sequence
  SiRNA target sequence
ggtttagccttcgaaattact

SEQ ID NO: 32936 - DNA, 21 bp, Artificial sequence
  SiRNA target sequence
gtttagccttcgaaattactc

SEQ ID NO: 32937 - DNA, 21 bp, Artificial sequence
  SiRNA target sequence
tttagccttcgaaattactct

SEQ ID NO: 32938 - DNA, 21 bp, Artificial sequence
  SiRNA target sequence
ttagccttcgaaattactctg

SEQ ID NO: 32939 - DNA, 21 bp, Artificial sequence
  SiRNA target sequence
tagccttcgaaattactctgg

SEQ ID NO: 32940 - DNA, 21 bp, Artificial sequence
  SiRNA target sequence
agccttcgaaattactctggg

SEQ ID NO: 32941 - DNA, 21 bp, Artificial sequence
  SiRNA target sequence
gccttcgaaattactctgggc

SEQ ID NO: 32942 - DNA, 21 bp, Artificial sequence
  SiRNA target sequence
ccttcgaaattactctgggca

SEQ ID NO: 32943 - DNA, 21 bp, Artificial sequence
  SiRNA target sequence
cttcgaaattactctgggcag

SEQ ID NO: 32944 - DNA, 21 bp, Artificial sequence
  SiRNA target sequence
ttcgaaattactctgggcagg

SEQ ID NO: 32945 - DNA, 21 bp, Artificial sequence
  SiRNA target sequence
tcgaaattactctgggcagga

SEQ ID NO: 32946 - DNA, 21 bp, Artificial sequence
  SiRNA target sequence
cgaaattactctgggcaggaa

SEQ ID NO: 32947 - DNA, 21 bp, Artificial sequence
  SiRNA target sequence
gaaattactctgggcaggaag

SEQ ID NO: 32948 - DNA, 21 bp, Artificial sequence
  SiRNA target sequence
aaattactctgggcaggaagt

SEQ ID NO: 32949 - DNA, 21 bp, Artificial sequence
  SiRNA target sequence
aattactctgggcaggaagtt

SEQ ID NO: 32950 - DNA, 21 bp, Artificial sequence
  SiRNA target sequence
attactctgggcaggaagtta

SEQ ID NO: 32951 - DNA, 21 bp, Artificial sequence
  SiRNA target sequence
ttactctgggcaggaagttac

SEQ ID NO: 32952 - DNA, 21 bp, Artificial sequence
  SiRNA target sequence
tactctgggcaggaagttact

SEQ ID NO: 32953 - DNA, 21 bp, Artificial sequence
  SiRNA target sequence
actctgggcaggaagttacta

SEQ ID NO: 32954 - DNA, 21 bp, Artificial sequence
  SiRNA target sequence
ctctgggcaggaagttactaa

SEQ ID NO: 32955 - DNA, 21 bp, Artificial sequence
  SiRNA target sequence
tctgggcaggaagttactaaa

SEQ ID NO: 32956 - DNA, 21 bp, Artificial sequence
  SiRNA target sequence
ctgggcaggaagttactaaac

SEQ ID NO: 32957 - DNA, 21 bp, Artificial sequence
  SiRNA target sequence
tgggcaggaagttactaaacg

SEQ ID NO: 32958 - DNA, 21 bp, Artificial sequence
  SiRNA target sequence
gggcaggaagttactaaacga

SEQ ID NO: 32959 - DNA, 21 bp, Artificial sequence
  SiRNA target sequence
ggcaggaagttactaaacgag

SEQ ID NO: 32960 - DNA, 21 bp, Artificial sequence
  SiRNA target sequence
gcaggaagttactaaacgaga

SEQ ID NO: 32961 - DNA, 21 bp, Artificial sequence
  SiRNA target sequence
caggaagttactaaacgagaa

SEQ ID NO: 32962 - DNA, 21 bp, Artificial sequence
  SiRNA target sequence
aggaagttactaaacgagaac

SEQ ID NO: 32963 - DNA, 21 bp, Artificial sequence
  SiRNA target sequence
ggaagttactaaacgagaact

SEQ ID NO: 32964 - DNA, 21 bp, Artificial sequence
  SiRNA target sequence
gaagttactaaacgagaactt

SEQ ID NO: 32965 - DNA, 21 bp, Artificial sequence
  SiRNA target sequence
aagttactaaacgagaacttt

SEQ ID NO: 32966 - DNA, 21 bp, Artificial sequence
  SiRNA target sequence
agttactaaacgagaactttc

SEQ ID NO: 32967 - DNA, 21 bp, Artificial sequence
  SiRNA target sequence
gttactaaacgagaactttct

SEQ ID NO: 32968 - DNA, 21 bp, Artificial sequence
  SiRNA target sequence
ttactaaacgagaactttctg

SEQ ID NO: 32969 - DNA, 21 bp, Artificial sequence
  SiRNA target sequence
tactaaacgagaactttctgc

SEQ ID NO: 32970 - DNA, 21 bp, Artificial sequence
  SiRNA target sequence
actaaacgagaactttctgct

SEQ ID NO: 32971 - DNA, 21 bp, Artificial sequence
  SiRNA target sequence
ctaaacgagaactttctgctt

SEQ ID NO: 32972 - DNA, 21 bp, Artificial sequence
  SiRNA target sequence
taaacgagaactttctgctta

SEQ ID NO: 32973 - DNA, 21 bp, Artificial sequence
  SiRNA target sequence
aaacgagaactttctgcttaa

SEQ ID NO: 32974 - DNA, 21 bp, Artificial sequence
  SiRNA target sequence
aacgagaactttctgcttaaa

SEQ ID NO: 32975 - DNA, 21 bp, Artificial sequence
  SiRNA target sequence
acgagaactttctgcttaaat

SEQ ID NO: 32976 - DNA, 21 bp, Artificial sequence
  SiRNA target sequence
cgagaactttctgcttaaatc

SEQ ID NO: 32977 - DNA, 21 bp, Artificial sequence
  SiRNA target sequence
gagaactttctgcttaaatcc

SEQ ID NO: 32978 - DNA, 21 bp, Artificial sequence
  SiRNA target sequence
agaactttctgcttaaatccc

SEQ ID NO: 32979 - DNA, 21 bp, Artificial sequence
  SiRNA target sequence
gaactttctgcttaaatccca

SEQ ID NO: 32980 - DNA, 21 bp, Artificial sequence
  SiRNA target sequence
aactttctgcttaaatcccaa

SEQ ID NO: 32981 - DNA, 21 bp, Artificial sequence
  SiRNA target sequence
actttctgcttaaatcccaac

SEQ ID NO: 32982 - DNA, 21 bp, Artificial sequence
  SiRNA target sequence
ctttctgcttaaatcccaacg

SEQ ID NO: 32983 - DNA, 21 bp, Artificial sequence
  SiRNA target sequence
tttctgcttaaatcccaacgc

SEQ ID NO: 32984 - DNA, 21 bp, Artificial sequence
  SiRNA target sequence
ttctgcttaaatcccaacgca

SEQ ID NO: 32985 - DNA, 21 bp, Artificial sequence
  SiRNA target sequence
tctgcttaaatcccaacgcac

SEQ ID NO: 32986 - DNA, 21 bp, Artificial sequence
  SiRNA target sequence
ctgcttaaatcccaacgcaca

SEQ ID NO: 32987 - DNA, 21 bp, Artificial sequence
  SiRNA target sequence
tgcttaaatcccaacgcacaa

SEQ ID NO: 32988 - DNA, 21 bp, Artificial sequence
  SiRNA target sequence
gcttaaatcccaacgcacaaa

SEQ ID NO: 32989 - DNA, 21 bp, Artificial sequence
  SiRNA target sequence
cttaaatcccaacgcacaaac

SEQ ID NO: 32990 - DNA, 21 bp, Artificial sequence
  SiRNA target sequence
ttaaatcccaacgcacaaaca

SEQ ID NO: 32991 - DNA, 21 bp, Artificial sequence
  SiRNA target sequence
taaatcccaacgcacaaacaa

SEQ ID NO: 32992 - DNA, 21 bp, Artificial sequence
  SiRNA target sequence
aaatcccaacgcacaaacaaa

SEQ ID NO: 32993 - DNA, 21 bp, Artificial sequence
  SiRNA target sequence
aatcccaacgcacaaacaaat

SEQ ID NO: 32994 - DNA, 21 bp, Artificial sequence
  SiRNA target sequence
atcccaacgcacaaacaaata

SEQ ID NO: 32995 - DNA, 21 bp, Artificial sequence
  SiRNA target sequence
tcccaacgcacaaacaaatag

SEQ ID NO: 32996 - DNA, 21 bp, Artificial sequence
  SiRNA target sequence
cccaacgcacaaacaaataga

SEQ ID NO: 32997 - DNA, 21 bp, Artificial sequence
  SiRNA target sequence
ccaacgcacaaacaaatagag

SEQ ID NO: 32998 - DNA, 21 bp, Artificial sequence
  SiRNA target sequence
caacgcacaaacaaatagagt

SEQ ID NO: 32999 - DNA, 21 bp, Artificial sequence
  SiRNA target sequence
aacgcacaaacaaatagagta

SEQ ID NO: 33000 - DNA, 21 bp, Artificial sequence
  SiRNA target sequence
acgcacaaacaaatagagtaa

SEQ ID NO: 33001 - DNA, 21 bp, Artificial sequence
  SiRNA target sequence
cgcacaaacaaatagagtaaa

SEQ ID NO: 33002 - DNA, 21 bp, Artificial sequence
  SiRNA target sequence
gcacaaacaaatagagtaaat

SEQ ID NO: 33003 - DNA, 21 bp, Artificial sequence
  SiRNA target sequence
cacaaacaaatagagtaaata

SEQ ID NO: 33004 - DNA, 21 bp, Artificial sequence
  SiRNA target sequence
acaaacaaatagagtaaataa

SEQ ID NO: 33005 - DNA, 21 bp, Artificial sequence
  SiRNA target sequence
caaacaaatagagtaaataaa

SEQ ID NO: 33006 - DNA, 21 bp, Artificial sequence
  SiRNA target sequence
aaacaaatagagtaaataaat

SEQ ID NO: 33007 - DNA, 21 bp, Artificial sequence
  SiRNA target sequence
aacaaatagagtaaataaata

SEQ ID NO: 33008 - DNA, 21 bp, Artificial sequence
  SiRNA target sequence
acaaatagagtaaataaataa

SEQ ID NO: 33009 - DNA, 21 bp, Artificial sequence
  SiRNA target sequence
caaatagagtaaataaataat

SEQ ID NO: 33010 - DNA, 21 bp, Artificial sequence
  SiRNA target sequence
aaatagagtaaataaataatt

SEQ ID NO: 33011 - DNA, 21 bp, Artificial sequence
  SiRNA target sequence
aatagagtaaataaataatta

SEQ ID NO: 33012 - DNA, 21 bp, Artificial sequence
  SiRNA target sequence
atagagtaaataaataattat

SEQ ID NO: 33013 - DNA, 21 bp, Artificial sequence
  SiRNA target sequence
tagagtaaataaataattata

SEQ ID NO: 33014 - DNA, 21 bp, Artificial sequence
  SiRNA target sequence
agagtaaataaataattataa

SEQ ID NO: 33015 - DNA, 21 bp, Artificial sequence
  SiRNA target sequence
gagtaaataaataattataat

SEQ ID NO: 33016 - DNA, 21 bp, Artificial sequence
  SiRNA target sequence
agtaaataaataattataatg

SEQ ID NO: 33017 - DNA, 21 bp, Artificial sequence
  SiRNA target sequence
gtaaataaataattataatga

SEQ ID NO: 33018 - DNA, 21 bp, Artificial sequence
  SiRNA target sequence
taaataaataattataatgaa

SEQ ID NO: 33019 - DNA, 21 bp, Artificial sequence
  SiRNA target sequence
aaataaataattataatgaat

SEQ ID NO: 33020 - DNA, 21 bp, Artificial sequence
  SiRNA target sequence
aataaataattataatgaatt

SEQ ID NO: 33021 - DNA, 21 bp, Artificial sequence
  SiRNA target sequence
ataaataattataatgaattt

SEQ ID NO: 33022 - DNA, 21 bp, Artificial sequence
  SiRNA target sequence
taaataattataatgaatttt

SEQ ID NO: 33023 - DNA, 21 bp, Artificial sequence
  SiRNA target sequence
aaataattataatgaatttta

SEQ ID NO: 33024 - DNA, 21 bp, Artificial sequence
  SiRNA target sequence
aataattataatgaattttac

SEQ ID NO: 33025 - DNA, 21 bp, Artificial sequence
  SiRNA target sequence
ataattataatgaattttaca

SEQ ID NO: 33026 - DNA, 21 bp, Artificial sequence
  SiRNA target sequence
taattataatgaattttacaa

SEQ ID NO: 33027 - DNA, 21 bp, Artificial sequence
  SiRNA target sequence
aattataatgaattttacaaa

SEQ ID NO: 33028 - DNA, 21 bp, Artificial sequence
  SiRNA target sequence
attataatgaattttacaaag

SEQ ID NO: 33029 - DNA, 21 bp, Artificial sequence
  SiRNA target sequence
ttataatgaattttacaaagc

SEQ ID NO: 33030 - DNA, 21 bp, Artificial sequence
  SiRNA target sequence
tataatgaattttacaaagca

SEQ ID NO: 33031 - DNA, 21 bp, Artificial sequence
  SiRNA target sequence
ataatgaattttacaaagcaa

SEQ ID NO: 33032 - DNA, 21 bp, Artificial sequence
  SiRNA target sequence
taatgaattttacaaagcaac

SEQ ID NO: 33033 - DNA, 21 bp, Artificial sequence
  SiRNA target sequence
aatgaattttacaaagcaacc

SEQ ID NO: 33034 - DNA, 21 bp, Artificial sequence
  SiRNA target sequence
atgaattttacaaagcaacca

SEQ ID NO: 33035 - DNA, 21 bp, Artificial sequence
  SiRNA target sequence
tgaattttacaaagcaaccag

SEQ ID NO: 33036 - DNA, 21 bp, Artificial sequence
  SiRNA target sequence
gaattttacaaagcaaccagc

SEQ ID NO: 33037 - DNA, 21 bp, Artificial sequence
  SiRNA target sequence
aattttacaaagcaaccagca

SEQ ID NO: 33038 - DNA, 21 bp, Artificial sequence
  SiRNA target sequence
attttacaaagcaaccagcaa

SEQ ID NO: 33039 - DNA, 21 bp, Artificial sequence
  SiRNA target sequence
ttttacaaagcaaccagcaag

SEQ ID NO: 33040 - DNA, 21 bp, Artificial sequence
  SiRNA target sequence
tttacaaagcaaccagcaagt

SEQ ID NO: 33041 - DNA, 21 bp, Artificial sequence
  SiRNA target sequence
ttacaaagcaaccagcaagtc

SEQ ID NO: 33042 - DNA, 21 bp, Artificial sequence
  SiRNA target sequence
tacaaagcaaccagcaagtct

SEQ ID NO: 33043 - DNA, 21 bp, Artificial sequence
  SiRNA target sequence
acaaagcaaccagcaagtctc

SEQ ID NO: 33044 - DNA, 21 bp, Artificial sequence
  SiRNA target sequence
caaagcaaccagcaagtctca

SEQ ID NO: 33045 - DNA, 21 bp, Artificial sequence
  SiRNA target sequence
aaagcaaccagcaagtctcaa

SEQ ID NO: 33046 - DNA, 21 bp, Artificial sequence
  SiRNA target sequence
aagcaaccagcaagtctcaaa

SEQ ID NO: 33047 - DNA, 21 bp, Artificial sequence
  SiRNA target sequence
agcaaccagcaagtctcaaat

SEQ ID NO: 33048 - DNA, 21 bp, Artificial sequence
  SiRNA target sequence
gcaaccagcaagtctcaaata

SEQ ID NO: 33049 - DNA, 21 bp, Artificial sequence
  SiRNA target sequence
caaccagcaagtctcaaatat

SEQ ID NO: 33050 - DNA, 21 bp, Artificial sequence
  SiRNA target sequence
aaccagcaagtctcaaatatt

SEQ ID NO: 33051 - DNA, 21 bp, Artificial sequence
  SiRNA target sequence
accagcaagtctcaaatattt

SEQ ID NO: 33052 - DNA, 21 bp, Artificial sequence
  SiRNA target sequence
ccagcaagtctcaaatattta

SEQ ID NO: 33053 - DNA, 21 bp, Artificial sequence
  SiRNA target sequence
cagcaagtctcaaatatttat

SEQ ID NO: 33054 - DNA, 21 bp, Artificial sequence
  SiRNA target sequence
agcaagtctcaaatatttatc

SEQ ID NO: 33055 - DNA, 21 bp, Artificial sequence
  SiRNA target sequence
gcaagtctcaaatatttatca

SEQ ID NO: 33056 - DNA, 21 bp, Artificial sequence
  SiRNA target sequence
caagtctcaaatatttatcaa

SEQ ID NO: 33057 - DNA, 21 bp, Artificial sequence
  SiRNA target sequence
aagtctcaaatatttatcaag

SEQ ID NO: 33058 - DNA, 21 bp, Artificial sequence
  SiRNA target sequence
agtctcaaatatttatcaagc

SEQ ID NO: 33059 - DNA, 21 bp, Artificial sequence
  SiRNA target sequence
gtctcaaatatttatcaagca

SEQ ID NO: 33060 - DNA, 21 bp, Artificial sequence
  SiRNA target sequence
tctcaaatatttatcaagcat

SEQ ID NO: 33061 - DNA, 21 bp, Artificial sequence
  SiRNA target sequence
ctcaaatatttatcaagcatg

SEQ ID NO: 33062 - DNA, 21 bp, Artificial sequence
  SiRNA target sequence
tcaaatatttatcaagcatga

SEQ ID NO: 33063 - DNA, 21 bp, Artificial sequence
  SiRNA target sequence
caaatatttatcaagcatgaa

SEQ ID NO: 33064 - DNA, 21 bp, Artificial sequence
  SiRNA target sequence
aaatatttatcaagcatgaaa

SEQ ID NO: 33065 - DNA, 21 bp, Artificial sequence
  SiRNA target sequence
aatatttatcaagcatgaaac

SEQ ID NO: 33066 - DNA, 21 bp, Artificial sequence
  SiRNA target sequence
atatttatcaagcatgaaact

SEQ ID NO: 33067 - DNA, 21 bp, Artificial sequence
  SiRNA target sequence
tatttatcaagcatgaaactt

SEQ ID NO: 33068 - DNA, 21 bp, Artificial sequence
  SiRNA target sequence
atttatcaagcatgaaactta

SEQ ID NO: 33069 - DNA, 21 bp, Artificial sequence
  SiRNA target sequence
tttatcaagcatgaaacttat

SEQ ID NO: 33070 - DNA, 21 bp, Artificial sequence
  SiRNA target sequence
ttatcaagcatgaaacttata

SEQ ID NO: 33071 - DNA, 21 bp, Artificial sequence
  SiRNA target sequence
tatcaagcatgaaacttataa

SEQ ID NO: 33072 - DNA, 21 bp, Artificial sequence
  SiRNA target sequence
atcaagcatgaaacttataac

SEQ ID NO: 33073 - DNA, 21 bp, Artificial sequence
  SiRNA target sequence
tcaagcatgaaacttataact

SEQ ID NO: 33074 - DNA, 21 bp, Artificial sequence
  SiRNA target sequence
caagcatgaaacttataactt

SEQ ID NO: 33075 - DNA, 21 bp, Artificial sequence
  SiRNA target sequence
aagcatgaaacttataacttc

SEQ ID NO: 33076 - DNA, 21 bp, Artificial sequence
  SiRNA target sequence
agcatgaaacttataacttca

SEQ ID NO: 33077 - DNA, 21 bp, Artificial sequence
  SiRNA target sequence
gcatgaaacttataacttcac

SEQ ID NO: 33078 - DNA, 21 bp, Artificial sequence
  SiRNA target sequence
catgaaacttataacttcaca

SEQ ID NO: 33079 - DNA, 21 bp, Artificial sequence
  SiRNA target sequence
atgaaacttataacttcacaa

SEQ ID NO: 33080 - DNA, 21 bp, Artificial sequence
  SiRNA target sequence
tgaaacttataacttcacaag

SEQ ID NO: 33081 - DNA, 21 bp, Artificial sequence
  SiRNA target sequence
gaaacttataacttcacaaga

SEQ ID NO: 33082 - DNA, 21 bp, Artificial sequence
  SiRNA target sequence
aaacttataacttcacaagac

SEQ ID NO: 33083 - DNA, 21 bp, Artificial sequence
  SiRNA target sequence
aacttataacttcacaagacc

SEQ ID NO: 33084 - DNA, 21 bp, Artificial sequence
  SiRNA target sequence
acttataacttcacaagacca

SEQ ID NO: 33085 - DNA, 21 bp, Artificial sequence
  SiRNA target sequence
cttataacttcacaagaccaa

SEQ ID NO: 33086 - DNA, 21 bp, Artificial sequence
  SiRNA target sequence
ttataacttcacaagaccaag

SEQ ID NO: 33087 - DNA, 21 bp, Artificial sequence
  SiRNA target sequence
tataacttcacaagaccaaga

SEQ ID NO: 33088 - DNA, 21 bp, Artificial sequence
  SiRNA target sequence
ataacttcacaagaccaagat

SEQ ID NO: 33089 - DNA, 21 bp, Artificial sequence
  SiRNA target sequence
taacttcacaagaccaagatt

SEQ ID NO: 33090 - DNA, 21 bp, Artificial sequence
  SiRNA target sequence
aacttcacaagaccaagattt

SEQ ID NO: 33091 - DNA, 21 bp, Artificial sequence
  SiRNA target sequence
acttcacaagaccaagatttc

SEQ ID NO: 33092 - DNA, 21 bp, Artificial sequence
  SiRNA target sequence
cttcacaagaccaagatttct

SEQ ID NO: 33093 - DNA, 21 bp, Artificial sequence
  SiRNA target sequence
ttcacaagaccaagatttctt

SEQ ID NO: 33094 - DNA, 21 bp, Artificial sequence
  SiRNA target sequence
tcacaagaccaagatttcttt

SEQ ID NO: 33095 - DNA, 21 bp, Artificial sequence
  SiRNA target sequence
cacaagaccaagatttcttta

SEQ ID NO: 33096 - DNA, 21 bp, Artificial sequence
  SiRNA target sequence
acaagaccaagatttctttaa

SEQ ID NO: 33097 - DNA, 21 bp, Artificial sequence
  SiRNA target sequence
caagaccaagatttctttaac

SEQ ID NO: 33098 - DNA, 21 bp, Artificial sequence
  SiRNA target sequence
aagaccaagatttctttaact

SEQ ID NO: 33099 - DNA, 21 bp, Artificial sequence
  SiRNA target sequence
agaccaagatttctttaactt

SEQ ID NO: 33100 - DNA, 21 bp, Artificial sequence
  SiRNA target sequence
gaccaagatttctttaacttt

SEQ ID NO: 33101 - DNA, 21 bp, Artificial sequence
  SiRNA target sequence
accaagatttctttaactttg

SEQ ID NO: 33102 - DNA, 21 bp, Artificial sequence
  SiRNA target sequence
ccaagatttctttaactttgg

SEQ ID NO: 33103 - DNA, 21 bp, Artificial sequence
  SiRNA target sequence
caagatttctttaactttgga

SEQ ID NO: 33104 - DNA, 21 bp, Artificial sequence
  SiRNA target sequence
aagatttctttaactttggag

SEQ ID NO: 33105 - DNA, 21 bp, Artificial sequence
  SiRNA target sequence
agatttctttaactttggaga

SEQ ID NO: 33106 - DNA, 21 bp, Artificial sequence
  SiRNA target sequence
gatttctttaactttggagaa

SEQ ID NO: 33107 - DNA, 21 bp, Artificial sequence
  SiRNA target sequence
atttctttaactttggagaag

SEQ ID NO: 33108 - DNA, 21 bp, Artificial sequence
  SiRNA target sequence
tttctttaactttggagaagt

SEQ ID NO: 33109 - DNA, 21 bp, Artificial sequence
  SiRNA target sequence
ttctttaactttggagaagtt

SEQ ID NO: 33110 - DNA, 21 bp, Artificial sequence
  SiRNA target sequence
tctttaactttggagaagttt

SEQ ID NO: 33111 - DNA, 21 bp, Artificial sequence
  SiRNA target sequence
ctttaactttggagaagtttc

SEQ ID NO: 33112 - DNA, 21 bp, Artificial sequence
  SiRNA target sequence
tttaactttggagaagtttca

SEQ ID NO: 33113 - DNA, 21 bp, Artificial sequence
  SiRNA target sequence
ttaactttggagaagtttcac

SEQ ID NO: 33114 - DNA, 21 bp, Artificial sequence
  SiRNA target sequence
taactttggagaagtttcacg

SEQ ID NO: 33115 - DNA, 21 bp, Artificial sequence
  SiRNA target sequence
aactttggagaagtttcacga

SEQ ID NO: 33116 - DNA, 21 bp, Artificial sequence
  SiRNA target sequence
actttggagaagtttcacgag

SEQ ID NO: 33117 - DNA, 21 bp, Artificial sequence
  SiRNA target sequence
ctttggagaagtttcacgaga

SEQ ID NO: 33118 - DNA, 21 bp, Artificial sequence
  SiRNA target sequence
tttggagaagtttcacgagaa

SEQ ID NO: 33119 - DNA, 21 bp, Artificial sequence
  SiRNA target sequence
ttggagaagtttcacgagaat

SEQ ID NO: 33120 - DNA, 21 bp, Artificial sequence
  SiRNA target sequence
tggagaagtttcacgagaatt

SEQ ID NO: 33121 - DNA, 21 bp, Artificial sequence
  SiRNA target sequence
ggagaagtttcacgagaattt

SEQ ID NO: 33122 - DNA, 21 bp, Artificial sequence
  SiRNA target sequence
gagaagtttcacgagaattta

SEQ ID NO: 33123 - DNA, 21 bp, Artificial sequence
  SiRNA target sequence
agaagtttcacgagaatttat

SEQ ID NO: 33124 - DNA, 21 bp, Artificial sequence
  SiRNA target sequence
gaagtttcacgagaatttata

SEQ ID NO: 33125 - DNA, 21 bp, Artificial sequence
  SiRNA target sequence
aagtttcacgagaatttatat

SEQ ID NO: 33126 - DNA, 21 bp, Artificial sequence
  SiRNA target sequence
agtttcacgagaatttatatt

SEQ ID NO: 33127 - DNA, 21 bp, Artificial sequence
  SiRNA target sequence
gtttcacgagaatttatattg

SEQ ID NO: 33128 - DNA, 21 bp, Artificial sequence
  SiRNA target sequence
tttcacgagaatttatattgg

SEQ ID NO: 33129 - DNA, 21 bp, Artificial sequence
  SiRNA target sequence
ttcacgagaatttatattgga

SEQ ID NO: 33130 - DNA, 21 bp, Artificial sequence
  SiRNA target sequence
tcacgagaatttatattggaa

SEQ ID NO: 33131 - DNA, 21 bp, Artificial sequence
  SiRNA target sequence
cacgagaatttatattggaac

SEQ ID NO: 33132 - DNA, 21 bp, Artificial sequence
  SiRNA target sequence
acgagaatttatattggaaca

SEQ ID NO: 33133 - DNA, 21 bp, Artificial sequence
  SiRNA target sequence
cgagaatttatattggaacag

SEQ ID NO: 33134 - DNA, 21 bp, Artificial sequence
  SiRNA target sequence
gagaatttatattggaacagg

SEQ ID NO: 33135 - DNA, 21 bp, Artificial sequence
  SiRNA target sequence
agaatttatattggaacaggc

SEQ ID NO: 33136 - DNA, 21 bp, Artificial sequence
  SiRNA target sequence
gaatttatattggaacaggca

SEQ ID NO: 33137 - DNA, 21 bp, Artificial sequence
  SiRNA target sequence
aatttatattggaacaggcat

SEQ ID NO: 33138 - DNA, 21 bp, Artificial sequence
  SiRNA target sequence
atttatattggaacaggcata

SEQ ID NO: 33139 - DNA, 21 bp, Artificial sequence
  SiRNA target sequence
tttatattggaacaggcatac

SEQ ID NO: 33140 - DNA, 21 bp, Artificial sequence
  SiRNA target sequence
ttatattggaacaggcatacg

SEQ ID NO: 33141 - DNA, 21 bp, Artificial sequence
  SiRNA target sequence
tatattggaacaggcatacgt

SEQ ID NO: 33142 - DNA, 21 bp, Artificial sequence
  SiRNA target sequence
atattggaacaggcatacgtc

SEQ ID NO: 33143 - DNA, 21 bp, Artificial sequence
  SiRNA target sequence
tattggaacaggcatacgtca

SEQ ID NO: 33144 - DNA, 21 bp, Artificial sequence
  SiRNA target sequence
attggaacaggcatacgtcaa

SEQ ID NO: 33145 - DNA, 21 bp, Artificial sequence
  SiRNA target sequence
ttggaacaggcatacgtcaat

SEQ ID NO: 33146 - DNA, 21 bp, Artificial sequence
  SiRNA target sequence
tggaacaggcatacgtcaatg

SEQ ID NO: 33147 - DNA, 21 bp, Artificial sequence
  SiRNA target sequence
ggaacaggcatacgtcaatgg

SEQ ID NO: 33148 - DNA, 21 bp, Artificial sequence
  SiRNA target sequence
gaacaggcatacgtcaatgga

SEQ ID NO: 33149 - DNA, 21 bp, Artificial sequence
  SiRNA target sequence
aacaggcatacgtcaatggat

SEQ ID NO: 33150 - DNA, 21 bp, Artificial sequence
  SiRNA target sequence
acaggcatacgtcaatggata

SEQ ID NO: 33151 - DNA, 21 bp, Artificial sequence
  SiRNA target sequence
caggcatacgtcaatggatac

SEQ ID NO: 33152 - DNA, 21 bp, Artificial sequence
  SiRNA target sequence
aggcatacgtcaatggatacg

SEQ ID NO: 33153 - DNA, 21 bp, Artificial sequence
  SiRNA target sequence
ggcatacgtcaatggatacga

SEQ ID NO: 33154 - DNA, 21 bp, Artificial sequence
  SiRNA target sequence
gcatacgtcaatggatacgat

SEQ ID NO: 33155 - DNA, 21 bp, Artificial sequence
  SiRNA target sequence
catacgtcaatggatacgatt

SEQ ID NO: 33156 - DNA, 21 bp, Artificial sequence
  SiRNA target sequence
atacgtcaatggatacgattt

SEQ ID NO: 33157 - DNA, 21 bp, Artificial sequence
  SiRNA target sequence
tacgtcaatggatacgatttc

SEQ ID NO: 33158 - DNA, 21 bp, Artificial sequence
  SiRNA target sequence
acgtcaatggatacgatttcc

SEQ ID NO: 33159 - DNA, 21 bp, Artificial sequence
  SiRNA target sequence
cgtcaatggatacgatttcca

SEQ ID NO: 33160 - DNA, 21 bp, Artificial sequence
  SiRNA target sequence
gtcaatggatacgatttccac

SEQ ID NO: 33161 - DNA, 21 bp, Artificial sequence
  SiRNA target sequence
tcaatggatacgatttccaca

SEQ ID NO: 33162 - DNA, 21 bp, Artificial sequence
  SiRNA target sequence
caatggatacgatttccacat

SEQ ID NO: 33163 - DNA, 21 bp, Artificial sequence
  SiRNA target sequence
aatggatacgatttccacatg

SEQ ID NO: 33164 - DNA, 21 bp, Artificial sequence
  SiRNA target sequence
atggatacgatttccacatgc

SEQ ID NO: 33165 - DNA, 21 bp, Artificial sequence
  SiRNA target sequence
tggatacgatttccacatgct

SEQ ID NO: 33166 - DNA, 21 bp, Artificial sequence
  SiRNA target sequence
ggatacgatttccacatgcta

SEQ ID NO: 33167 - DNA, 21 bp, Artificial sequence
  SiRNA target sequence
gatacgatttccacatgctac

SEQ ID NO: 33168 - DNA, 21 bp, Artificial sequence
  SiRNA target sequence
atacgatttccacatgctaca

SEQ ID NO: 33169 - DNA, 21 bp, Artificial sequence
  SiRNA target sequence
tacgatttccacatgctacat

SEQ ID NO: 33170 - DNA, 21 bp, Artificial sequence
  SiRNA target sequence
acgatttccacatgctacatc

SEQ ID NO: 33171 - DNA, 21 bp, Artificial sequence
  SiRNA target sequence
cgatttccacatgctacatca

SEQ ID NO: 33172 - DNA, 21 bp, Artificial sequence
  SiRNA target sequence
gatttccacatgctacatcaa

SEQ ID NO: 33173 - DNA, 21 bp, Artificial sequence
  SiRNA target sequence
atttccacatgctacatcaag

SEQ ID NO: 33174 - DNA, 21 bp, Artificial sequence
  SiRNA target sequence
tttccacatgctacatcaaga

SEQ ID NO: 33175 - DNA, 21 bp, Artificial sequence
  SiRNA target sequence
ttccacatgctacatcaagac

SEQ ID NO: 33176 - DNA, 21 bp, Artificial sequence
  SiRNA target sequence
tccacatgctacatcaagaca

SEQ ID NO: 33177 - DNA, 21 bp, Artificial sequence
  SiRNA target sequence
ccacatgctacatcaagacat

SEQ ID NO: 33178 - DNA, 21 bp, Artificial sequence
  SiRNA target sequence
cacatgctacatcaagacatg

SEQ ID NO: 33179 - DNA, 21 bp, Artificial sequence
  SiRNA target sequence
acatgctacatcaagacatga

SEQ ID NO: 33180 - DNA, 21 bp, Artificial sequence
  SiRNA target sequence
catgctacatcaagacatgaa

SEQ ID NO: 33181 - DNA, 21 bp, Artificial sequence
  SiRNA target sequence
atgctacatcaagacatgaat

SEQ ID NO: 33182 - DNA, 21 bp, Artificial sequence
  SiRNA target sequence
tgctacatcaagacatgaatt

SEQ ID NO: 33183 - DNA, 21 bp, Artificial sequence
  SiRNA target sequence
gctacatcaagacatgaattg

SEQ ID NO: 33184 - DNA, 21 bp, Artificial sequence
  SiRNA target sequence
ctacatcaagacatgaattgt

SEQ ID NO: 33185 - DNA, 21 bp, Artificial sequence
  SiRNA target sequence
tacatcaagacatgaattgta

SEQ ID NO: 33186 - DNA, 21 bp, Artificial sequence
  SiRNA target sequence
acatcaagacatgaattgtat

SEQ ID NO: 33187 - DNA, 21 bp, Artificial sequence
  SiRNA target sequence
catcaagacatgaattgtata

SEQ ID NO: 33188 - DNA, 21 bp, Artificial sequence
  SiRNA target sequence
atcaagacatgaattgtatag

SEQ ID NO: 33189 - DNA, 21 bp, Artificial sequence
  SiRNA target sequence
tcaagacatgaattgtatagg

SEQ ID NO: 33190 - DNA, 21 bp, Artificial sequence
  SiRNA target sequence
caagacatgaattgtatagga

SEQ ID NO: 33191 - DNA, 21 bp, Artificial sequence
  SiRNA target sequence
aagacatgaattgtataggat

SEQ ID NO: 33192 - DNA, 21 bp, Artificial sequence
  SiRNA target sequence
agacatgaattgtataggatt

SEQ ID NO: 33193 - DNA, 21 bp, Artificial sequence
  SiRNA target sequence
gacatgaattgtataggattc

SEQ ID NO: 33194 - DNA, 21 bp, Artificial sequence
  SiRNA target sequence
acatgaattgtataggattcg

SEQ ID NO: 33195 - DNA, 21 bp, Artificial sequence
  SiRNA target sequence
catgaattgtataggattcgt

SEQ ID NO: 33196 - DNA, 21 bp, Artificial sequence
  SiRNA target sequence
atgaattgtataggattcgta

SEQ ID NO: 33197 - DNA, 21 bp, Artificial sequence
  SiRNA target sequence
tgaattgtataggattcgtac

SEQ ID NO: 33198 - DNA, 21 bp, Artificial sequence
  SiRNA target sequence
gaattgtataggattcgtact

SEQ ID NO: 33199 - DNA, 21 bp, Artificial sequence
  SiRNA target sequence
aattgtataggattcgtacta

SEQ ID NO: 33200 - DNA, 21 bp, Artificial sequence
  SiRNA target sequence
attgtataggattcgtactat

SEQ ID NO: 33201 - DNA, 21 bp, Artificial sequence
  SiRNA target sequence
ttgtataggattcgtactatc

SEQ ID NO: 33202 - DNA, 21 bp, Artificial sequence
  SiRNA target sequence
tgtataggattcgtactatca

SEQ ID NO: 33203 - DNA, 21 bp, Artificial sequence
  SiRNA target sequence
gtataggattcgtactatcaa

SEQ ID NO: 33204 - DNA, 21 bp, Artificial sequence
  SiRNA target sequence
tataggattcgtactatcaat

SEQ ID NO: 33205 - DNA, 21 bp, Artificial sequence
  SiRNA target sequence
ataggattcgtactatcaatt

SEQ ID NO: 33206 - DNA, 21 bp, Artificial sequence
  SiRNA target sequence
taggattcgtactatcaattt

SEQ ID NO: 33207 - DNA, 21 bp, Artificial sequence
  SiRNA target sequence
aggattcgtactatcaatttt

SEQ ID NO: 33208 - DNA, 21 bp, Artificial sequence
  SiRNA target sequence
ggattcgtactatcaattttt

SEQ ID NO: 33209 - DNA, 21 bp, Artificial sequence
  SiRNA target sequence
gattcgtactatcaatttttg

SEQ ID NO: 33210 - DNA, 21 bp, Artificial sequence
  SiRNA target sequence
attcgtactatcaatttttga

SEQ ID NO: 33211 - DNA, 21 bp, Artificial sequence
  SiRNA target sequence
ttcgtactatcaatttttgat

SEQ ID NO: 33212 - DNA, 21 bp, Artificial sequence
  SiRNA target sequence
tcgtactatcaatttttgatg

SEQ ID NO: 33213 - DNA, 21 bp, Artificial sequence
  SiRNA target sequence
cgtactatcaatttttgatga

SEQ ID NO: 33214 - DNA, 21 bp, Artificial sequence
  SiRNA target sequence
gtactatcaatttttgatgaa

SEQ ID NO: 33215 - DNA, 21 bp, Artificial sequence
  SiRNA target sequence
tactatcaatttttgatgaag

SEQ ID NO: 33216 - DNA, 21 bp, Artificial sequence
  SiRNA target sequence
actatcaatttttgatgaaga

SEQ ID NO: 33217 - DNA, 21 bp, Artificial sequence
  SiRNA target sequence
ctatcaatttttgatgaagat

SEQ ID NO: 33218 - DNA, 21 bp, Artificial sequence
  SiRNA target sequence
tatcaatttttgatgaagatg

SEQ ID NO: 33219 - DNA, 21 bp, Artificial sequence
  SiRNA target sequence
atcaatttttgatgaagatgc

SEQ ID NO: 33220 - DNA, 21 bp, Artificial sequence
  SiRNA target sequence
tcaatttttgatgaagatgct

SEQ ID NO: 33221 - DNA, 21 bp, Artificial sequence
  SiRNA target sequence
caatttttgatgaagatgcta

SEQ ID NO: 33222 - DNA, 21 bp, Artificial sequence
  SiRNA target sequence
aatttttgatgaagatgctag

SEQ ID NO: 33223 - DNA, 21 bp, Artificial sequence
  SiRNA target sequence
atttttgatgaagatgctaga

SEQ ID NO: 33224 - DNA, 21 bp, Artificial sequence
  SiRNA target sequence
tttttgatgaagatgctagag

SEQ ID NO: 33225 - DNA, 21 bp, Artificial sequence
  SiRNA target sequence
ttttgatgaagatgctagaga

SEQ ID NO: 33226 - DNA, 21 bp, Artificial sequence
  SiRNA target sequence
tttgatgaagatgctagagat

SEQ ID NO: 33227 - DNA, 21 bp, Artificial sequence
  SiRNA target sequence
ttgatgaagatgctagagatg

SEQ ID NO: 33228 - DNA, 21 bp, Artificial sequence
  SiRNA target sequence
tgatgaagatgctagagatga

SEQ ID NO: 33229 - DNA, 21 bp, Artificial sequence
  SiRNA target sequence
gatgaagatgctagagatgag

SEQ ID NO: 33230 - DNA, 21 bp, Artificial sequence
  SiRNA target sequence
atgaagatgctagagatgagt

SEQ ID NO: 33231 - DNA, 21 bp, Artificial sequence
  SiRNA target sequence
tgaagatgctagagatgagta

SEQ ID NO: 33232 - DNA, 21 bp, Artificial sequence
  SiRNA target sequence
gaagatgctagagatgagtat

SEQ ID NO: 33233 - DNA, 21 bp, Artificial sequence
  SiRNA target sequence
aagatgctagagatgagtatg

SEQ ID NO: 33234 - DNA, 21 bp, Artificial sequence
  SiRNA target sequence
agatgctagagatgagtatga

SEQ ID NO: 33235 - DNA, 21 bp, Artificial sequence
  SiRNA target sequence
gatgctagagatgagtatgaa

SEQ ID NO: 33236 - DNA, 21 bp, Artificial sequence
  SiRNA target sequence
atgctagagatgagtatgaat

SEQ ID NO: 33237 - DNA, 21 bp, Artificial sequence
  SiRNA target sequence
tgctagagatgagtatgaata

SEQ ID NO: 33238 - DNA, 21 bp, Artificial sequence
  SiRNA target sequence
gctagagatgagtatgaatac

SEQ ID NO: 33239 - DNA, 21 bp, Artificial sequence
  SiRNA target sequence
ctagagatgagtatgaataca

SEQ ID NO: 33240 - DNA, 21 bp, Artificial sequence
  SiRNA target sequence
tagagatgagtatgaatacaa

SEQ ID NO: 33241 - DNA, 21 bp, Artificial sequence
  SiRNA target sequence
agagatgagtatgaatacaaa

SEQ ID NO: 33242 - DNA, 21 bp, Artificial sequence
  SiRNA target sequence
gagatgagtatgaatacaaag

SEQ ID NO: 33243 - DNA, 21 bp, Artificial sequence
  SiRNA target sequence
agatgagtatgaatacaaaga

SEQ ID NO: 33244 - DNA, 21 bp, Artificial sequence
  SiRNA target sequence
gatgagtatgaatacaaagat

SEQ ID NO: 33245 - DNA, 21 bp, Artificial sequence
  SiRNA target sequence
atgagtatgaatacaaagatc

SEQ ID NO: 33246 - DNA, 21 bp, Artificial sequence
  SiRNA target sequence
tgagtatgaatacaaagatct

SEQ ID NO: 33247 - DNA, 21 bp, Artificial sequence
  SiRNA target sequence
gagtatgaatacaaagatctg

SEQ ID NO: 33248 - DNA, 21 bp, Artificial sequence
  SiRNA target sequence
agtatgaatacaaagatctga

SEQ ID NO: 33249 - DNA, 21 bp, Artificial sequence
  SiRNA target sequence
gtatgaatacaaagatctgaa

SEQ ID NO: 33250 - DNA, 21 bp, Artificial sequence
  SiRNA target sequence
tatgaatacaaagatctgaat

SEQ ID NO: 33251 - DNA, 21 bp, Artificial sequence
  SiRNA target sequence
atgaatacaaagatctgaatt

SEQ ID NO: 33252 - DNA, 21 bp, Artificial sequence
  SiRNA target sequence
tgaatacaaagatctgaattg

SEQ ID NO: 33253 - DNA, 21 bp, Artificial sequence
  SiRNA target sequence
gaatacaaagatctgaattgt

SEQ ID NO: 33254 - DNA, 21 bp, Artificial sequence
  SiRNA target sequence
aatacaaagatctgaattgtg

SEQ ID NO: 33255 - DNA, 21 bp, Artificial sequence
  SiRNA target sequence
atacaaagatctgaattgtga

SEQ ID NO: 33256 - DNA, 21 bp, Artificial sequence
  SiRNA target sequence
tacaaagatctgaattgtgaa

SEQ ID NO: 33257 - DNA, 21 bp, Artificial sequence
  SiRNA target sequence
acaaagatctgaattgtgaat

SEQ ID NO: 33258 - DNA, 21 bp, Artificial sequence
  SiRNA target sequence
caaagatctgaattgtgaata

SEQ ID NO: 33259 - DNA, 21 bp, Artificial sequence
  SiRNA target sequence
aaagatctgaattgtgaatat

SEQ ID NO: 33260 - DNA, 21 bp, Artificial sequence
  SiRNA target sequence
aagatctgaattgtgaatatc

SEQ ID NO: 33261 - DNA, 21 bp, Artificial sequence
  SiRNA target sequence
agatctgaattgtgaatatca

SEQ ID NO: 33262 - DNA, 21 bp, Artificial sequence
  SiRNA target sequence
gatctgaattgtgaatatcat

SEQ ID NO: 33263 - DNA, 21 bp, Artificial sequence
  SiRNA target sequence
atctgaattgtgaatatcatg

SEQ ID NO: 33264 - DNA, 21 bp, Artificial sequence
  SiRNA target sequence
tctgaattgtgaatatcatga

SEQ ID NO: 33265 - DNA, 21 bp, Artificial sequence
  SiRNA target sequence
ctgaattgtgaatatcatgag

SEQ ID NO: 33266 - DNA, 21 bp, Artificial sequence
  SiRNA target sequence
tgaattgtgaatatcatgaga

SEQ ID NO: 33267 - DNA, 21 bp, Artificial sequence
  SiRNA target sequence
gaattgtgaatatcatgagaa

SEQ ID NO: 33268 - DNA, 21 bp, Artificial sequence
  SiRNA target sequence
aattgtgaatatcatgagaat

SEQ ID NO: 33269 - DNA, 21 bp, Artificial sequence
  SiRNA target sequence
attgtgaatatcatgagaatt

SEQ ID NO: 33270 - DNA, 21 bp, Artificial sequence
  SiRNA target sequence
ttgtgaatatcatgagaattt

SEQ ID NO: 33271 - DNA, 21 bp, Artificial sequence
  SiRNA target sequence
tgtgaatatcatgagaattta

SEQ ID NO: 33272 - DNA, 21 bp, Artificial sequence
  SiRNA target sequence
gtgaatatcatgagaatttat

SEQ ID NO: 33273 - DNA, 21 bp, Artificial sequence
  SiRNA target sequence
tgaatatcatgagaatttatt

SEQ ID NO: 33274 - DNA, 21 bp, Artificial sequence
  SiRNA target sequence
gaatatcatgagaatttattt

SEQ ID NO: 33275 - DNA, 21 bp, Artificial sequence
  SiRNA target sequence
aatatcatgagaatttatttg

SEQ ID NO: 33276 - DNA, 21 bp, Artificial sequence
  SiRNA target sequence
atatcatgagaatttatttga

SEQ ID NO: 33277 - DNA, 21 bp, Artificial sequence
  SiRNA target sequence
tatcatgagaatttatttgat

SEQ ID NO: 33278 - DNA, 21 bp, Artificial sequence
  SiRNA target sequence
atcatgagaatttatttgatg

SEQ ID NO: 33279 - DNA, 21 bp, Artificial sequence
  SiRNA target sequence
tcatgagaatttatttgatgc

SEQ ID NO: 33280 - DNA, 21 bp, Artificial sequence
  SiRNA target sequence
catgagaatttatttgatgca

SEQ ID NO: 33281 - DNA, 21 bp, Artificial sequence
  SiRNA target sequence
atgagaatttatttgatgcag

SEQ ID NO: 33282 - DNA, 21 bp, Artificial sequence
  SiRNA target sequence
tgagaatttatttgatgcagt

SEQ ID NO: 33283 - DNA, 21 bp, Artificial sequence
  SiRNA target sequence
gagaatttatttgatgcagta

SEQ ID NO: 33284 - DNA, 21 bp, Artificial sequence
  SiRNA target sequence
agaatttatttgatgcagtag

SEQ ID NO: 33285 - DNA, 21 bp, Artificial sequence
  SiRNA target sequence
gaatttatttgatgcagtagt

SEQ ID NO: 33286 - DNA, 21 bp, Artificial sequence
  SiRNA target sequence
aatttatttgatgcagtagta

SEQ ID NO: 33287 - DNA, 21 bp, Artificial sequence
  SiRNA target sequence
atttatttgatgcagtagtag

SEQ ID NO: 33288 - DNA, 21 bp, Artificial sequence
  SiRNA target sequence
tttatttgatgcagtagtaga

SEQ ID NO: 33289 - DNA, 21 bp, Artificial sequence
  SiRNA target sequence
ttatttgatgcagtagtagat

SEQ ID NO: 33290 - DNA, 21 bp, Artificial sequence
  SiRNA target sequence
tatttgatgcagtagtagatt

SEQ ID NO: 33291 - DNA, 21 bp, Artificial sequence
  SiRNA target sequence
atttgatgcagtagtagattc

SEQ ID NO: 33292 - DNA, 21 bp, Artificial sequence
  SiRNA target sequence
tttgatgcagtagtagattct

SEQ ID NO: 33293 - DNA, 21 bp, Artificial sequence
  SiRNA target sequence
ttgatgcagtagtagattctg

SEQ ID NO: 33294 - DNA, 21 bp, Artificial sequence
  SiRNA target sequence
tgatgcagtagtagattctga

SEQ ID NO: 33295 - DNA, 21 bp, Artificial sequence
  SiRNA target sequence
gatgcagtagtagattctgaa

SEQ ID NO: 33296 - DNA, 21 bp, Artificial sequence
  SiRNA target sequence
atgcagtagtagattctgaat

SEQ ID NO: 33297 - DNA, 21 bp, Artificial sequence
  SiRNA target sequence
tgcagtagtagattctgaatt

SEQ ID NO: 33298 - DNA, 21 bp, Artificial sequence
  SiRNA target sequence
gcagtagtagattctgaattt

SEQ ID NO: 33299 - DNA, 21 bp, Artificial sequence
  SiRNA target sequence
cagtagtagattctgaatttg

SEQ ID NO: 33300 - DNA, 21 bp, Artificial sequence
  SiRNA target sequence
agtagtagattctgaatttga

SEQ ID NO: 33301 - DNA, 21 bp, Artificial sequence
  SiRNA target sequence
gtagtagattctgaatttgat

SEQ ID NO: 33302 - DNA, 21 bp, Artificial sequence
  SiRNA target sequence
tagtagattctgaatttgata

SEQ ID NO: 33303 - DNA, 21 bp, Artificial sequence
  SiRNA target sequence
agtagattctgaatttgataa

SEQ ID NO: 33304 - DNA, 21 bp, Artificial sequence
  SiRNA target sequence
gtagattctgaatttgataaa

SEQ ID NO: 33305 - DNA, 21 bp, Artificial sequence
  SiRNA target sequence
tagattctgaatttgataaaa

SEQ ID NO: 33306 - DNA, 21 bp, Artificial sequence
  SiRNA target sequence
agattctgaatttgataaaat

SEQ ID NO: 33307 - DNA, 21 bp, Artificial sequence
  SiRNA target sequence
gattctgaatttgataaaatt

SEQ ID NO: 33308 - DNA, 21 bp, Artificial sequence
  SiRNA target sequence
attctgaatttgataaaattt

SEQ ID NO: 33309 - DNA, 21 bp, Artificial sequence
  SiRNA target sequence
ttctgaatttgataaaatttg

SEQ ID NO: 33310 - DNA, 21 bp, Artificial sequence
  SiRNA target sequence
tctgaatttgataaaatttgg

SEQ ID NO: 33311 - DNA, 21 bp, Artificial sequence
  SiRNA target sequence
ctgaatttgataaaatttggc

SEQ ID NO: 33312 - DNA, 21 bp, Artificial sequence
  SiRNA target sequence
tgaatttgataaaatttggcc

SEQ ID NO: 33313 - DNA, 21 bp, Artificial sequence
  SiRNA target sequence
gaatttgataaaatttggcca

SEQ ID NO: 33314 - DNA, 21 bp, Artificial sequence
  SiRNA target sequence
aatttgataaaatttggccac

SEQ ID NO: 33315 - DNA, 21 bp, Artificial sequence
  SiRNA target sequence
atttgataaaatttggccaca

SEQ ID NO: 33316 - DNA, 21 bp, Artificial sequence
  SiRNA target sequence
tttgataaaatttggccacac

SEQ ID NO: 33317 - DNA, 21 bp, Artificial sequence
  SiRNA target sequence
ttgataaaatttggccacact

SEQ ID NO: 33318 - DNA, 21 bp, Artificial sequence
  SiRNA target sequence
tgataaaatttggccacactt

SEQ ID NO: 33319 - DNA, 21 bp, Artificial sequence
  SiRNA target sequence
gataaaatttggccacacttg

SEQ ID NO: 33320 - DNA, 21 bp, Artificial sequence
  SiRNA target sequence
ataaaatttggccacacttgg

SEQ ID NO: 33321 - DNA, 21 bp, Artificial sequence
  SiRNA target sequence
taaaatttggccacacttggt

SEQ ID NO: 33322 - DNA, 21 bp, Artificial sequence
  SiRNA target sequence
aaaatttggccacacttggtt

SEQ ID NO: 33323 - DNA, 21 bp, Artificial sequence
  SiRNA target sequence
aaatttggccacacttggttt

SEQ ID NO: 33324 - DNA, 21 bp, Artificial sequence
  SiRNA target sequence
aatttggccacacttggtttt

SEQ ID NO: 33325 - DNA, 21 bp, Artificial sequence
  SiRNA target sequence
atttggccacacttggttttg

SEQ ID NO: 33326 - DNA, 21 bp, Artificial sequence
  SiRNA target sequence
tttggccacacttggttttga

SEQ ID NO: 33327 - DNA, 21 bp, Artificial sequence
  SiRNA target sequence
ttggccacacttggttttgaa

SEQ ID NO: 33328 - DNA, 21 bp, Artificial sequence
  SiRNA target sequence
tggccacacttggttttgaaa

SEQ ID NO: 33329 - DNA, 21 bp, Artificial sequence
  SiRNA target sequence
ggccacacttggttttgaaat

SEQ ID NO: 33330 - DNA, 21 bp, Artificial sequence
  SiRNA target sequence
gccacacttggttttgaaata

SEQ ID NO: 33331 - DNA, 21 bp, Artificial sequence
  SiRNA target sequence
ccacacttggttttgaaatat

SEQ ID NO: 33332 - DNA, 21 bp, Artificial sequence
  SiRNA target sequence
cacacttggttttgaaatata

SEQ ID NO: 33333 - DNA, 21 bp, Artificial sequence
  SiRNA target sequence
acacttggttttgaaatatat

SEQ ID NO: 33334 - DNA, 21 bp, Artificial sequence
  SiRNA target sequence
cacttggttttgaaatatata

SEQ ID NO: 33335 - DNA, 21 bp, Artificial sequence
  SiRNA target sequence
acttggttttgaaatatataa

SEQ ID NO: 33336 - DNA, 21 bp, Artificial sequence
  SiRNA target sequence
cttggttttgaaatatataac

SEQ ID NO: 33337 - DNA, 21 bp, Artificial sequence
  SiRNA target sequence
ttggttttgaaatatataaca

SEQ ID NO: 33338 - DNA, 21 bp, Artificial sequence
  SiRNA target sequence
tggttttgaaatatataacat

SEQ ID NO: 33339 - DNA, 21 bp, Artificial sequence
  SiRNA target sequence
ggttttgaaatatataacata

SEQ ID NO: 33340 - DNA, 21 bp, Artificial sequence
  SiRNA target sequence
gttttgaaatatataacatat

SEQ ID NO: 33341 - DNA, 21 bp, Artificial sequence
  SiRNA target sequence
ttttgaaatatataacatatt

SEQ ID NO: 33342 - DNA, 21 bp, Artificial sequence
  SiRNA target sequence
tttgaaatatataacatatta

SEQ ID NO: 33343 - DNA, 21 bp, Artificial sequence
  SiRNA target sequence
ttgaaatatataacatattat

SEQ ID NO: 33344 - DNA, 21 bp, Artificial sequence
  SiRNA target sequence
tgaaatatataacatattatc

SEQ ID NO: 33345 - DNA, 21 bp, Artificial sequence
  SiRNA target sequence
gaaatatataacatattatcc

SEQ ID NO: 33346 - DNA, 21 bp, Artificial sequence
  SiRNA target sequence
aaatatataacatattatcca

SEQ ID NO: 33347 - DNA, 21 bp, Artificial sequence
  SiRNA target sequence
aatatataacatattatccat

SEQ ID NO: 33348 - DNA, 21 bp, Artificial sequence
  SiRNA target sequence
atatataacatattatccatg

SEQ ID NO: 33349 - DNA, 21 bp, Artificial sequence
  SiRNA target sequence
tatataacatattatccatgt

SEQ ID NO: 33350 - DNA, 21 bp, Artificial sequence
  SiRNA target sequence
atataacatattatccatgta

SEQ ID NO: 33351 - DNA, 21 bp, Artificial sequence
  SiRNA target sequence
tataacatattatccatgtag

SEQ ID NO: 33352 - DNA, 21 bp, Artificial sequence
  SiRNA target sequence
ataacatattatccatgtagt

SEQ ID NO: 33353 - DNA, 21 bp, Artificial sequence
  SiRNA target sequence
taacatattatccatgtagtt

SEQ ID NO: 33354 - DNA, 21 bp, Artificial sequence
  SiRNA target sequence
aacatattatccatgtagttt

SEQ ID NO: 33355 - DNA, 21 bp, Artificial sequence
  SiRNA target sequence
acatattatccatgtagtttg

SEQ ID NO: 33356 - DNA, 21 bp, Artificial sequence
  SiRNA target sequence
catattatccatgtagtttga

SEQ ID NO: 33357 - DNA, 21 bp, Artificial sequence
  SiRNA target sequence
atattatccatgtagtttgaa

SEQ ID NO: 33358 - DNA, 21 bp, Artificial sequence
  SiRNA target sequence
tattatccatgtagtttgaat

SEQ ID NO: 33359 - DNA, 21 bp, Artificial sequence
  SiRNA target sequence
attatccatgtagtttgaatt

SEQ ID NO: 33360 - DNA, 21 bp, Artificial sequence
  SiRNA target sequence
ttatccatgtagtttgaattg

SEQ ID NO: 33361 - DNA, 21 bp, Artificial sequence
  SiRNA target sequence
tatccatgtagtttgaattgg

SEQ ID NO: 33362 - DNA, 21 bp, Artificial sequence
  SiRNA target sequence
atccatgtagtttgaattgga

SEQ ID NO: 33363 - DNA, 21 bp, Artificial sequence
  SiRNA target sequence
tccatgtagtttgaattggag

SEQ ID NO: 33364 - DNA, 21 bp, Artificial sequence
  SiRNA target sequence
ccatgtagtttgaattggagg

SEQ ID NO: 33365 - DNA, 21 bp, Artificial sequence
  SiRNA target sequence
catgtagtttgaattggaggg

SEQ ID NO: 33366 - DNA, 21 bp, Artificial sequence
  SiRNA target sequence
atgtagtttgaattggagggg

SEQ ID NO: 33367 - DNA, 21 bp, Artificial sequence
  SiRNA target sequence
tgtagtttgaattggaggggt

SEQ ID NO: 33368 - DNA, 21 bp, Artificial sequence
  SiRNA target sequence
gtagtttgaattggaggggta

SEQ ID NO: 33369 - DNA, 21 bp, Artificial sequence
  SiRNA target sequence
tagtttgaattggaggggtat

SEQ ID NO: 33370 - DNA, 21 bp, Artificial sequence
  SiRNA target sequence
agtttgaattggaggggtatg

SEQ ID NO: 33371 - DNA, 21 bp, Artificial sequence
  SiRNA target sequence
gtttgaattggaggggtatgc

SEQ ID NO: 33372 - DNA, 21 bp, Artificial sequence
  SiRNA target sequence
tttgaattggaggggtatgcc

SEQ ID NO: 33373 - DNA, 21 bp, Artificial sequence
  SiRNA target sequence
ttgaattggaggggtatgcca

SEQ ID NO: 33374 - DNA, 21 bp, Artificial sequence
  SiRNA target sequence
tgaattggaggggtatgccaa

SEQ ID NO: 33375 - DNA, 21 bp, Artificial sequence
  SiRNA target sequence
gaattggaggggtatgccaac

SEQ ID NO: 33376 - DNA, 21 bp, Artificial sequence
  SiRNA target sequence
aattggaggggtatgccaact

SEQ ID NO: 33377 - DNA, 21 bp, Artificial sequence
  SiRNA target sequence
attggaggggtatgccaacta

SEQ ID NO: 33378 - DNA, 21 bp, Artificial sequence
  SiRNA target sequence
ttggaggggtatgccaactat

SEQ ID NO: 33379 - DNA, 21 bp, Artificial sequence
  SiRNA target sequence
tggaggggtatgccaactata

SEQ ID NO: 33380 - DNA, 21 bp, Artificial sequence
  SiRNA target sequence
ggaggggtatgccaactatac

SEQ ID NO: 33381 - DNA, 21 bp, Artificial sequence
  SiRNA target sequence
gaggggtatgccaactatacc

SEQ ID NO: 33382 - DNA, 21 bp, Artificial sequence
  SiRNA target sequence
aggggtatgccaactatacct

SEQ ID NO: 33383 - DNA, 21 bp, Artificial sequence
  SiRNA target sequence
ggggtatgccaactataccta

SEQ ID NO: 33384 - DNA, 21 bp, Artificial sequence
  SiRNA target sequence
gggtatgccaactatacctat

SEQ ID NO: 33385 - DNA, 21 bp, Artificial sequence
  SiRNA target sequence
ggtatgccaactatacctatt

SEQ ID NO: 33386 - DNA, 21 bp, Artificial sequence
  SiRNA target sequence
gtatgccaactatacctattg

SEQ ID NO: 33387 - DNA, 21 bp, Artificial sequence
  SiRNA target sequence
tatgccaactatacctattgt

SEQ ID NO: 33388 - DNA, 21 bp, Artificial sequence
  SiRNA target sequence
atgccaactatacctattgtt

SEQ ID NO: 33389 - DNA, 21 bp, Artificial sequence
  SiRNA target sequence
tgccaactatacctattgttt

SEQ ID NO: 33390 - DNA, 21 bp, Artificial sequence
  SiRNA target sequence
gccaactatacctattgttta

SEQ ID NO: 33391 - DNA, 21 bp, Artificial sequence
  SiRNA target sequence
ccaactatacctattgtttat

SEQ ID NO: 33392 - DNA, 21 bp, Artificial sequence
  SiRNA target sequence
caactatacctattgtttatg

SEQ ID NO: 33393 - DNA, 21 bp, Artificial sequence
  SiRNA target sequence
aactatacctattgtttatgt

SEQ ID NO: 33394 - DNA, 21 bp, Artificial sequence
  SiRNA target sequence
actatacctattgtttatgtt

SEQ ID NO: 33395 - DNA, 21 bp, Artificial sequence
  SiRNA target sequence
ctatacctattgtttatgttt

SEQ ID NO: 33396 - DNA, 21 bp, Artificial sequence
  SiRNA target sequence
tatacctattgtttatgtttc

SEQ ID NO: 33397 - DNA, 21 bp, Artificial sequence
  SiRNA target sequence
atacctattgtttatgtttca

SEQ ID NO: 33398 - DNA, 21 bp, Artificial sequence
  SiRNA target sequence
tacctattgtttatgtttcaa

SEQ ID NO: 33399 - DNA, 21 bp, Artificial sequence
  SiRNA target sequence
acctattgtttatgtttcaaa

SEQ ID NO: 33400 - DNA, 21 bp, Artificial sequence
  SiRNA target sequence
cctattgtttatgtttcaaaa

SEQ ID NO: 33401 - DNA, 21 bp, Artificial sequence
  SiRNA target sequence
ctattgtttatgtttcaaaac

SEQ ID NO: 33402 - DNA, 21 bp, Artificial sequence
  SiRNA target sequence
tattgtttatgtttcaaaaca

SEQ ID NO: 33403 - DNA, 21 bp, Artificial sequence
  SiRNA target sequence
attgtttatgtttcaaaacat

SEQ ID NO: 33404 - DNA, 21 bp, Artificial sequence
  SiRNA target sequence
ttgtttatgtttcaaaacatt

SEQ ID NO: 33405 - DNA, 21 bp, Artificial sequence
  SiRNA target sequence
tgtttatgtttcaaaacattt

SEQ ID NO: 33406 - DNA, 21 bp, Artificial sequence
  SiRNA target sequence
gtttatgtttcaaaacatttt

SEQ ID NO: 33407 - DNA, 21 bp, Artificial sequence
  SiRNA target sequence
tttatgtttcaaaacattttt

SEQ ID NO: 33408 - DNA, 21 bp, Artificial sequence
  SiRNA target sequence
ttatgtttcaaaacatttttg

SEQ ID NO: 33409 - DNA, 21 bp, Artificial sequence
  SiRNA target sequence
tatgtttcaaaacatttttgg

SEQ ID NO: 33410 - DNA, 21 bp, Artificial sequence
  SiRNA target sequence
atgtttcaaaacatttttggt

SEQ ID NO: 33411 - DNA, 21 bp, Artificial sequence
  SiRNA target sequence
tgtttcaaaacatttttggta

SEQ ID NO: 33412 - DNA, 21 bp, Artificial sequence
  SiRNA target sequence
gtttcaaaacatttttggtat

SEQ ID NO: 33413 - DNA, 21 bp, Artificial sequence
  SiRNA target sequence
tttcaaaacatttttggtatg

SEQ ID NO: 33414 - DNA, 21 bp, Artificial sequence
  SiRNA target sequence
ttcaaaacatttttggtatga

SEQ ID NO: 33415 - DNA, 21 bp, Artificial sequence
  SiRNA target sequence
tcaaaacatttttggtatgaa

SEQ ID NO: 33416 - DNA, 21 bp, Artificial sequence
  SiRNA target sequence
caaaacatttttggtatgaat

SEQ ID NO: 33417 - DNA, 21 bp, Artificial sequence
  SiRNA target sequence
aaaacatttttggtatgaatt

SEQ ID NO: 33418 - DNA, 21 bp, Artificial sequence
  SiRNA target sequence
aaacatttttggtatgaattg

SEQ ID NO: 33419 - DNA, 21 bp, Artificial sequence
  SiRNA target sequence
aacatttttggtatgaattgt

SEQ ID NO: 33420 - DNA, 21 bp, Artificial sequence
  SiRNA target sequence
acatttttggtatgaattgta

SEQ ID NO: 33421 - DNA, 21 bp, Artificial sequence
  SiRNA target sequence
catttttggtatgaattgtat

SEQ ID NO: 33422 - DNA, 21 bp, Artificial sequence
  SiRNA target sequence
atttttggtatgaattgtata

SEQ ID NO: 33423 - DNA, 21 bp, Artificial sequence
  SiRNA target sequence
tttttggtatgaattgtatag

SEQ ID NO: 33424 - DNA, 21 bp, Artificial sequence
  SiRNA target sequence
ttttggtatgaattgtataga

SEQ ID NO: 33425 - DNA, 21 bp, Artificial sequence
  SiRNA target sequence
tttggtatgaattgtatagaa

SEQ ID NO: 33426 - DNA, 21 bp, Artificial sequence
  SiRNA target sequence
ttggtatgaattgtatagaac

SEQ ID NO: 33427 - DNA, 21 bp, Artificial sequence
  SiRNA target sequence
tggtatgaattgtatagaact

SEQ ID NO: 33428 - DNA, 21 bp, Artificial sequence
  SiRNA target sequence
ggtatgaattgtatagaactg

SEQ ID NO: 33429 - DNA, 21 bp, Artificial sequence
  SiRNA target sequence
gtatgaattgtatagaactgg

SEQ ID NO: 33430 - DNA, 21 bp, Artificial sequence
  SiRNA target sequence
tatgaattgtatagaactggt

SEQ ID NO: 33431 - DNA, 21 bp, Artificial sequence
  SiRNA target sequence
atgaattgtatagaactggtt

SEQ ID NO: 33432 - DNA, 21 bp, Artificial sequence
  SiRNA target sequence
tgaattgtatagaactggttt

SEQ ID NO: 33433 - DNA, 21 bp, Artificial sequence
  SiRNA target sequence
gaattgtatagaactggtttt

SEQ ID NO: 33434 - DNA, 21 bp, Artificial sequence
  SiRNA target sequence
aattgtatagaactggttttt

SEQ ID NO: 33435 - DNA, 21 bp, Artificial sequence
  SiRNA target sequence
attgtatagaactggtttttt

SEQ ID NO: 33436 - DNA, 21 bp, Artificial sequence
  SiRNA target sequence
ttgtatagaactggtttttta

SEQ ID NO: 33437 - DNA, 21 bp, Artificial sequence
  SiRNA target sequence
tgtatagaactggttttttaa

SEQ ID NO: 33438 - DNA, 21 bp, Artificial sequence
  SiRNA target sequence
gtatagaactggttttttaaa

SEQ ID NO: 33439 - DNA, 21 bp, Artificial sequence
  SiRNA target sequence
tatagaactggttttttaaac

SEQ ID NO: 33440 - DNA, 21 bp, Artificial sequence
  SiRNA target sequence
atagaactggttttttaaaca

SEQ ID NO: 33441 - DNA, 21 bp, Artificial sequence
  SiRNA target sequence
tagaactggttttttaaacaa

SEQ ID NO: 33442 - DNA, 21 bp, Artificial sequence
  SiRNA target sequence
agaactggttttttaaacaag

SEQ ID NO: 33443 - DNA, 21 bp, Artificial sequence
  SiRNA target sequence
gaactggttttttaaacaagt

SEQ ID NO: 33444 - DNA, 21 bp, Artificial sequence
  SiRNA target sequence
aactggttttttaaacaagtt

SEQ ID NO: 33445 - DNA, 21 bp, Artificial sequence
  SiRNA target sequence
actggttttttaaacaagtta

SEQ ID NO: 33446 - DNA, 21 bp, Artificial sequence
  SiRNA target sequence
ctggttttttaaacaagttat

SEQ ID NO: 33447 - DNA, 21 bp, Artificial sequence
  SiRNA target sequence
tggttttttaaacaagttata

SEQ ID NO: 33448 - DNA, 21 bp, Artificial sequence
  SiRNA target sequence
ggttttttaaacaagttatat

SEQ ID NO: 33449 - DNA, 21 bp, Artificial sequence
  SiRNA target sequence
gttttttaaacaagttatatc

SEQ ID NO: 33450 - DNA, 21 bp, Artificial sequence
  SiRNA target sequence
ttttttaaacaagttatatca

SEQ ID NO: 33451 - DNA, 21 bp, Artificial sequence
  SiRNA target sequence
tttttaaacaagttatatcat

SEQ ID NO: 33452 - DNA, 21 bp, Artificial sequence
  SiRNA target sequence
ttttaaacaagttatatcatt

SEQ ID NO: 33453 - DNA, 21 bp, Artificial sequence
  SiRNA target sequence
tttaaacaagttatatcattg

SEQ ID NO: 33454 - DNA, 21 bp, Artificial sequence
  SiRNA target sequence
ttaaacaagttatatcattgt

SEQ ID NO: 33455 - DNA, 21 bp, Artificial sequence
  SiRNA target sequence
taaacaagttatatcattgtg

SEQ ID NO: 33456 - DNA, 21 bp, Artificial sequence
  SiRNA target sequence
aaacaagttatatcattgtgg

SEQ ID NO: 33457 - DNA, 21 bp, Artificial sequence
  SiRNA target sequence
aacaagttatatcattgtggc

SEQ ID NO: 33458 - DNA, 21 bp, Artificial sequence
  SiRNA target sequence
acaagttatatcattgtggct

SEQ ID NO: 33459 - DNA, 21 bp, Artificial sequence
  SiRNA target sequence
caagttatatcattgtggctc

SEQ ID NO: 33460 - DNA, 21 bp, Artificial sequence
  SiRNA target sequence
aagttatatcattgtggctca

SEQ ID NO: 33461 - DNA, 21 bp, Artificial sequence
  SiRNA target sequence
agttatatcattgtggctcat

SEQ ID NO: 33462 - DNA, 21 bp, Artificial sequence
  SiRNA target sequence
gttatatcattgtggctcatg

SEQ ID NO: 33463 - DNA, 21 bp, Artificial sequence
  SiRNA target sequence
ttatatcattgtggctcatgg

SEQ ID NO: 33464 - DNA, 21 bp, Artificial sequence
  SiRNA target sequence
tatatcattgtggctcatgga

SEQ ID NO: 33465 - DNA, 21 bp, Artificial sequence
  SiRNA target sequence
atatcattgtggctcatggac

SEQ ID NO: 33466 - DNA, 21 bp, Artificial sequence
  SiRNA target sequence
tatcattgtggctcatggact

SEQ ID NO: 33467 - DNA, 21 bp, Artificial sequence
  SiRNA target sequence
atcattgtggctcatggactg

SEQ ID NO: 33468 - DNA, 21 bp, Artificial sequence
  SiRNA target sequence
tcattgtggctcatggactga

SEQ ID NO: 33469 - DNA, 21 bp, Artificial sequence
  SiRNA target sequence
cattgtggctcatggactgac

SEQ ID NO: 33470 - DNA, 21 bp, Artificial sequence
  SiRNA target sequence
attgtggctcatggactgaca

SEQ ID NO: 33471 - DNA, 21 bp, Artificial sequence
  SiRNA target sequence
ttgtggctcatggactgacat

SEQ ID NO: 33472 - DNA, 21 bp, Artificial sequence
  SiRNA target sequence
tgtggctcatggactgacata

SEQ ID NO: 33473 - DNA, 21 bp, Artificial sequence
  SiRNA target sequence
gtggctcatggactgacatat

SEQ ID NO: 33474 - DNA, 21 bp, Artificial sequence
  SiRNA target sequence
tggctcatggactgacatatt

SEQ ID NO: 33475 - DNA, 21 bp, Artificial sequence
  SiRNA target sequence
ggctcatggactgacatattg

SEQ ID NO: 33476 - DNA, 21 bp, Artificial sequence
  SiRNA target sequence
gctcatggactgacatattgt

SEQ ID NO: 33477 - DNA, 21 bp, Artificial sequence
  SiRNA target sequence
ctcatggactgacatattgtt

SEQ ID NO: 33478 - DNA, 21 bp, Artificial sequence
  SiRNA target sequence
tcatggactgacatattgttg

SEQ ID NO: 33479 - DNA, 21 bp, Artificial sequence
  SiRNA target sequence
catggactgacatattgttgt

SEQ ID NO: 33480 - DNA, 21 bp, Artificial sequence
  SiRNA target sequence
atggactgacatattgttgtt

SEQ ID NO: 33481 - DNA, 21 bp, Artificial sequence
  SiRNA target sequence
tggactgacatattgttgttg

SEQ ID NO: 33482 - DNA, 21 bp, Artificial sequence
  SiRNA target sequence
ggactgacatattgttgttgt

SEQ ID NO: 33483 - DNA, 21 bp, Artificial sequence
  SiRNA target sequence
gactgacatattgttgttgtt

SEQ ID NO: 33484 - DNA, 21 bp, Artificial sequence
  SiRNA target sequence
actgacatattgttgttgttg

SEQ ID NO: 33485 - DNA, 21 bp, Artificial sequence
  SiRNA target sequence
ctgacatattgttgttgttgt

SEQ ID NO: 33486 - DNA, 21 bp, Artificial sequence
  SiRNA target sequence
tgacatattgttgttgttgtc

SEQ ID NO: 33487 - DNA, 21 bp, Artificial sequence
  SiRNA target sequence
gacatattgttgttgttgtct

SEQ ID NO: 33488 - DNA, 21 bp, Artificial sequence
  SiRNA target sequence
acatattgttgttgttgtctg

SEQ ID NO: 33489 - DNA, 21 bp, Artificial sequence
  SiRNA target sequence
catattgttgttgttgtctgg

SEQ ID NO: 33490 - DNA, 21 bp, Artificial sequence
  SiRNA target sequence
atattgttgttgttgtctgga

SEQ ID NO: 33491 - DNA, 21 bp, Artificial sequence
  SiRNA target sequence
tattgttgttgttgtctggag

SEQ ID NO: 33492 - DNA, 21 bp, Artificial sequence
  SiRNA target sequence
attgttgttgttgtctggaga

SEQ ID NO: 33493 - DNA, 21 bp, Artificial sequence
  SiRNA target sequence
ttgttgttgttgtctggagat

SEQ ID NO: 33494 - DNA, 21 bp, Artificial sequence
  SiRNA target sequence
tgttgttgttgtctggagatg

SEQ ID NO: 33495 - DNA, 21 bp, Artificial sequence
  SiRNA target sequence
gttgttgttgtctggagatgt

SEQ ID NO: 33496 - DNA, 21 bp, Artificial sequence
  SiRNA target sequence
ttgttgttgtctggagatgta

SEQ ID NO: 33497 - DNA, 21 bp, Artificial sequence
  SiRNA target sequence
tgttgttgtctggagatgtag

SEQ ID NO: 33498 - DNA, 21 bp, Artificial sequence
  SiRNA target sequence
gttgttgtctggagatgtaga

SEQ ID NO: 33499 - DNA, 21 bp, Artificial sequence
  SiRNA target sequence
ttgttgtctggagatgtagaa

SEQ ID NO: 33500 - DNA, 21 bp, Artificial sequence
  SiRNA target sequence
tgttgtctggagatgtagaaa

SEQ ID NO: 33501 - DNA, 21 bp, Artificial sequence
  SiRNA target sequence
gttgtctggagatgtagaaac

SEQ ID NO: 33502 - DNA, 21 bp, Artificial sequence
  SiRNA target sequence
ttgtctggagatgtagaaacc

SEQ ID NO: 33503 - DNA, 21 bp, Artificial sequence
  SiRNA target sequence
tgtctggagatgtagaaacca

SEQ ID NO: 33504 - DNA, 21 bp, Artificial sequence
  SiRNA target sequence
gtctggagatgtagaaaccaa

SEQ ID NO: 33505 - DNA, 21 bp, Artificial sequence
  SiRNA target sequence
tctggagatgtagaaaccaat

SEQ ID NO: 33506 - DNA, 21 bp, Artificial sequence
  SiRNA target sequence
ctggagatgtagaaaccaatc

SEQ ID NO: 33507 - DNA, 21 bp, Artificial sequence
  SiRNA target sequence
tggagatgtagaaaccaatcc

SEQ ID NO: 33508 - DNA, 21 bp, Artificial sequence
  SiRNA target sequence
ggagatgtagaaaccaatcca

SEQ ID NO: 33509 - DNA, 21 bp, Artificial sequence
  SiRNA target sequence
gagatgtagaaaccaatccag

SEQ ID NO: 33510 - DNA, 21 bp, Artificial sequence
  SiRNA target sequence
agatgtagaaaccaatccagg

SEQ ID NO: 33511 - DNA, 21 bp, Artificial sequence
  SiRNA target sequence
gatgtagaaaccaatccagga

SEQ ID NO: 33512 - DNA, 21 bp, Artificial sequence
  SiRNA target sequence
atgtagaaaccaatccaggac

SEQ ID NO: 33513 - DNA, 21 bp, Artificial sequence
  SiRNA target sequence
tgtagaaaccaatccaggacc

SEQ ID NO: 33514 - DNA, 21 bp, Artificial sequence
  SiRNA target sequence
gtagaaaccaatccaggacct

SEQ ID NO: 33515 - DNA, 21 bp, Artificial sequence
  SiRNA target sequence
tagaaaccaatccaggacctg

SEQ ID NO: 33516 - DNA, 21 bp, Artificial sequence
  SiRNA target sequence
agaaaccaatccaggacctgt

SEQ ID NO: 33517 - DNA, 21 bp, Artificial sequence
  SiRNA target sequence
gaaaccaatccaggacctgtt

SEQ ID NO: 33518 - DNA, 21 bp, Artificial sequence
  SiRNA target sequence
aaaccaatccaggacctgttg

SEQ ID NO: 33519 - DNA, 21 bp, Artificial sequence
  SiRNA target sequence
aaccaatccaggacctgttga

SEQ ID NO: 33520 - DNA, 21 bp, Artificial sequence
  SiRNA target sequence
accaatccaggacctgttgaa

SEQ ID NO: 33521 - DNA, 21 bp, Artificial sequence
  SiRNA target sequence
ccaatccaggacctgttgaaa

SEQ ID NO: 33522 - DNA, 21 bp, Artificial sequence
  SiRNA target sequence
caatccaggacctgttgaaac

SEQ ID NO: 33523 - DNA, 21 bp, Artificial sequence
  SiRNA target sequence
aatccaggacctgttgaaacg

SEQ ID NO: 33524 - DNA, 21 bp, Artificial sequence
  SiRNA target sequence
atccaggacctgttgaaacgt

SEQ ID NO: 33525 - DNA, 21 bp, Artificial sequence
  SiRNA target sequence
tccaggacctgttgaaacgta

SEQ ID NO: 33526 - DNA, 21 bp, Artificial sequence
  SiRNA target sequence
ccaggacctgttgaaacgtat

SEQ ID NO: 33527 - DNA, 21 bp, Artificial sequence
  SiRNA target sequence
caggacctgttgaaacgtata

SEQ ID NO: 33528 - DNA, 21 bp, Artificial sequence
  SiRNA target sequence
aggacctgttgaaacgtataa

SEQ ID NO: 33529 - DNA, 21 bp, Artificial sequence
  SiRNA target sequence
ggacctgttgaaacgtataaa

SEQ ID NO: 33530 - DNA, 21 bp, Artificial sequence
  SiRNA target sequence
gacctgttgaaacgtataaag

SEQ ID NO: 33531 - DNA, 21 bp, Artificial sequence
  SiRNA target sequence
acctgttgaaacgtataaaga

SEQ ID NO: 33532 - DNA, 21 bp, Artificial sequence
  SiRNA target sequence
cctgttgaaacgtataaagac

SEQ ID NO: 33533 - DNA, 21 bp, Artificial sequence
  SiRNA target sequence
ctgttgaaacgtataaagact

SEQ ID NO: 33534 - DNA, 21 bp, Artificial sequence
  SiRNA target sequence
tgttgaaacgtataaagactt

SEQ ID NO: 33535 - DNA, 21 bp, Artificial sequence
  SiRNA target sequence
gttgaaacgtataaagactta

SEQ ID NO: 33536 - DNA, 21 bp, Artificial sequence
  SiRNA target sequence
ttgaaacgtataaagacttat

SEQ ID NO: 33537 - DNA, 21 bp, Artificial sequence
  SiRNA target sequence
tgaaacgtataaagacttatg

SEQ ID NO: 33538 - DNA, 21 bp, Artificial sequence
  SiRNA target sequence
gaaacgtataaagacttatgc

SEQ ID NO: 33539 - DNA, 21 bp, Artificial sequence
  SiRNA target sequence
aaacgtataaagacttatgca

SEQ ID NO: 33540 - DNA, 21 bp, Artificial sequence
  SiRNA target sequence
aacgtataaagacttatgcag

SEQ ID NO: 33541 - DNA, 21 bp, Artificial sequence
  SiRNA target sequence
acgtataaagacttatgcaga

SEQ ID NO: 33542 - DNA, 21 bp, Artificial sequence
  SiRNA target sequence
cgtataaagacttatgcagaa

SEQ ID NO: 33543 - DNA, 21 bp, Artificial sequence
  SiRNA target sequence
gtataaagacttatgcagaag

SEQ ID NO: 33544 - DNA, 21 bp, Artificial sequence
  SiRNA target sequence
tataaagacttatgcagaagg

SEQ ID NO: 33545 - DNA, 21 bp, Artificial sequence
  SiRNA target sequence
ataaagacttatgcagaagga

SEQ ID NO: 33546 - DNA, 21 bp, Artificial sequence
  SiRNA target sequence
taaagacttatgcagaaggaa

SEQ ID NO: 33547 - DNA, 21 bp, Artificial sequence
  SiRNA target sequence
aaagacttatgcagaaggaaa

SEQ ID NO: 33548 - DNA, 21 bp, Artificial sequence
  SiRNA target sequence
aagacttatgcagaaggaaaa

SEQ ID NO: 33549 - DNA, 21 bp, Artificial sequence
  SiRNA target sequence
agacttatgcagaaggaaaaa

SEQ ID NO: 33550 - DNA, 21 bp, Artificial sequence
  SiRNA target sequence
gacttatgcagaaggaaaaat

SEQ ID NO: 33551 - DNA, 21 bp, Artificial sequence
  SiRNA target sequence
acttatgcagaaggaaaaata

SEQ ID NO: 33552 - DNA, 21 bp, Artificial sequence
  SiRNA target sequence
cttatgcagaaggaaaaatat

SEQ ID NO: 33553 - DNA, 21 bp, Artificial sequence
  SiRNA target sequence
ttatgcagaaggaaaaatatt

SEQ ID NO: 33554 - DNA, 21 bp, Artificial sequence
  SiRNA target sequence
tatgcagaaggaaaaatattc

SEQ ID NO: 33555 - DNA, 21 bp, Artificial sequence
  SiRNA target sequence
atgcagaaggaaaaatattcg

SEQ ID NO: 33556 - DNA, 21 bp, Artificial sequence
  SiRNA target sequence
tgcagaaggaaaaatattcgt

SEQ ID NO: 33557 - DNA, 21 bp, Artificial sequence
  SiRNA target sequence
gcagaaggaaaaatattcgta

SEQ ID NO: 33558 - DNA, 21 bp, Artificial sequence
  SiRNA target sequence
cagaaggaaaaatattcgtaa

SEQ ID NO: 33559 - DNA, 21 bp, Artificial sequence
  SiRNA target sequence
agaaggaaaaatattcgtaag

SEQ ID NO: 33560 - DNA, 21 bp, Artificial sequence
  SiRNA target sequence
gaaggaaaaatattcgtaaga

SEQ ID NO: 33561 - DNA, 21 bp, Artificial sequence
  SiRNA target sequence
aaggaaaaatattcgtaagag

SEQ ID NO: 33562 - DNA, 21 bp, Artificial sequence
  SiRNA target sequence
aggaaaaatattcgtaagaga

SEQ ID NO: 33563 - DNA, 21 bp, Artificial sequence
  SiRNA target sequence
ggaaaaatattcgtaagagaa

SEQ ID NO: 33564 - DNA, 21 bp, Artificial sequence
  SiRNA target sequence
gaaaaatattcgtaagagaaa

SEQ ID NO: 33565 - DNA, 21 bp, Artificial sequence
  SiRNA target sequence
aaaaatattcgtaagagaaaa

SEQ ID NO: 33566 - DNA, 21 bp, Artificial sequence
  SiRNA target sequence
aaaatattcgtaagagaaaat

SEQ ID NO: 33567 - DNA, 21 bp, Artificial sequence
  SiRNA target sequence
aaatattcgtaagagaaaatc

SEQ ID NO: 33568 - DNA, 21 bp, Artificial sequence
  SiRNA target sequence
aatattcgtaagagaaaatct

SEQ ID NO: 33569 - DNA, 21 bp, Artificial sequence
  SiRNA target sequence
atattcgtaagagaaaatctc

SEQ ID NO: 33570 - DNA, 21 bp, Artificial sequence
  SiRNA target sequence
tattcgtaagagaaaatctcg

SEQ ID NO: 33571 - DNA, 21 bp, Artificial sequence
  SiRNA target sequence
attcgtaagagaaaatctcga

SEQ ID NO: 33572 - DNA, 21 bp, Artificial sequence
  SiRNA target sequence
ttcgtaagagaaaatctcgaa

SEQ ID NO: 33573 - DNA, 21 bp, Artificial sequence
  SiRNA target sequence
tcgtaagagaaaatctcgaat

SEQ ID NO: 33574 - DNA, 21 bp, Artificial sequence
  SiRNA target sequence
cgtaagagaaaatctcgaatt

SEQ ID NO: 33575 - DNA, 21 bp, Artificial sequence
  SiRNA target sequence
gtaagagaaaatctcgaattc

SEQ ID NO: 33576 - DNA, 21 bp, Artificial sequence
  SiRNA target sequence
taagagaaaatctcgaattcg

SEQ ID NO: 33577 - DNA, 21 bp, Artificial sequence
  SiRNA target sequence
aagagaaaatctcgaattcga

SEQ ID NO: 33578 - DNA, 21 bp, Artificial sequence
  SiRNA target sequence
agagaaaatctcgaattcgag

SEQ ID NO: 33579 - DNA, 21 bp, Artificial sequence
  SiRNA target sequence
gagaaaatctcgaattcgaga

SEQ ID NO: 33580 - DNA, 21 bp, Artificial sequence
  SiRNA target sequence
agaaaatctcgaattcgagaa

SEQ ID NO: 33581 - DNA, 21 bp, Artificial sequence
  SiRNA target sequence
gaaaatctcgaattcgagaag

SEQ ID NO: 33582 - DNA, 21 bp, Artificial sequence
  SiRNA target sequence
aaaatctcgaattcgagaaga

SEQ ID NO: 33583 - DNA, 21 bp, Artificial sequence
  SiRNA target sequence
aaatctcgaattcgagaagaa

SEQ ID NO: 33584 - DNA, 21 bp, Artificial sequence
  SiRNA target sequence
aatctcgaattcgagaagaaa

SEQ ID NO: 33585 - DNA, 21 bp, Artificial sequence
  SiRNA target sequence
atctcgaattcgagaagaaat

SEQ ID NO: 33586 - DNA, 21 bp, Artificial sequence
  SiRNA target sequence
tctcgaattcgagaagaaatc

SEQ ID NO: 33587 - DNA, 21 bp, Artificial sequence
  SiRNA target sequence
ctcgaattcgagaagaaatca

SEQ ID NO: 33588 - DNA, 21 bp, Artificial sequence
  SiRNA target sequence
tcgaattcgagaagaaatcaa

SEQ ID NO: 33589 - DNA, 21 bp, Artificial sequence
  SiRNA target sequence
cgaattcgagaagaaatcaaa

SEQ ID NO: 33590 - DNA, 21 bp, Artificial sequence
  SiRNA target sequence
gaattcgagaagaaatcaaaa

SEQ ID NO: 33591 - DNA, 21 bp, Artificial sequence
  SiRNA target sequence
aattcgagaagaaatcaaaat

SEQ ID NO: 33592 - DNA, 21 bp, Artificial sequence
  SiRNA target sequence
attcgagaagaaatcaaaatg

SEQ ID NO: 33593 - DNA, 21 bp, Artificial sequence
  SiRNA target sequence
ttcgagaagaaatcaaaatgc

SEQ ID NO: 33594 - DNA, 21 bp, Artificial sequence
  SiRNA target sequence
tcgagaagaaatcaaaatgca

SEQ ID NO: 33595 - DNA, 21 bp, Artificial sequence
  SiRNA target sequence
cgagaagaaatcaaaatgcaa

SEQ ID NO: 33596 - DNA, 21 bp, Artificial sequence
  SiRNA target sequence
gagaagaaatcaaaatgcaac

SEQ ID NO: 33597 - DNA, 21 bp, Artificial sequence
  SiRNA target sequence
agaagaaatcaaaatgcaaca

SEQ ID NO: 33598 - DNA, 21 bp, Artificial sequence
  SiRNA target sequence
gaagaaatcaaaatgcaacaa

SEQ ID NO: 33599 - DNA, 21 bp, Artificial sequence
  SiRNA target sequence
aagaaatcaaaatgcaacaac

SEQ ID NO: 33600 - DNA, 21 bp, Artificial sequence
  SiRNA target sequence
agaaatcaaaatgcaacaaca

SEQ ID NO: 33601 - DNA, 21 bp, Artificial sequence
  SiRNA target sequence
gaaatcaaaatgcaacaacat

SEQ ID NO: 33602 - DNA, 21 bp, Artificial sequence
  SiRNA target sequence
aaatcaaaatgcaacaacata

SEQ ID NO: 33603 - DNA, 21 bp, Artificial sequence
  SiRNA target sequence
aatcaaaatgcaacaacatat

SEQ ID NO: 33604 - DNA, 21 bp, Artificial sequence
  SiRNA target sequence
atcaaaatgcaacaacatatt

SEQ ID NO: 33605 - DNA, 21 bp, Artificial sequence
  SiRNA target sequence
tcaaaatgcaacaacatattg

SEQ ID NO: 33606 - DNA, 21 bp, Artificial sequence
  SiRNA target sequence
caaaatgcaacaacatattga

SEQ ID NO: 33607 - DNA, 21 bp, Artificial sequence
  SiRNA target sequence
aaaatgcaacaacatattgat

SEQ ID NO: 33608 - DNA, 21 bp, Artificial sequence
  SiRNA target sequence
aaatgcaacaacatattgata

SEQ ID NO: 33609 - DNA, 21 bp, Artificial sequence
  SiRNA target sequence
aatgcaacaacatattgataa

SEQ ID NO: 33610 - DNA, 21 bp, Artificial sequence
  SiRNA target sequence
atgcaacaacatattgataag

SEQ ID NO: 33611 - DNA, 21 bp, Artificial sequence
  SiRNA target sequence
tgcaacaacatattgataaga

SEQ ID NO: 33612 - DNA, 21 bp, Artificial sequence
  SiRNA target sequence
gcaacaacatattgataagat

SEQ ID NO: 33613 - DNA, 21 bp, Artificial sequence
  SiRNA target sequence
caacaacatattgataagata

SEQ ID NO: 33614 - DNA, 21 bp, Artificial sequence
  SiRNA target sequence
aacaacatattgataagataa

SEQ ID NO: 33615 - DNA, 21 bp, Artificial sequence
  SiRNA target sequence
acaacatattgataagataat

SEQ ID NO: 33616 - DNA, 21 bp, Artificial sequence
  SiRNA target sequence
caacatattgataagataata

SEQ ID NO: 33617 - DNA, 21 bp, Artificial sequence
  SiRNA target sequence
aacatattgataagataatag

SEQ ID NO: 33618 - DNA, 21 bp, Artificial sequence
  SiRNA target sequence
acatattgataagataatagg

SEQ ID NO: 33619 - DNA, 21 bp, Artificial sequence
  SiRNA target sequence
catattgataagataataggg

SEQ ID NO: 33620 - DNA, 21 bp, Artificial sequence
  SiRNA target sequence
atattgataagataatagggc

SEQ ID NO: 33621 - DNA, 21 bp, Artificial sequence
  SiRNA target sequence
tattgataagataatagggca

SEQ ID NO: 33622 - DNA, 21 bp, Artificial sequence
  SiRNA target sequence
attgataagataatagggcag

SEQ ID NO: 33623 - DNA, 21 bp, Artificial sequence
  SiRNA target sequence
ttgataagataatagggcagg

SEQ ID NO: 33624 - DNA, 21 bp, Artificial sequence
  SiRNA target sequence
tgataagataatagggcagga

SEQ ID NO: 33625 - DNA, 21 bp, Artificial sequence
  SiRNA target sequence
gataagataatagggcaggag

SEQ ID NO: 33626 - DNA, 21 bp, Artificial sequence
  SiRNA target sequence
ataagataatagggcaggaga

SEQ ID NO: 33627 - DNA, 21 bp, Artificial sequence
  SiRNA target sequence
taagataatagggcaggagaa

SEQ ID NO: 33628 - DNA, 21 bp, Artificial sequence
  SiRNA target sequence
aagataatagggcaggagaat

SEQ ID NO: 33629 - DNA, 21 bp, Artificial sequence
  SiRNA target sequence
agataatagggcaggagaatg

SEQ ID NO: 33630 - DNA, 21 bp, Artificial sequence
  SiRNA target sequence
gataatagggcaggagaatga

SEQ ID NO: 33631 - DNA, 21 bp, Artificial sequence
  SiRNA target sequence
ataatagggcaggagaatgaa

SEQ ID NO: 33632 - DNA, 21 bp, Artificial sequence
  SiRNA target sequence
taatagggcaggagaatgaag

SEQ ID NO: 33633 - DNA, 21 bp, Artificial sequence
  SiRNA target sequence
aatagggcaggagaatgaaga

SEQ ID NO: 33634 - DNA, 21 bp, Artificial sequence
  SiRNA target sequence
atagggcaggagaatgaagag

SEQ ID NO: 33635 - DNA, 21 bp, Artificial sequence
  SiRNA target sequence
tagggcaggagaatgaagagt

SEQ ID NO: 33636 - DNA, 21 bp, Artificial sequence
  SiRNA target sequence
agggcaggagaatgaagagta

SEQ ID NO: 33637 - DNA, 21 bp, Artificial sequence
  SiRNA target sequence
gggcaggagaatgaagagtat

SEQ ID NO: 33638 - DNA, 21 bp, Artificial sequence
  SiRNA target sequence
ggcaggagaatgaagagtata

SEQ ID NO: 33639 - DNA, 21 bp, Artificial sequence
  SiRNA target sequence
gcaggagaatgaagagtataa

SEQ ID NO: 33640 - DNA, 21 bp, Artificial sequence
  SiRNA target sequence
caggagaatgaagagtataag

SEQ ID NO: 33641 - DNA, 21 bp, Artificial sequence
  SiRNA target sequence
aggagaatgaagagtataaga

SEQ ID NO: 33642 - DNA, 21 bp, Artificial sequence
  SiRNA target sequence
ggagaatgaagagtataagat

SEQ ID NO: 33643 - DNA, 21 bp, Artificial sequence
  SiRNA target sequence
gagaatgaagagtataagatt

SEQ ID NO: 33644 - DNA, 21 bp, Artificial sequence
  SiRNA target sequence
agaatgaagagtataagatta

SEQ ID NO: 33645 - DNA, 21 bp, Artificial sequence
  SiRNA target sequence
gaatgaagagtataagattat

SEQ ID NO: 33646 - DNA, 21 bp, Artificial sequence
  SiRNA target sequence
aatgaagagtataagattata

SEQ ID NO: 33647 - DNA, 21 bp, Artificial sequence
  SiRNA target sequence
atgaagagtataagattataa

SEQ ID NO: 33648 - DNA, 21 bp, Artificial sequence
  SiRNA target sequence
tgaagagtataagattataaa

SEQ ID NO: 33649 - DNA, 21 bp, Artificial sequence
  SiRNA target sequence
gaagagtataagattataaac

SEQ ID NO: 33650 - DNA, 21 bp, Artificial sequence
  SiRNA target sequence
aagagtataagattataaacg

SEQ ID NO: 33651 - DNA, 21 bp, Artificial sequence
  SiRNA target sequence
agagtataagattataaacgt

SEQ ID NO: 33652 - DNA, 21 bp, Artificial sequence
  SiRNA target sequence
gagtataagattataaacgtc

SEQ ID NO: 33653 - DNA, 21 bp, Artificial sequence
  SiRNA target sequence
agtataagattataaacgtca

SEQ ID NO: 33654 - DNA, 21 bp, Artificial sequence
  SiRNA target sequence
gtataagattataaacgtcaa

SEQ ID NO: 33655 - DNA, 21 bp, Artificial sequence
  SiRNA target sequence
tataagattataaacgtcaat

SEQ ID NO: 33656 - DNA, 21 bp, Artificial sequence
  SiRNA target sequence
ataagattataaacgtcaata

SEQ ID NO: 33657 - DNA, 21 bp, Artificial sequence
  SiRNA target sequence
taagattataaacgtcaatat

SEQ ID NO: 33658 - DNA, 21 bp, Artificial sequence
  SiRNA target sequence
aagattataaacgtcaatatg

SEQ ID NO: 33659 - DNA, 21 bp, Artificial sequence
  SiRNA target sequence
agattataaacgtcaatatgc

SEQ ID NO: 33660 - DNA, 21 bp, Artificial sequence
  SiRNA target sequence
gattataaacgtcaatatgca

SEQ ID NO: 33661 - DNA, 21 bp, Artificial sequence
  SiRNA target sequence
attataaacgtcaatatgcag

SEQ ID NO: 33662 - DNA, 21 bp, Artificial sequence
  SiRNA target sequence
ttataaacgtcaatatgcagg

SEQ ID NO: 33663 - DNA, 21 bp, Artificial sequence
  SiRNA target sequence
tataaacgtcaatatgcaggg

SEQ ID NO: 33664 - DNA, 21 bp, Artificial sequence
  SiRNA target sequence
ataaacgtcaatatgcaggga

SEQ ID NO: 33665 - DNA, 21 bp, Artificial sequence
  SiRNA target sequence
taaacgtcaatatgcagggaa

SEQ ID NO: 33666 - DNA, 21 bp, Artificial sequence
  SiRNA target sequence
aaacgtcaatatgcagggaat

SEQ ID NO: 33667 - DNA, 21 bp, Artificial sequence
  SiRNA target sequence
aacgtcaatatgcagggaatc

SEQ ID NO: 33668 - DNA, 21 bp, Artificial sequence
  SiRNA target sequence
acgtcaatatgcagggaatct

SEQ ID NO: 33669 - DNA, 21 bp, Artificial sequence
  SiRNA target sequence
cgtcaatatgcagggaatctt

SEQ ID NO: 33670 - DNA, 21 bp, Artificial sequence
  SiRNA target sequence
gtcaatatgcagggaatcttt

SEQ ID NO: 33671 - DNA, 21 bp, Artificial sequence
  SiRNA target sequence
tcaatatgcagggaatcttta

SEQ ID NO: 33672 - DNA, 21 bp, Artificial sequence
  SiRNA target sequence
caatatgcagggaatctttag

SEQ ID NO: 33673 - DNA, 21 bp, Artificial sequence
  SiRNA target sequence
aatatgcagggaatctttagt

SEQ ID NO: 33674 - DNA, 21 bp, Artificial sequence
  SiRNA target sequence
atatgcagggaatctttagtt

SEQ ID NO: 33675 - DNA, 21 bp, Artificial sequence
  SiRNA target sequence
tatgcagggaatctttagttt

SEQ ID NO: 33676 - DNA, 21 bp, Artificial sequence
  SiRNA target sequence
atgcagggaatctttagtttt

SEQ ID NO: 33677 - DNA, 21 bp, Artificial sequence
  SiRNA target sequence
tgcagggaatctttagtttta

SEQ ID NO: 33678 - DNA, 21 bp, Artificial sequence
  SiRNA target sequence
gcagggaatctttagttttaa

SEQ ID NO: 33679 - DNA, 21 bp, Artificial sequence
  SiRNA target sequence
cagggaatctttagttttaat

SEQ ID NO: 33680 - DNA, 21 bp, Artificial sequence
  SiRNA target sequence
agggaatctttagttttaatg

SEQ ID NO: 33681 - DNA, 21 bp, Artificial sequence
  SiRNA target sequence
gggaatctttagttttaatga

SEQ ID NO: 33682 - DNA, 21 bp, Artificial sequence
  SiRNA target sequence
ggaatctttagttttaatgaa

SEQ ID NO: 33683 - DNA, 21 bp, Artificial sequence
  SiRNA target sequence
gaatctttagttttaatgaag

SEQ ID NO: 33684 - DNA, 21 bp, Artificial sequence
  SiRNA target sequence
aatctttagttttaatgaaga

SEQ ID NO: 33685 - DNA, 21 bp, Artificial sequence
  SiRNA target sequence
atctttagttttaatgaagaa

SEQ ID NO: 33686 - DNA, 21 bp, Artificial sequence
  SiRNA target sequence
tctttagttttaatgaagaaa

SEQ ID NO: 33687 - DNA, 21 bp, Artificial sequence
  SiRNA target sequence
ctttagttttaatgaagaaaa

SEQ ID NO: 33688 - DNA, 21 bp, Artificial sequence
  SiRNA target sequence
tttagttttaatgaagaaaaa

SEQ ID NO: 33689 - DNA, 21 bp, Artificial sequence
  SiRNA target sequence
ttagttttaatgaagaaaaag

SEQ ID NO: 33690 - DNA, 21 bp, Artificial sequence
  SiRNA target sequence
tagttttaatgaagaaaaaga

SEQ ID NO: 33691 - DNA, 21 bp, Artificial sequence
  SiRNA target sequence
agttttaatgaagaaaaagaa

SEQ ID NO: 33692 - DNA, 21 bp, Artificial sequence
  SiRNA target sequence
gttttaatgaagaaaaagaaa

SEQ ID NO: 33693 - DNA, 21 bp, Artificial sequence
  SiRNA target sequence
ttttaatgaagaaaaagaaat

SEQ ID NO: 33694 - DNA, 21 bp, Artificial sequence
  SiRNA target sequence
tttaatgaagaaaaagaaata

SEQ ID NO: 33695 - DNA, 21 bp, Artificial sequence
  SiRNA target sequence
ttaatgaagaaaaagaaataa

SEQ ID NO: 33696 - DNA, 21 bp, Artificial sequence
  SiRNA target sequence
taatgaagaaaaagaaataat

SEQ ID NO: 33697 - DNA, 21 bp, Artificial sequence
  SiRNA target sequence
aatgaagaaaaagaaataatt

SEQ ID NO: 33698 - DNA, 21 bp, Artificial sequence
  SiRNA target sequence
atgaagaaaaagaaataatta

SEQ ID NO: 33699 - DNA, 21 bp, Artificial sequence
  SiRNA target sequence
tgaagaaaaagaaataattaa

SEQ ID NO: 33700 - DNA, 21 bp, Artificial sequence
  SiRNA target sequence
gaagaaaaagaaataattaaa

SEQ ID NO: 33701 - DNA, 21 bp, Artificial sequence
  SiRNA target sequence
aagaaaaagaaataattaaaa

SEQ ID NO: 33702 - DNA, 21 bp, Artificial sequence
  SiRNA target sequence
agaaaaagaaataattaaaag

SEQ ID NO: 33703 - DNA, 21 bp, Artificial sequence
  SiRNA target sequence
gaaaaagaaataattaaaagt

SEQ ID NO: 33704 - DNA, 21 bp, Artificial sequence
  SiRNA target sequence
aaaaagaaataattaaaagta

SEQ ID NO: 33705 - DNA, 21 bp, Artificial sequence
  SiRNA target sequence
aaaagaaataattaaaagtac

SEQ ID NO: 33706 - DNA, 21 bp, Artificial sequence
  SiRNA target sequence
aaagaaataattaaaagtacg

SEQ ID NO: 33707 - DNA, 21 bp, Artificial sequence
  SiRNA target sequence
aagaaataattaaaagtacgg

SEQ ID NO: 33708 - DNA, 21 bp, Artificial sequence
  SiRNA target sequence
agaaataattaaaagtacggc

SEQ ID NO: 33709 - DNA, 21 bp, Artificial sequence
  SiRNA target sequence
gaaataattaaaagtacggct

SEQ ID NO: 33710 - DNA, 21 bp, Artificial sequence
  SiRNA target sequence
aaataattaaaagtacggctt

SEQ ID NO: 33711 - DNA, 21 bp, Artificial sequence
  SiRNA target sequence
aataattaaaagtacggcttg

SEQ ID NO: 33712 - DNA, 21 bp, Artificial sequence
  SiRNA target sequence
ataattaaaagtacggcttgg

SEQ ID NO: 33713 - DNA, 21 bp, Artificial sequence
  SiRNA target sequence
taattaaaagtacggcttgga

SEQ ID NO: 33714 - DNA, 21 bp, Artificial sequence
  SiRNA target sequence
aattaaaagtacggcttggaa

SEQ ID NO: 33715 - DNA, 21 bp, Artificial sequence
  SiRNA target sequence
attaaaagtacggcttggaaa

SEQ ID NO: 33716 - DNA, 21 bp, Artificial sequence
  SiRNA target sequence
ttaaaagtacggcttggaaat

SEQ ID NO: 33717 - DNA, 21 bp, Artificial sequence
  SiRNA target sequence
taaaagtacggcttggaaatt

SEQ ID NO: 33718 - DNA, 21 bp, Artificial sequence
  SiRNA target sequence
aaaagtacggcttggaaattc

SEQ ID NO: 33719 - DNA, 21 bp, Artificial sequence
  SiRNA target sequence
aaagtacggcttggaaattca

SEQ ID NO: 33720 - DNA, 21 bp, Artificial sequence
  SiRNA target sequence
aagtacggcttggaaattcaa

SEQ ID NO: 33721 - DNA, 21 bp, Artificial sequence
  SiRNA target sequence
agtacggcttggaaattcaat

SEQ ID NO: 33722 - DNA, 21 bp, Artificial sequence
  SiRNA target sequence
gtacggcttggaaattcaata

SEQ ID NO: 33723 - DNA, 21 bp, Artificial sequence
  SiRNA target sequence
tacggcttggaaattcaatag

SEQ ID NO: 33724 - DNA, 21 bp, Artificial sequence
  SiRNA target sequence
acggcttggaaattcaatagc

SEQ ID NO: 33725 - DNA, 21 bp, Artificial sequence
  SiRNA target sequence
cggcttggaaattcaatagca

SEQ ID NO: 33726 - DNA, 21 bp, Artificial sequence
  SiRNA target sequence
ggcttggaaattcaatagcac

SEQ ID NO: 33727 - DNA, 21 bp, Artificial sequence
  SiRNA target sequence
gcttggaaattcaatagcact

SEQ ID NO: 33728 - DNA, 21 bp, Artificial sequence
  SiRNA target sequence
cttggaaattcaatagcactc

SEQ ID NO: 33729 - DNA, 21 bp, Artificial sequence
  SiRNA target sequence
ttggaaattcaatagcactct

SEQ ID NO: 33730 - DNA, 21 bp, Artificial sequence
  SiRNA target sequence
tggaaattcaatagcactcta

SEQ ID NO: 33731 - DNA, 21 bp, Artificial sequence
  SiRNA target sequence
ggaaattcaatagcactctag

SEQ ID NO: 33732 - DNA, 21 bp, Artificial sequence
  SiRNA target sequence
gaaattcaatagcactctaga

SEQ ID NO: 33733 - DNA, 21 bp, Artificial sequence
  SiRNA target sequence
aaattcaatagcactctagac

SEQ ID NO: 33734 - DNA, 21 bp, Artificial sequence
  SiRNA target sequence
aattcaatagcactctagaca

SEQ ID NO: 33735 - DNA, 21 bp, Artificial sequence
  SiRNA target sequence
attcaatagcactctagacaa

SEQ ID NO: 33736 - DNA, 21 bp, Artificial sequence
  SiRNA target sequence
ttcaatagcactctagacaaa

SEQ ID NO: 33737 - DNA, 21 bp, Artificial sequence
  SiRNA target sequence
tcaatagcactctagacaaaa

SEQ ID NO: 33738 - DNA, 21 bp, Artificial sequence
  SiRNA target sequence
caatagcactctagacaaaac

SEQ ID NO: 33739 - DNA, 21 bp, Artificial sequence
  SiRNA target sequence
aatagcactctagacaaaaca

SEQ ID NO: 33740 - DNA, 21 bp, Artificial sequence
  SiRNA target sequence
atagcactctagacaaaacaa

SEQ ID NO: 33741 - DNA, 21 bp, Artificial sequence
  SiRNA target sequence
tagcactctagacaaaacaaa

SEQ ID NO: 33742 - DNA, 21 bp, Artificial sequence
  SiRNA target sequence
agcactctagacaaaacaaat

SEQ ID NO: 33743 - DNA, 21 bp, Artificial sequence
  SiRNA target sequence
gcactctagacaaaacaaatt

SEQ ID NO: 33744 - DNA, 21 bp, Artificial sequence
  SiRNA target sequence
cactctagacaaaacaaattc

SEQ ID NO: 33745 - DNA, 21 bp, Artificial sequence
  SiRNA target sequence
actctagacaaaacaaattct

SEQ ID NO: 33746 - DNA, 21 bp, Artificial sequence
  SiRNA target sequence
ctctagacaaaacaaattcta

SEQ ID NO: 33747 - DNA, 21 bp, Artificial sequence
  SiRNA target sequence
tctagacaaaacaaattctat

SEQ ID NO: 33748 - DNA, 21 bp, Artificial sequence
  SiRNA target sequence
ctagacaaaacaaattctata

SEQ ID NO: 33749 - DNA, 21 bp, Artificial sequence
  SiRNA target sequence
tagacaaaacaaattctataa

SEQ ID NO: 33750 - DNA, 21 bp, Artificial sequence
  SiRNA target sequence
agacaaaacaaattctataat

SEQ ID NO: 33751 - DNA, 21 bp, Artificial sequence
  SiRNA target sequence
gacaaaacaaattctataata

SEQ ID NO: 33752 - DNA, 21 bp, Artificial sequence
  SiRNA target sequence
acaaaacaaattctataatag

SEQ ID NO: 33753 - DNA, 21 bp, Artificial sequence
  SiRNA target sequence
caaaacaaattctataataga

SEQ ID NO: 33754 - DNA, 21 bp, Artificial sequence
  SiRNA target sequence
aaaacaaattctataatagac

SEQ ID NO: 33755 - DNA, 21 bp, Artificial sequence
  SiRNA target sequence
aaacaaattctataatagaca

SEQ ID NO: 33756 - DNA, 21 bp, Artificial sequence
  SiRNA target sequence
aacaaattctataatagacaa

SEQ ID NO: 33757 - DNA, 21 bp, Artificial sequence
  SiRNA target sequence
acaaattctataatagacaat

SEQ ID NO: 33758 - DNA, 21 bp, Artificial sequence
  SiRNA target sequence
caaattctataatagacaatt

SEQ ID NO: 33759 - DNA, 21 bp, Artificial sequence
  SiRNA target sequence
aaattctataatagacaattt

SEQ ID NO: 33760 - DNA, 21 bp, Artificial sequence
  SiRNA target sequence
aattctataatagacaattta

SEQ ID NO: 33761 - DNA, 21 bp, Artificial sequence
  SiRNA target sequence
attctataatagacaatttaa

SEQ ID NO: 33762 - DNA, 21 bp, Artificial sequence
  SiRNA target sequence
ttctataatagacaatttaat

SEQ ID NO: 33763 - DNA, 21 bp, Artificial sequence
  SiRNA target sequence
tctataatagacaatttaata

SEQ ID NO: 33764 - DNA, 21 bp, Artificial sequence
  SiRNA target sequence
ctataatagacaatttaatac

SEQ ID NO: 33765 - DNA, 21 bp, Artificial sequence
  SiRNA target sequence
tataatagacaatttaatacc

SEQ ID NO: 33766 - DNA, 21 bp, Artificial sequence
  SiRNA target sequence
ataatagacaatttaataccc

SEQ ID NO: 33767 - DNA, 21 bp, Artificial sequence
  SiRNA target sequence
taatagacaatttaatacccc

SEQ ID NO: 33768 - DNA, 21 bp, Artificial sequence
  SiRNA target sequence
aatagacaatttaatacccca

SEQ ID NO: 33769 - DNA, 21 bp, Artificial sequence
  SiRNA target sequence
atagacaatttaataccccaa

SEQ ID NO: 33770 - DNA, 21 bp, Artificial sequence
  SiRNA target sequence
tagacaatttaataccccaat

SEQ ID NO: 33771 - DNA, 21 bp, Artificial sequence
  SiRNA target sequence
agacaatttaataccccaatt

SEQ ID NO: 33772 - DNA, 21 bp, Artificial sequence
  SiRNA target sequence
gacaatttaataccccaatta

SEQ ID NO: 33773 - DNA, 21 bp, Artificial sequence
  SiRNA target sequence
acaatttaataccccaattag

SEQ ID NO: 33774 - DNA, 21 bp, Artificial sequence
  SiRNA target sequence
caatttaataccccaattaga

SEQ ID NO: 33775 - DNA, 21 bp, Artificial sequence
  SiRNA target sequence
aatttaataccccaattagaa

SEQ ID NO: 33776 - DNA, 21 bp, Artificial sequence
  SiRNA target sequence
atttaataccccaattagaag

SEQ ID NO: 33777 - DNA, 21 bp, Artificial sequence
  SiRNA target sequence
tttaataccccaattagaaga

SEQ ID NO: 33778 - DNA, 21 bp, Artificial sequence
  SiRNA target sequence
ttaataccccaattagaagaa

SEQ ID NO: 33779 - DNA, 21 bp, Artificial sequence
  SiRNA target sequence
taataccccaattagaagaaa

SEQ ID NO: 33780 - DNA, 21 bp, Artificial sequence
  SiRNA target sequence
aataccccaattagaagaaac

SEQ ID NO: 33781 - DNA, 21 bp, Artificial sequence
  SiRNA target sequence
ataccccaattagaagaaact

SEQ ID NO: 33782 - DNA, 21 bp, Artificial sequence
  SiRNA target sequence
taccccaattagaagaaactt

SEQ ID NO: 33783 - DNA, 21 bp, Artificial sequence
  SiRNA target sequence
accccaattagaagaaacttt

SEQ ID NO: 33784 - DNA, 21 bp, Artificial sequence
  SiRNA target sequence
ccccaattagaagaaacttta

SEQ ID NO: 33785 - DNA, 21 bp, Artificial sequence
  SiRNA target sequence
cccaattagaagaaactttag

SEQ ID NO: 33786 - DNA, 21 bp, Artificial sequence
  SiRNA target sequence
ccaattagaagaaactttagc

SEQ ID NO: 33787 - DNA, 21 bp, Artificial sequence
  SiRNA target sequence
caattagaagaaactttagca

SEQ ID NO: 33788 - DNA, 21 bp, Artificial sequence
  SiRNA target sequence
aattagaagaaactttagcag

SEQ ID NO: 33789 - DNA, 21 bp, Artificial sequence
  SiRNA target sequence
attagaagaaactttagcagg

SEQ ID NO: 33790 - DNA, 21 bp, Artificial sequence
  SiRNA target sequence
ttagaagaaactttagcaggt

SEQ ID NO: 33791 - DNA, 21 bp, Artificial sequence
  SiRNA target sequence
tagaagaaactttagcaggtt

SEQ ID NO: 33792 - DNA, 21 bp, Artificial sequence
  SiRNA target sequence
agaagaaactttagcaggttt

SEQ ID NO: 33793 - DNA, 21 bp, Artificial sequence
  SiRNA target sequence
gaagaaactttagcaggtttc

SEQ ID NO: 33794 - DNA, 21 bp, Artificial sequence
  SiRNA target sequence
aagaaactttagcaggtttca

SEQ ID NO: 33795 - DNA, 21 bp, Artificial sequence
  SiRNA target sequence
agaaactttagcaggtttcag

SEQ ID NO: 33796 - DNA, 21 bp, Artificial sequence
  SiRNA target sequence
gaaactttagcaggtttcaga

SEQ ID NO: 33797 - DNA, 21 bp, Artificial sequence
  SiRNA target sequence
aaactttagcaggtttcagaa

SEQ ID NO: 33798 - DNA, 21 bp, Artificial sequence
  SiRNA target sequence
aactttagcaggtttcagaaa

SEQ ID NO: 33799 - DNA, 21 bp, Artificial sequence
  SiRNA target sequence
actttagcaggtttcagaaaa

SEQ ID NO: 33800 - DNA, 21 bp, Artificial sequence
  SiRNA target sequence
ctttagcaggtttcagaaaaa

SEQ ID NO: 33801 - DNA, 21 bp, Artificial sequence
  SiRNA target sequence
tttagcaggtttcagaaaaac

SEQ ID NO: 33802 - DNA, 21 bp, Artificial sequence
  SiRNA target sequence
ttagcaggtttcagaaaaaca

SEQ ID NO: 33803 - DNA, 21 bp, Artificial sequence
  SiRNA target sequence
tagcaggtttcagaaaaacat

SEQ ID NO: 33804 - DNA, 21 bp, Artificial sequence
  SiRNA target sequence
agcaggtttcagaaaaacata

SEQ ID NO: 33805 - DNA, 21 bp, Artificial sequence
  SiRNA target sequence
gcaggtttcagaaaaacatat

SEQ ID NO: 33806 - DNA, 21 bp, Artificial sequence
  SiRNA target sequence
caggtttcagaaaaacatatt

SEQ ID NO: 33807 - DNA, 21 bp, Artificial sequence
  SiRNA target sequence
aggtttcagaaaaacatattc

SEQ ID NO: 33808 - DNA, 21 bp, Artificial sequence
  SiRNA target sequence
ggtttcagaaaaacatattca

SEQ ID NO: 33809 - DNA, 21 bp, Artificial sequence
  SiRNA target sequence
gtttcagaaaaacatattcaa

SEQ ID NO: 33810 - DNA, 21 bp, Artificial sequence
  SiRNA target sequence
tttcagaaaaacatattcaaa

SEQ ID NO: 33811 - DNA, 21 bp, Artificial sequence
  SiRNA target sequence
ttcagaaaaacatattcaaaa

SEQ ID NO: 33812 - DNA, 21 bp, Artificial sequence
  SiRNA target sequence
tcagaaaaacatattcaaaat

SEQ ID NO: 33813 - DNA, 21 bp, Artificial sequence
  SiRNA target sequence
cagaaaaacatattcaaaatg

SEQ ID NO: 33814 - DNA, 21 bp, Artificial sequence
  SiRNA target sequence
agaaaaacatattcaaaatgt

SEQ ID NO: 33815 - DNA, 21 bp, Artificial sequence
  SiRNA target sequence
gaaaaacatattcaaaatgtg

SEQ ID NO: 33816 - DNA, 21 bp, Artificial sequence
  SiRNA target sequence
aaaaacatattcaaaatgtga

SEQ ID NO: 33817 - DNA, 21 bp, Artificial sequence
  SiRNA target sequence
aaaacatattcaaaatgtgaa

SEQ ID NO: 33818 - DNA, 21 bp, Artificial sequence
  SiRNA target sequence
aaacatattcaaaatgtgaat

SEQ ID NO: 33819 - DNA, 21 bp, Artificial sequence
  SiRNA target sequence
aacatattcaaaatgtgaatc

SEQ ID NO: 33820 - DNA, 21 bp, Artificial sequence
  SiRNA target sequence
acatattcaaaatgtgaatca

SEQ ID NO: 33821 - DNA, 21 bp, Artificial sequence
  SiRNA target sequence
catattcaaaatgtgaatcaa

SEQ ID NO: 33822 - DNA, 21 bp, Artificial sequence
  SiRNA target sequence
atattcaaaatgtgaatcaaa

SEQ ID NO: 33823 - DNA, 21 bp, Artificial sequence
  SiRNA target sequence
tattcaaaatgtgaatcaaaa

SEQ ID NO: 33824 - DNA, 21 bp, Artificial sequence
  SiRNA target sequence
attcaaaatgtgaatcaaaaa

SEQ ID NO: 33825 - DNA, 21 bp, Artificial sequence
  SiRNA target sequence
ttcaaaatgtgaatcaaaaat

SEQ ID NO: 33826 - DNA, 21 bp, Artificial sequence
  SiRNA target sequence
tcaaaatgtgaatcaaaaatt

SEQ ID NO: 33827 - DNA, 21 bp, Artificial sequence
  SiRNA target sequence
caaaatgtgaatcaaaaattt

SEQ ID NO: 33828 - DNA, 21 bp, Artificial sequence
  SiRNA target sequence
aaaatgtgaatcaaaaatttt

SEQ ID NO: 33829 - DNA, 21 bp, Artificial sequence
  SiRNA target sequence
aaatgtgaatcaaaaattttt

SEQ ID NO: 33830 - DNA, 21 bp, Artificial sequence
  SiRNA target sequence
aatgtgaatcaaaaatttttg

SEQ ID NO: 33831 - DNA, 21 bp, Artificial sequence
  SiRNA target sequence
atgtgaatcaaaaatttttgg

SEQ ID NO: 33832 - DNA, 21 bp, Artificial sequence
  SiRNA target sequence
tgtgaatcaaaaatttttggt

SEQ ID NO: 33833 - DNA, 21 bp, Artificial sequence
  SiRNA target sequence
gtgaatcaaaaatttttggta

SEQ ID NO: 33834 - DNA, 21 bp, Artificial sequence
  SiRNA target sequence
tgaatcaaaaatttttggtac

SEQ ID NO: 33835 - DNA, 21 bp, Artificial sequence
  SiRNA target sequence
gaatcaaaaatttttggtact

SEQ ID NO: 33836 - DNA, 21 bp, Artificial sequence
  SiRNA target sequence
aatcaaaaatttttggtacta

SEQ ID NO: 33837 - DNA, 21 bp, Artificial sequence
  SiRNA target sequence
atcaaaaatttttggtactat

SEQ ID NO: 33838 - DNA, 21 bp, Artificial sequence
  SiRNA target sequence
tcaaaaatttttggtactata

SEQ ID NO: 33839 - DNA, 21 bp, Artificial sequence
  SiRNA target sequence
caaaaatttttggtactataa

SEQ ID NO: 33840 - DNA, 21 bp, Artificial sequence
  SiRNA target sequence
aaaaatttttggtactataag

SEQ ID NO: 33841 - DNA, 21 bp, Artificial sequence
  SiRNA target sequence
aaaatttttggtactataagt

SEQ ID NO: 33842 - DNA, 21 bp, Artificial sequence
  SiRNA target sequence
aaatttttggtactataagtg

SEQ ID NO: 33843 - DNA, 21 bp, Artificial sequence
  SiRNA target sequence
aatttttggtactataagtgt

SEQ ID NO: 33844 - DNA, 21 bp, Artificial sequence
  SiRNA target sequence
atttttggtactataagtgtg

SEQ ID NO: 33845 - DNA, 21 bp, Artificial sequence
  SiRNA target sequence
tttttggtactataagtgtgg

SEQ ID NO: 33846 - DNA, 21 bp, Artificial sequence
  SiRNA target sequence
ttttggtactataagtgtggt

SEQ ID NO: 33847 - DNA, 21 bp, Artificial sequence
  SiRNA target sequence
tttggtactataagtgtggtt

SEQ ID NO: 33848 - DNA, 21 bp, Artificial sequence
  SiRNA target sequence
ttggtactataagtgtggttg

SEQ ID NO: 33849 - DNA, 21 bp, Artificial sequence
  SiRNA target sequence
tggtactataagtgtggttga

SEQ ID NO: 33850 - DNA, 21 bp, Artificial sequence
  SiRNA target sequence
ggtactataagtgtggttgat

SEQ ID NO: 33851 - DNA, 21 bp, Artificial sequence
  SiRNA target sequence
gtactataagtgtggttgatg

SEQ ID NO: 33852 - DNA, 21 bp, Artificial sequence
  SiRNA target sequence
tactataagtgtggttgatgt

SEQ ID NO: 33853 - DNA, 21 bp, Artificial sequence
  SiRNA target sequence
actataagtgtggttgatgtg

SEQ ID NO: 33854 - DNA, 21 bp, Artificial sequence
  SiRNA target sequence
ctataagtgtggttgatgtgt

SEQ ID NO: 33855 - DNA, 21 bp, Artificial sequence
  SiRNA target sequence
tataagtgtggttgatgtgtg

SEQ ID NO: 33856 - DNA, 21 bp, Artificial sequence
  SiRNA target sequence
ataagtgtggttgatgtgtgt

SEQ ID NO: 33857 - DNA, 21 bp, Artificial sequence
  SiRNA target sequence
taagtgtggttgatgtgtgtg

SEQ ID NO: 33858 - DNA, 21 bp, Artificial sequence
  SiRNA target sequence
aagtgtggttgatgtgtgtgt

SEQ ID NO: 33859 - DNA, 21 bp, Artificial sequence
  SiRNA target sequence
agtgtggttgatgtgtgtgta

SEQ ID NO: 33860 - DNA, 21 bp, Artificial sequence
  SiRNA target sequence
gtgtggttgatgtgtgtgtag

SEQ ID NO: 33861 - DNA, 21 bp, Artificial sequence
  SiRNA target sequence
tgtggttgatgtgtgtgtaga

SEQ ID NO: 33862 - DNA, 21 bp, Artificial sequence
  SiRNA target sequence
gtggttgatgtgtgtgtagat

SEQ ID NO: 33863 - DNA, 21 bp, Artificial sequence
  SiRNA target sequence
tggttgatgtgtgtgtagatt

SEQ ID NO: 33864 - DNA, 21 bp, Artificial sequence
  SiRNA target sequence
ggttgatgtgtgtgtagattt

SEQ ID NO: 33865 - DNA, 21 bp, Artificial sequence
  SiRNA target sequence
gttgatgtgtgtgtagatttg

SEQ ID NO: 33866 - DNA, 21 bp, Artificial sequence
  SiRNA target sequence
ttgatgtgtgtgtagatttga

SEQ ID NO: 33867 - DNA, 21 bp, Artificial sequence
  SiRNA target sequence
tgatgtgtgtgtagatttgat

SEQ ID NO: 33868 - DNA, 21 bp, Artificial sequence
  SiRNA target sequence
gatgtgtgtgtagatttgatt

SEQ ID NO: 33869 - DNA, 21 bp, Artificial sequence
  SiRNA target sequence
atgtgtgtgtagatttgatta

SEQ ID NO: 33870 - DNA, 21 bp, Artificial sequence
  SiRNA target sequence
tgtgtgtgtagatttgattag

SEQ ID NO: 33871 - DNA, 21 bp, Artificial sequence
  SiRNA target sequence
gtgtgtgtagatttgattagt

SEQ ID NO: 33872 - DNA, 21 bp, Artificial sequence
  SiRNA target sequence
tgtgtgtagatttgattagtg

SEQ ID NO: 33873 - DNA, 21 bp, Artificial sequence
  SiRNA target sequence
gtgtgtagatttgattagtgc

SEQ ID NO: 33874 - DNA, 21 bp, Artificial sequence
  SiRNA target sequence
tgtgtagatttgattagtgct

SEQ ID NO: 33875 - DNA, 21 bp, Artificial sequence
  SiRNA target sequence
gtgtagatttgattagtgctt

SEQ ID NO: 33876 - DNA, 21 bp, Artificial sequence
  SiRNA target sequence
tgtagatttgattagtgcttt

SEQ ID NO: 33877 - DNA, 21 bp, Artificial sequence
  SiRNA target sequence
gtagatttgattagtgcttta

SEQ ID NO: 33878 - DNA, 21 bp, Artificial sequence
  SiRNA target sequence
tagatttgattagtgctttat

SEQ ID NO: 33879 - DNA, 21 bp, Artificial sequence
  SiRNA target sequence
agatttgattagtgctttatt

SEQ ID NO: 33880 - DNA, 21 bp, Artificial sequence
  SiRNA target sequence
gatttgattagtgctttatta

SEQ ID NO: 33881 - DNA, 21 bp, Artificial sequence
  SiRNA target sequence
atttgattagtgctttattac

SEQ ID NO: 33882 - DNA, 21 bp, Artificial sequence
  SiRNA target sequence
tttgattagtgctttattaca

SEQ ID NO: 33883 - DNA, 21 bp, Artificial sequence
  SiRNA target sequence
ttgattagtgctttattacaa

SEQ ID NO: 33884 - DNA, 21 bp, Artificial sequence
  SiRNA target sequence
tgattagtgctttattacaag

SEQ ID NO: 33885 - DNA, 21 bp, Artificial sequence
  SiRNA target sequence
gattagtgctttattacaagt

SEQ ID NO: 33886 - DNA, 21 bp, Artificial sequence
  SiRNA target sequence
attagtgctttattacaagtt

SEQ ID NO: 33887 - DNA, 21 bp, Artificial sequence
  SiRNA target sequence
ttagtgctttattacaagtta

SEQ ID NO: 33888 - DNA, 21 bp, Artificial sequence
  SiRNA target sequence
tagtgctttattacaagttag

SEQ ID NO: 33889 - DNA, 21 bp, Artificial sequence
  SiRNA target sequence
agtgctttattacaagttagt

SEQ ID NO: 33890 - DNA, 21 bp, Artificial sequence
  SiRNA target sequence
gtgctttattacaagttagtt

SEQ ID NO: 33891 - DNA, 21 bp, Artificial sequence
  SiRNA target sequence
tgctttattacaagttagttt

SEQ ID NO: 33892 - DNA, 21 bp, Artificial sequence
  SiRNA target sequence
gctttattacaagttagtttt

SEQ ID NO: 33893 - DNA, 21 bp, Artificial sequence
  SiRNA target sequence
ctttattacaagttagttttg

SEQ ID NO: 33894 - DNA, 21 bp, Artificial sequence
  SiRNA target sequence
tttattacaagttagttttgc

SEQ ID NO: 33895 - DNA, 21 bp, Artificial sequence
  SiRNA target sequence
ttattacaagttagttttgct

SEQ ID NO: 33896 - DNA, 21 bp, Artificial sequence
  SiRNA target sequence
tattacaagttagttttgcta

SEQ ID NO: 33897 - DNA, 21 bp, Artificial sequence
  SiRNA target sequence
attacaagttagttttgctaa

SEQ ID NO: 33898 - DNA, 21 bp, Artificial sequence
  SiRNA target sequence
ttacaagttagttttgctaaa

SEQ ID NO: 33899 - DNA, 21 bp, Artificial sequence
  SiRNA target sequence
tacaagttagttttgctaaac

SEQ ID NO: 33900 - DNA, 21 bp, Artificial sequence
  SiRNA target sequence
acaagttagttttgctaaacc

SEQ ID NO: 33901 - DNA, 21 bp, Artificial sequence
  SiRNA target sequence
caagttagttttgctaaacca

SEQ ID NO: 33902 - DNA, 21 bp, Artificial sequence
  SiRNA target sequence
aagttagttttgctaaaccag

SEQ ID NO: 33903 - DNA, 21 bp, Artificial sequence
  SiRNA target sequence
agttagttttgctaaaccagc

SEQ ID NO: 33904 - DNA, 21 bp, Artificial sequence
  SiRNA target sequence
gttagttttgctaaaccagca

SEQ ID NO: 33905 - DNA, 21 bp, Artificial sequence
  SiRNA target sequence
ttagttttgctaaaccagcaa

SEQ ID NO: 33906 - DNA, 21 bp, Artificial sequence
  SiRNA target sequence
tagttttgctaaaccagcaat

SEQ ID NO: 33907 - DNA, 21 bp, Artificial sequence
  SiRNA target sequence
agttttgctaaaccagcaatg

SEQ ID NO: 33908 - DNA, 21 bp, Artificial sequence
  SiRNA target sequence
gttttgctaaaccagcaatga

SEQ ID NO: 33909 - DNA, 21 bp, Artificial sequence
  SiRNA target sequence
ttttgctaaaccagcaatgaa

SEQ ID NO: 33910 - DNA, 21 bp, Artificial sequence
  SiRNA target sequence
tttgctaaaccagcaatgaag

SEQ ID NO: 33911 - DNA, 21 bp, Artificial sequence
  SiRNA target sequence
ttgctaaaccagcaatgaaga

SEQ ID NO: 33912 - DNA, 21 bp, Artificial sequence
  SiRNA target sequence
tgctaaaccagcaatgaagat

SEQ ID NO: 33913 - DNA, 21 bp, Artificial sequence
  SiRNA target sequence
gctaaaccagcaatgaagata

SEQ ID NO: 33914 - DNA, 21 bp, Artificial sequence
  SiRNA target sequence
ctaaaccagcaatgaagatag

SEQ ID NO: 33915 - DNA, 21 bp, Artificial sequence
  SiRNA target sequence
taaaccagcaatgaagatagc

SEQ ID NO: 33916 - DNA, 21 bp, Artificial sequence
  SiRNA target sequence
aaaccagcaatgaagatagct

SEQ ID NO: 33917 - DNA, 21 bp, Artificial sequence
  SiRNA target sequence
aaccagcaatgaagatagctt

SEQ ID NO: 33918 - DNA, 21 bp, Artificial sequence
  SiRNA target sequence
accagcaatgaagatagcttc

SEQ ID NO: 33919 - DNA, 21 bp, Artificial sequence
  SiRNA target sequence
ccagcaatgaagatagcttca

SEQ ID NO: 33920 - DNA, 21 bp, Artificial sequence
  SiRNA target sequence
cagcaatgaagatagcttcat

SEQ ID NO: 33921 - DNA, 21 bp, Artificial sequence
  SiRNA target sequence
agcaatgaagatagcttcatt

SEQ ID NO: 33922 - DNA, 21 bp, Artificial sequence
  SiRNA target sequence
gcaatgaagatagcttcatta

SEQ ID NO: 33923 - DNA, 21 bp, Artificial sequence
  SiRNA target sequence
caatgaagatagcttcattag

SEQ ID NO: 33924 - DNA, 21 bp, Artificial sequence
  SiRNA target sequence
aatgaagatagcttcattagc

SEQ ID NO: 33925 - DNA, 21 bp, Artificial sequence
  SiRNA target sequence
atgaagatagcttcattagca

SEQ ID NO: 33926 - DNA, 21 bp, Artificial sequence
  SiRNA target sequence
tgaagatagcttcattagcag

SEQ ID NO: 33927 - DNA, 21 bp, Artificial sequence
  SiRNA target sequence
gaagatagcttcattagcagt

SEQ ID NO: 33928 - DNA, 21 bp, Artificial sequence
  SiRNA target sequence
aagatagcttcattagcagta

SEQ ID NO: 33929 - DNA, 21 bp, Artificial sequence
  SiRNA target sequence
agatagcttcattagcagtag

SEQ ID NO: 33930 - DNA, 21 bp, Artificial sequence
  SiRNA target sequence
gatagcttcattagcagtaga

SEQ ID NO: 33931 - DNA, 21 bp, Artificial sequence
  SiRNA target sequence
atagcttcattagcagtagaa

SEQ ID NO: 33932 - DNA, 21 bp, Artificial sequence
  SiRNA target sequence
tagcttcattagcagtagaag

SEQ ID NO: 33933 - DNA, 21 bp, Artificial sequence
  SiRNA target sequence
agcttcattagcagtagaagt

SEQ ID NO: 33934 - DNA, 21 bp, Artificial sequence
  SiRNA target sequence
gcttcattagcagtagaagtt

SEQ ID NO: 33935 - DNA, 21 bp, Artificial sequence
  SiRNA target sequence
cttcattagcagtagaagttt

SEQ ID NO: 33936 - DNA, 21 bp, Artificial sequence
  SiRNA target sequence
ttcattagcagtagaagtttt

SEQ ID NO: 33937 - DNA, 21 bp, Artificial sequence
  SiRNA target sequence
tcattagcagtagaagttttt

SEQ ID NO: 33938 - DNA, 21 bp, Artificial sequence
  SiRNA target sequence
cattagcagtagaagttttta

SEQ ID NO: 33939 - DNA, 21 bp, Artificial sequence
  SiRNA target sequence
attagcagtagaagtttttag

SEQ ID NO: 33940 - DNA, 21 bp, Artificial sequence
  SiRNA target sequence
ttagcagtagaagtttttaga

SEQ ID NO: 33941 - DNA, 21 bp, Artificial sequence
  SiRNA target sequence
tagcagtagaagtttttagat

SEQ ID NO: 33942 - DNA, 21 bp, Artificial sequence
  SiRNA target sequence
agcagtagaagtttttagatt

SEQ ID NO: 33943 - DNA, 21 bp, Artificial sequence
  SiRNA target sequence
gcagtagaagtttttagatta

SEQ ID NO: 33944 - DNA, 21 bp, Artificial sequence
  SiRNA target sequence
cagtagaagtttttagattaa

SEQ ID NO: 33945 - DNA, 21 bp, Artificial sequence
  SiRNA target sequence
agtagaagtttttagattaat

SEQ ID NO: 33946 - DNA, 21 bp, Artificial sequence
  SiRNA target sequence
gtagaagtttttagattaatt

SEQ ID NO: 33947 - DNA, 21 bp, Artificial sequence
  SiRNA target sequence
tagaagtttttagattaatta

SEQ ID NO: 33948 - DNA, 21 bp, Artificial sequence
  SiRNA target sequence
agaagtttttagattaattaa

SEQ ID NO: 33949 - DNA, 21 bp, Artificial sequence
  SiRNA target sequence
gaagtttttagattaattaag

SEQ ID NO: 33950 - DNA, 21 bp, Artificial sequence
  SiRNA target sequence
aagtttttagattaattaaga

SEQ ID NO: 33951 - DNA, 21 bp, Artificial sequence
  SiRNA target sequence
agtttttagattaattaagaa

SEQ ID NO: 33952 - DNA, 21 bp, Artificial sequence
  SiRNA target sequence
gtttttagattaattaagaaa

SEQ ID NO: 33953 - DNA, 21 bp, Artificial sequence
  SiRNA target sequence
tttttagattaattaagaaat

SEQ ID NO: 33954 - DNA, 21 bp, Artificial sequence
  SiRNA target sequence
ttttagattaattaagaaata

SEQ ID NO: 33955 - DNA, 21 bp, Artificial sequence
  SiRNA target sequence
tttagattaattaagaaatat

SEQ ID NO: 33956 - DNA, 21 bp, Artificial sequence
  SiRNA target sequence
ttagattaattaagaaatatg

SEQ ID NO: 33957 - DNA, 21 bp, Artificial sequence
  SiRNA target sequence
tagattaattaagaaatatgt

SEQ ID NO: 33958 - DNA, 21 bp, Artificial sequence
  SiRNA target sequence
agattaattaagaaatatgtt

SEQ ID NO: 33959 - DNA, 21 bp, Artificial sequence
  SiRNA target sequence
gattaattaagaaatatgtta

SEQ ID NO: 33960 - DNA, 21 bp, Artificial sequence
  SiRNA target sequence
attaattaagaaatatgttag

SEQ ID NO: 33961 - DNA, 21 bp, Artificial sequence
  SiRNA target sequence
ttaattaagaaatatgttagc

SEQ ID NO: 33962 - DNA, 21 bp, Artificial sequence
  SiRNA target sequence
taattaagaaatatgttagca

SEQ ID NO: 33963 - DNA, 21 bp, Artificial sequence
  SiRNA target sequence
aattaagaaatatgttagcaa

SEQ ID NO: 33964 - DNA, 21 bp, Artificial sequence
  SiRNA target sequence
attaagaaatatgttagcaat

SEQ ID NO: 33965 - DNA, 21 bp, Artificial sequence
  SiRNA target sequence
ttaagaaatatgttagcaata

SEQ ID NO: 33966 - DNA, 21 bp, Artificial sequence
  SiRNA target sequence
taagaaatatgttagcaatat

SEQ ID NO: 33967 - DNA, 21 bp, Artificial sequence
  SiRNA target sequence
aagaaatatgttagcaatatt

SEQ ID NO: 33968 - DNA, 21 bp, Artificial sequence
  SiRNA target sequence
agaaatatgttagcaatatta

SEQ ID NO: 33969 - DNA, 21 bp, Artificial sequence
  SiRNA target sequence
gaaatatgttagcaatattaa

SEQ ID NO: 33970 - DNA, 21 bp, Artificial sequence
  SiRNA target sequence
aaatatgttagcaatattaat

SEQ ID NO: 33971 - DNA, 21 bp, Artificial sequence
  SiRNA target sequence
aatatgttagcaatattaata

SEQ ID NO: 33972 - DNA, 21 bp, Artificial sequence
  SiRNA target sequence
atatgttagcaatattaatat

SEQ ID NO: 33973 - DNA, 21 bp, Artificial sequence
  SiRNA target sequence
tatgttagcaatattaatatc

SEQ ID NO: 33974 - DNA, 21 bp, Artificial sequence
  SiRNA target sequence
atgttagcaatattaatatca

SEQ ID NO: 33975 - DNA, 21 bp, Artificial sequence
  SiRNA target sequence
tgttagcaatattaatatcaa

SEQ ID NO: 33976 - DNA, 21 bp, Artificial sequence
  SiRNA target sequence
gttagcaatattaatatcaat

SEQ ID NO: 33977 - DNA, 21 bp, Artificial sequence
  SiRNA target sequence
ttagcaatattaatatcaata

SEQ ID NO: 33978 - DNA, 21 bp, Artificial sequence
  SiRNA target sequence
tagcaatattaatatcaatat

SEQ ID NO: 33979 - DNA, 21 bp, Artificial sequence
  SiRNA target sequence
agcaatattaatatcaatatc

SEQ ID NO: 33980 - DNA, 21 bp, Artificial sequence
  SiRNA target sequence
gcaatattaatatcaatatcg

SEQ ID NO: 33981 - DNA, 21 bp, Artificial sequence
  SiRNA target sequence
caatattaatatcaatatcga

SEQ ID NO: 33982 - DNA, 21 bp, Artificial sequence
  SiRNA target sequence
aatattaatatcaatatcgat

SEQ ID NO: 33983 - DNA, 21 bp, Artificial sequence
  SiRNA target sequence
atattaatatcaatatcgata

SEQ ID NO: 33984 - DNA, 21 bp, Artificial sequence
  SiRNA target sequence
tattaatatcaatatcgataa

SEQ ID NO: 33985 - DNA, 21 bp, Artificial sequence
  SiRNA target sequence
attaatatcaatatcgataag

SEQ ID NO: 33986 - DNA, 21 bp, Artificial sequence
  SiRNA target sequence
ttaatatcaatatcgataaga

SEQ ID NO: 33987 - DNA, 21 bp, Artificial sequence
  SiRNA target sequence
taatatcaatatcgataagat

SEQ ID NO: 33988 - DNA, 21 bp, Artificial sequence
  SiRNA target sequence
aatatcaatatcgataagatt

SEQ ID NO: 33989 - DNA, 21 bp, Artificial sequence
  SiRNA target sequence
atatcaatatcgataagatta

SEQ ID NO: 33990 - DNA, 21 bp, Artificial sequence
  SiRNA target sequence
tatcaatatcgataagattaa

SEQ ID NO: 33991 - DNA, 21 bp, Artificial sequence
  SiRNA target sequence
atcaatatcgataagattaaa

SEQ ID NO: 33992 - DNA, 21 bp, Artificial sequence
  SiRNA target sequence
tcaatatcgataagattaaag

SEQ ID NO: 33993 - DNA, 21 bp, Artificial sequence
  SiRNA target sequence
caatatcgataagattaaaga

SEQ ID NO: 33994 - DNA, 21 bp, Artificial sequence
  SiRNA target sequence
aatatcgataagattaaagaa

SEQ ID NO: 33995 - DNA, 21 bp, Artificial sequence
  SiRNA target sequence
atatcgataagattaaagaat

SEQ ID NO: 33996 - DNA, 21 bp, Artificial sequence
  SiRNA target sequence
tatcgataagattaaagaatt

SEQ ID NO: 33997 - DNA, 21 bp, Artificial sequence
  SiRNA target sequence
atcgataagattaaagaattg

SEQ ID NO: 33998 - DNA, 21 bp, Artificial sequence
  SiRNA target sequence
tcgataagattaaagaattgt

SEQ ID NO: 33999 - DNA, 21 bp, Artificial sequence
  SiRNA target sequence
cgataagattaaagaattgtt

SEQ ID NO: 34000 - DNA, 21 bp, Artificial sequence
  SiRNA target sequence
gataagattaaagaattgtta

SEQ ID NO: 34001 - DNA, 21 bp, Artificial sequence
  SiRNA target sequence
ataagattaaagaattgttat

SEQ ID NO: 34002 - DNA, 21 bp, Artificial sequence
  SiRNA target sequence
taagattaaagaattgttatc

SEQ ID NO: 34003 - DNA, 21 bp, Artificial sequence
  SiRNA target sequence
aagattaaagaattgttatct

SEQ ID NO: 34004 - DNA, 21 bp, Artificial sequence
  SiRNA target sequence
agattaaagaattgttatctt

SEQ ID NO: 34005 - DNA, 21 bp, Artificial sequence
  SiRNA target sequence
gattaaagaattgttatctta

SEQ ID NO: 34006 - DNA, 21 bp, Artificial sequence
  SiRNA target sequence
attaaagaattgttatcttat

SEQ ID NO: 34007 - DNA, 21 bp, Artificial sequence
  SiRNA target sequence
ttaaagaattgttatcttatg

SEQ ID NO: 34008 - DNA, 21 bp, Artificial sequence
  SiRNA target sequence
taaagaattgttatcttatgg

SEQ ID NO: 34009 - DNA, 21 bp, Artificial sequence
  SiRNA target sequence
aaagaattgttatcttatggt

SEQ ID NO: 34010 - DNA, 21 bp, Artificial sequence
  SiRNA target sequence
aagaattgttatcttatggta

SEQ ID NO: 34011 - DNA, 21 bp, Artificial sequence
  SiRNA target sequence
agaattgttatcttatggtaa

SEQ ID NO: 34012 - DNA, 21 bp, Artificial sequence
  SiRNA target sequence
gaattgttatcttatggtaag

SEQ ID NO: 34013 - DNA, 21 bp, Artificial sequence
  SiRNA target sequence
aattgttatcttatggtaagg

SEQ ID NO: 34014 - DNA, 21 bp, Artificial sequence
  SiRNA target sequence
attgttatcttatggtaaggt

SEQ ID NO: 34015 - DNA, 21 bp, Artificial sequence
  SiRNA target sequence
ttgttatcttatggtaaggta

SEQ ID NO: 34016 - DNA, 21 bp, Artificial sequence
  SiRNA target sequence
tgttatcttatggtaaggtag

SEQ ID NO: 34017 - DNA, 21 bp, Artificial sequence
  SiRNA target sequence
gttatcttatggtaaggtagc

SEQ ID NO: 34018 - DNA, 21 bp, Artificial sequence
  SiRNA target sequence
ttatcttatggtaaggtagct

SEQ ID NO: 34019 - DNA, 21 bp, Artificial sequence
  SiRNA target sequence
tatcttatggtaaggtagctc

SEQ ID NO: 34020 - DNA, 21 bp, Artificial sequence
  SiRNA target sequence
atcttatggtaaggtagctct

SEQ ID NO: 34021 - DNA, 21 bp, Artificial sequence
  SiRNA target sequence
tcttatggtaaggtagctctt

SEQ ID NO: 34022 - DNA, 21 bp, Artificial sequence
  SiRNA target sequence
cttatggtaaggtagctctta

SEQ ID NO: 34023 - DNA, 21 bp, Artificial sequence
  SiRNA target sequence
ttatggtaaggtagctcttaa

SEQ ID NO: 34024 - DNA, 21 bp, Artificial sequence
  SiRNA target sequence
tatggtaaggtagctcttaac

SEQ ID NO: 34025 - DNA, 21 bp, Artificial sequence
  SiRNA target sequence
atggtaaggtagctcttaaca

SEQ ID NO: 34026 - DNA, 21 bp, Artificial sequence
  SiRNA target sequence
tggtaaggtagctcttaacaa

SEQ ID NO: 34027 - DNA, 21 bp, Artificial sequence
  SiRNA target sequence
ggtaaggtagctcttaacaat

SEQ ID NO: 34028 - DNA, 21 bp, Artificial sequence
  SiRNA target sequence
gtaaggtagctcttaacaata

SEQ ID NO: 34029 - DNA, 21 bp, Artificial sequence
  SiRNA target sequence
taaggtagctcttaacaataa

SEQ ID NO: 34030 - DNA, 21 bp, Artificial sequence
  SiRNA target sequence
aaggtagctcttaacaataat

SEQ ID NO: 34031 - DNA, 21 bp, Artificial sequence
  SiRNA target sequence
aggtagctcttaacaataata

SEQ ID NO: 34032 - DNA, 21 bp, Artificial sequence
  SiRNA target sequence
ggtagctcttaacaataataa

SEQ ID NO: 34033 - DNA, 21 bp, Artificial sequence
  SiRNA target sequence
gtagctcttaacaataataat

SEQ ID NO: 34034 - DNA, 21 bp, Artificial sequence
  SiRNA target sequence
tagctcttaacaataataatc

SEQ ID NO: 34035 - DNA, 21 bp, Artificial sequence
  SiRNA target sequence
agctcttaacaataataatcc

SEQ ID NO: 34036 - DNA, 21 bp, Artificial sequence
  SiRNA target sequence
gctcttaacaataataatcca

SEQ ID NO: 34037 - DNA, 21 bp, Artificial sequence
  SiRNA target sequence
ctcttaacaataataatccaa

SEQ ID NO: 34038 - DNA, 21 bp, Artificial sequence
  SiRNA target sequence
tcttaacaataataatccaat

SEQ ID NO: 34039 - DNA, 21 bp, Artificial sequence
  SiRNA target sequence
cttaacaataataatccaatt

SEQ ID NO: 34040 - DNA, 21 bp, Artificial sequence
  SiRNA target sequence
ttaacaataataatccaatta

SEQ ID NO: 34041 - DNA, 21 bp, Artificial sequence
  SiRNA target sequence
taacaataataatccaattat

SEQ ID NO: 34042 - DNA, 21 bp, Artificial sequence
  SiRNA target sequence
aacaataataatccaattatt

SEQ ID NO: 34043 - DNA, 21 bp, Artificial sequence
  SiRNA target sequence
acaataataatccaattattc

SEQ ID NO: 34044 - DNA, 21 bp, Artificial sequence
  SiRNA target sequence
caataataatccaattattca

SEQ ID NO: 34045 - DNA, 21 bp, Artificial sequence
  SiRNA target sequence
aataataatccaattattcat

SEQ ID NO: 34046 - DNA, 21 bp, Artificial sequence
  SiRNA target sequence
ataataatccaattattcatg

SEQ ID NO: 34047 - DNA, 21 bp, Artificial sequence
  SiRNA target sequence
taataatccaattattcatgt

SEQ ID NO: 34048 - DNA, 21 bp, Artificial sequence
  SiRNA target sequence
aataatccaattattcatgta

SEQ ID NO: 34049 - DNA, 21 bp, Artificial sequence
  SiRNA target sequence
ataatccaattattcatgtaa

SEQ ID NO: 34050 - DNA, 21 bp, Artificial sequence
  SiRNA target sequence
taatccaattattcatgtaac

SEQ ID NO: 34051 - DNA, 21 bp, Artificial sequence
  SiRNA target sequence
aatccaattattcatgtaaca

SEQ ID NO: 34052 - DNA, 21 bp, Artificial sequence
  SiRNA target sequence
atccaattattcatgtaacaa

SEQ ID NO: 34053 - DNA, 21 bp, Artificial sequence
  SiRNA target sequence
tccaattattcatgtaacaat

SEQ ID NO: 34054 - DNA, 21 bp, Artificial sequence
  SiRNA target sequence
ccaattattcatgtaacaatg

SEQ ID NO: 34055 - DNA, 21 bp, Artificial sequence
  SiRNA target sequence
caattattcatgtaacaatgc

SEQ ID NO: 34056 - DNA, 21 bp, Artificial sequence
  SiRNA target sequence
aattattcatgtaacaatgca

SEQ ID NO: 34057 - DNA, 21 bp, Artificial sequence
  SiRNA target sequence
attattcatgtaacaatgcaa

SEQ ID NO: 34058 - DNA, 21 bp, Artificial sequence
  SiRNA target sequence
ttattcatgtaacaatgcaat

SEQ ID NO: 34059 - DNA, 21 bp, Artificial sequence
  SiRNA target sequence
tattcatgtaacaatgcaatc

SEQ ID NO: 34060 - DNA, 21 bp, Artificial sequence
  SiRNA target sequence
attcatgtaacaatgcaatct

SEQ ID NO: 34061 - DNA, 21 bp, Artificial sequence
  SiRNA target sequence
ttcatgtaacaatgcaatcta

SEQ ID NO: 34062 - DNA, 21 bp, Artificial sequence
  SiRNA target sequence
tcatgtaacaatgcaatctaa

SEQ ID NO: 34063 - DNA, 21 bp, Artificial sequence
  SiRNA target sequence
catgtaacaatgcaatctaat

SEQ ID NO: 34064 - DNA, 21 bp, Artificial sequence
  SiRNA target sequence
atgtaacaatgcaatctaatt

SEQ ID NO: 34065 - DNA, 21 bp, Artificial sequence
  SiRNA target sequence
tgtaacaatgcaatctaattc

SEQ ID NO: 34066 - DNA, 21 bp, Artificial sequence
  SiRNA target sequence
gtaacaatgcaatctaattct

SEQ ID NO: 34067 - DNA, 21 bp, Artificial sequence
  SiRNA target sequence
taacaatgcaatctaattctc

SEQ ID NO: 34068 - DNA, 21 bp, Artificial sequence
  SiRNA target sequence
aacaatgcaatctaattctcc

SEQ ID NO: 34069 - DNA, 21 bp, Artificial sequence
  SiRNA target sequence
acaatgcaatctaattctccc

SEQ ID NO: 34070 - DNA, 21 bp, Artificial sequence
  SiRNA target sequence
caatgcaatctaattctccca

SEQ ID NO: 34071 - DNA, 21 bp, Artificial sequence
  SiRNA target sequence
aatgcaatctaattctcccat

SEQ ID NO: 34072 - DNA, 21 bp, Artificial sequence
  SiRNA target sequence
atgcaatctaattctcccatt

SEQ ID NO: 34073 - DNA, 21 bp, Artificial sequence
  SiRNA target sequence
tgcaatctaattctcccattc

SEQ ID NO: 34074 - DNA, 21 bp, Artificial sequence
  SiRNA target sequence
gcaatctaattctcccattct

SEQ ID NO: 34075 - DNA, 21 bp, Artificial sequence
  SiRNA target sequence
caatctaattctcccattctt

SEQ ID NO: 34076 - DNA, 21 bp, Artificial sequence
  SiRNA target sequence
aatctaattctcccattcttg

SEQ ID NO: 34077 - DNA, 21 bp, Artificial sequence
  SiRNA target sequence
atctaattctcccattcttga

SEQ ID NO: 34078 - DNA, 21 bp, Artificial sequence
  SiRNA target sequence
tctaattctcccattcttgaa

SEQ ID NO: 34079 - DNA, 21 bp, Artificial sequence
  SiRNA target sequence
ctaattctcccattcttgaag

SEQ ID NO: 34080 - DNA, 21 bp, Artificial sequence
  SiRNA target sequence
taattctcccattcttgaagt

SEQ ID NO: 34081 - DNA, 21 bp, Artificial sequence
  SiRNA target sequence
aattctcccattcttgaagtt

SEQ ID NO: 34082 - DNA, 21 bp, Artificial sequence
  SiRNA target sequence
attctcccattcttgaagttt

SEQ ID NO: 34083 - DNA, 21 bp, Artificial sequence
  SiRNA target sequence
ttctcccattcttgaagtttt

SEQ ID NO: 34084 - DNA, 21 bp, Artificial sequence
  SiRNA target sequence
tctcccattcttgaagtttta

SEQ ID NO: 34085 - DNA, 21 bp, Artificial sequence
  SiRNA target sequence
ctcccattcttgaagttttat

SEQ ID NO: 34086 - DNA, 21 bp, Artificial sequence
  SiRNA target sequence
tcccattcttgaagttttatt

SEQ ID NO: 34087 - DNA, 21 bp, Artificial sequence
  SiRNA target sequence
cccattcttgaagttttatta

SEQ ID NO: 34088 - DNA, 21 bp, Artificial sequence
  SiRNA target sequence
ccattcttgaagttttattac

SEQ ID NO: 34089 - DNA, 21 bp, Artificial sequence
  SiRNA target sequence
cattcttgaagttttattaca

SEQ ID NO: 34090 - DNA, 21 bp, Artificial sequence
  SiRNA target sequence
attcttgaagttttattacaa

SEQ ID NO: 34091 - DNA, 21 bp, Artificial sequence
  SiRNA target sequence
ttcttgaagttttattacaac

SEQ ID NO: 34092 - DNA, 21 bp, Artificial sequence
  SiRNA target sequence
tcttgaagttttattacaacc

SEQ ID NO: 34093 - DNA, 21 bp, Artificial sequence
  SiRNA target sequence
cttgaagttttattacaaccc

SEQ ID NO: 34094 - DNA, 21 bp, Artificial sequence
  SiRNA target sequence
ttgaagttttattacaaccca

SEQ ID NO: 34095 - DNA, 21 bp, Artificial sequence
  SiRNA target sequence
tgaagttttattacaacccaa

SEQ ID NO: 34096 - DNA, 21 bp, Artificial sequence
  SiRNA target sequence
gaagttttattacaacccaac

SEQ ID NO: 34097 - DNA, 21 bp, Artificial sequence
  SiRNA target sequence
aagttttattacaacccaaca

SEQ ID NO: 34098 - DNA, 21 bp, Artificial sequence
  SiRNA target sequence
agttttattacaacccaacat

SEQ ID NO: 34099 - DNA, 21 bp, Artificial sequence
  SiRNA target sequence
gttttattacaacccaacatt

SEQ ID NO: 34100 - DNA, 21 bp, Artificial sequence
  SiRNA target sequence
ttttattacaacccaacatta

SEQ ID NO: 34101 - DNA, 21 bp, Artificial sequence
  SiRNA target sequence
tttattacaacccaacattat

SEQ ID NO: 34102 - DNA, 21 bp, Artificial sequence
  SiRNA target sequence
ttattacaacccaacattata

SEQ ID NO: 34103 - DNA, 21 bp, Artificial sequence
  SiRNA target sequence
tattacaacccaacattatag

SEQ ID NO: 34104 - DNA, 21 bp, Artificial sequence
  SiRNA target sequence
attacaacccaacattatagt

SEQ ID NO: 34105 - DNA, 21 bp, Artificial sequence
  SiRNA target sequence
ttacaacccaacattatagtt

SEQ ID NO: 34106 - DNA, 21 bp, Artificial sequence
  SiRNA target sequence
tacaacccaacattatagtta

SEQ ID NO: 34107 - DNA, 21 bp, Artificial sequence
  SiRNA target sequence
acaacccaacattatagttag

SEQ ID NO: 34108 - DNA, 21 bp, Artificial sequence
  SiRNA target sequence
caacccaacattatagttagc

SEQ ID NO: 34109 - DNA, 21 bp, Artificial sequence
  SiRNA target sequence
aacccaacattatagttagcg

SEQ ID NO: 34110 - DNA, 21 bp, Artificial sequence
  SiRNA target sequence
acccaacattatagttagcgc

SEQ ID NO: 34111 - DNA, 21 bp, Artificial sequence
  SiRNA target sequence
cccaacattatagttagcgcc

SEQ ID NO: 34112 - DNA, 21 bp, Artificial sequence
  SiRNA target sequence
ccaacattatagttagcgcca

SEQ ID NO: 34113 - DNA, 21 bp, Artificial sequence
  SiRNA target sequence
caacattatagttagcgccat

SEQ ID NO: 34114 - DNA, 21 bp, Artificial sequence
  SiRNA target sequence
aacattatagttagcgccata

SEQ ID NO: 34115 - DNA, 21 bp, Artificial sequence
  SiRNA target sequence
acattatagttagcgccatat

SEQ ID NO: 34116 - DNA, 21 bp, Artificial sequence
  SiRNA target sequence
cattatagttagcgccatatt

SEQ ID NO: 34117 - DNA, 21 bp, Artificial sequence
  SiRNA target sequence
attatagttagcgccatattt

SEQ ID NO: 34118 - DNA, 21 bp, Artificial sequence
  SiRNA target sequence
ttatagttagcgccatattta

SEQ ID NO: 34119 - DNA, 21 bp, Artificial sequence
  SiRNA target sequence
tatagttagcgccatatttat

SEQ ID NO: 34120 - DNA, 21 bp, Artificial sequence
  SiRNA target sequence
atagttagcgccatatttata

SEQ ID NO: 34121 - DNA, 21 bp, Artificial sequence
  SiRNA target sequence
tagttagcgccatatttatag

SEQ ID NO: 34122 - DNA, 21 bp, Artificial sequence
  SiRNA target sequence
agttagcgccatatttatagc

SEQ ID NO: 34123 - DNA, 21 bp, Artificial sequence
  SiRNA target sequence
gttagcgccatatttatagca

SEQ ID NO: 34124 - DNA, 21 bp, Artificial sequence
  SiRNA target sequence
ttagcgccatatttatagcat

SEQ ID NO: 34125 - DNA, 21 bp, Artificial sequence
  SiRNA target sequence
tagcgccatatttatagcatt

SEQ ID NO: 34126 - DNA, 21 bp, Artificial sequence
  SiRNA target sequence
agcgccatatttatagcatta

SEQ ID NO: 34127 - DNA, 21 bp, Artificial sequence
  SiRNA target sequence
gcgccatatttatagcattaa

SEQ ID NO: 34128 - DNA, 21 bp, Artificial sequence
  SiRNA target sequence
cgccatatttatagcattaag

SEQ ID NO: 34129 - DNA, 21 bp, Artificial sequence
  SiRNA target sequence
gccatatttatagcattaagc

SEQ ID NO: 34130 - DNA, 21 bp, Artificial sequence
  SiRNA target sequence
ccatatttatagcattaagcg

SEQ ID NO: 34131 - DNA, 21 bp, Artificial sequence
  SiRNA target sequence
catatttatagcattaagcgt

SEQ ID NO: 34132 - DNA, 21 bp, Artificial sequence
  SiRNA target sequence
atatttatagcattaagcgta

SEQ ID NO: 34133 - DNA, 21 bp, Artificial sequence
  SiRNA target sequence
tatttatagcattaagcgtag

SEQ ID NO: 34134 - DNA, 21 bp, Artificial sequence
  SiRNA target sequence
atttatagcattaagcgtagt

SEQ ID NO: 34135 - DNA, 21 bp, Artificial sequence
  SiRNA target sequence
tttatagcattaagcgtagtg

SEQ ID NO: 34136 - DNA, 21 bp, Artificial sequence
  SiRNA target sequence
ttatagcattaagcgtagtgt

SEQ ID NO: 34137 - DNA, 21 bp, Artificial sequence
  SiRNA target sequence
tatagcattaagcgtagtgtt

SEQ ID NO: 34138 - DNA, 21 bp, Artificial sequence
  SiRNA target sequence
atagcattaagcgtagtgttc

SEQ ID NO: 34139 - DNA, 21 bp, Artificial sequence
  SiRNA target sequence
tagcattaagcgtagtgttcc

SEQ ID NO: 34140 - DNA, 21 bp, Artificial sequence
  SiRNA target sequence
agcattaagcgtagtgttcca

SEQ ID NO: 34141 - DNA, 21 bp, Artificial sequence
  SiRNA target sequence
gcattaagcgtagtgttccac

SEQ ID NO: 34142 - DNA, 21 bp, Artificial sequence
  SiRNA target sequence
cattaagcgtagtgttccaca

SEQ ID NO: 34143 - DNA, 21 bp, Artificial sequence
  SiRNA target sequence
attaagcgtagtgttccacaa

SEQ ID NO: 34144 - DNA, 21 bp, Artificial sequence
  SiRNA target sequence
ttaagcgtagtgttccacaaa

SEQ ID NO: 34145 - DNA, 21 bp, Artificial sequence
  SiRNA target sequence
taagcgtagtgttccacaaaa

SEQ ID NO: 34146 - DNA, 21 bp, Artificial sequence
  SiRNA target sequence
aagcgtagtgttccacaaaaa

SEQ ID NO: 34147 - DNA, 21 bp, Artificial sequence
  SiRNA target sequence
agcgtagtgttccacaaaaaa

SEQ ID NO: 34148 - DNA, 21 bp, Artificial sequence
  SiRNA target sequence
gcgtagtgttccacaaaaaat

SEQ ID NO: 34149 - DNA, 21 bp, Artificial sequence
  SiRNA target sequence
cgtagtgttccacaaaaaatt

SEQ ID NO: 34150 - DNA, 21 bp, Artificial sequence
  SiRNA target sequence
gtagtgttccacaaaaaattt

SEQ ID NO: 34151 - DNA, 21 bp, Artificial sequence
  SiRNA target sequence
tagtgttccacaaaaaattta

SEQ ID NO: 34152 - DNA, 21 bp, Artificial sequence
  SiRNA target sequence
agtgttccacaaaaaatttac

SEQ ID NO: 34153 - DNA, 21 bp, Artificial sequence
  SiRNA target sequence
gtgttccacaaaaaatttacc

SEQ ID NO: 34154 - DNA, 21 bp, Artificial sequence
  SiRNA target sequence
tgttccacaaaaaatttacct

SEQ ID NO: 34155 - DNA, 21 bp, Artificial sequence
  SiRNA target sequence
gttccacaaaaaatttaccta

SEQ ID NO: 34156 - DNA, 21 bp, Artificial sequence
  SiRNA target sequence
ttccacaaaaaatttacctac

SEQ ID NO: 34157 - DNA, 21 bp, Artificial sequence
  SiRNA target sequence
tccacaaaaaatttacctaca

SEQ ID NO: 34158 - DNA, 21 bp, Artificial sequence
  SiRNA target sequence
ccacaaaaaatttacctacaa

SEQ ID NO: 34159 - DNA, 21 bp, Artificial sequence
  SiRNA target sequence
cacaaaaaatttacctacaaa

SEQ ID NO: 34160 - DNA, 21 bp, Artificial sequence
  SiRNA target sequence
acaaaaaatttacctacaaaa

SEQ ID NO: 34161 - DNA, 21 bp, Artificial sequence
  SiRNA target sequence
caaaaaatttacctacaaaaa

SEQ ID NO: 34162 - DNA, 21 bp, Artificial sequence
  SiRNA target sequence
aaaaaatttacctacaaaaaa

SEQ ID NO: 34163 - DNA, 21 bp, Artificial sequence
  SiRNA target sequence
aaaaatttacctacaaaaaac

SEQ ID NO: 34164 - DNA, 21 bp, Artificial sequence
  SiRNA target sequence
aaaatttacctacaaaaaact

SEQ ID NO: 34165 - DNA, 21 bp, Artificial sequence
  SiRNA target sequence
aaatttacctacaaaaaactg

SEQ ID NO: 34166 - DNA, 21 bp, Artificial sequence
  SiRNA target sequence
aatttacctacaaaaaactgg

SEQ ID NO: 34167 - DNA, 21 bp, Artificial sequence
  SiRNA target sequence
atttacctacaaaaaactggg

SEQ ID NO: 34168 - DNA, 21 bp, Artificial sequence
  SiRNA target sequence
tttacctacaaaaaactggga

SEQ ID NO: 34169 - DNA, 21 bp, Artificial sequence
  SiRNA target sequence
ttacctacaaaaaactgggaa

SEQ ID NO: 34170 - DNA, 21 bp, Artificial sequence
  SiRNA target sequence
tacctacaaaaaactgggaat

SEQ ID NO: 34171 - DNA, 21 bp, Artificial sequence
  SiRNA target sequence
acctacaaaaaactgggaatt

SEQ ID NO: 34172 - DNA, 21 bp, Artificial sequence
  SiRNA target sequence
cctacaaaaaactgggaattg

SEQ ID NO: 34173 - DNA, 21 bp, Artificial sequence
  SiRNA target sequence
ctacaaaaaactgggaattga

SEQ ID NO: 34174 - DNA, 21 bp, Artificial sequence
  SiRNA target sequence
tacaaaaaactgggaattgaa

SEQ ID NO: 34175 - DNA, 21 bp, Artificial sequence
  SiRNA target sequence
acaaaaaactgggaattgaag

SEQ ID NO: 34176 - DNA, 21 bp, Artificial sequence
  SiRNA target sequence
caaaaaactgggaattgaagc

SEQ ID NO: 34177 - DNA, 21 bp, Artificial sequence
  SiRNA target sequence
aaaaaactgggaattgaagca

SEQ ID NO: 34178 - DNA, 21 bp, Artificial sequence
  SiRNA target sequence
aaaaactgggaattgaagcaa

SEQ ID NO: 34179 - DNA, 21 bp, Artificial sequence
  SiRNA target sequence
aaaactgggaattgaagcaat

SEQ ID NO: 34180 - DNA, 21 bp, Artificial sequence
  SiRNA target sequence
aaactgggaattgaagcaatg

SEQ ID NO: 34181 - DNA, 21 bp, Artificial sequence
  SiRNA target sequence
aactgggaattgaagcaatga

SEQ ID NO: 34182 - DNA, 21 bp, Artificial sequence
  SiRNA target sequence
actgggaattgaagcaatgat

SEQ ID NO: 34183 - DNA, 21 bp, Artificial sequence
  SiRNA target sequence
ctgggaattgaagcaatgatt

SEQ ID NO: 34184 - DNA, 21 bp, Artificial sequence
  SiRNA target sequence
tgggaattgaagcaatgatta

SEQ ID NO: 34185 - DNA, 21 bp, Artificial sequence
  SiRNA target sequence
gggaattgaagcaatgattaa

SEQ ID NO: 34186 - DNA, 21 bp, Artificial sequence
  SiRNA target sequence
ggaattgaagcaatgattaaa

SEQ ID NO: 34187 - DNA, 21 bp, Artificial sequence
  SiRNA target sequence
gaattgaagcaatgattaaaa

SEQ ID NO: 34188 - DNA, 21 bp, Artificial sequence
  SiRNA target sequence
aattgaagcaatgattaaaag

SEQ ID NO: 34189 - DNA, 21 bp, Artificial sequence
  SiRNA target sequence
attgaagcaatgattaaaaga

SEQ ID NO: 34190 - DNA, 21 bp, Artificial sequence
  SiRNA target sequence
ttgaagcaatgattaaaagac

SEQ ID NO: 34191 - DNA, 21 bp, Artificial sequence
  SiRNA target sequence
tgaagcaatgattaaaagact

SEQ ID NO: 34192 - DNA, 21 bp, Artificial sequence
  SiRNA target sequence
gaagcaatgattaaaagactt

SEQ ID NO: 34193 - DNA, 21 bp, Artificial sequence
  SiRNA target sequence
aagcaatgattaaaagacttg

SEQ ID NO: 34194 - DNA, 21 bp, Artificial sequence
  SiRNA target sequence
agcaatgattaaaagacttgg

SEQ ID NO: 34195 - DNA, 21 bp, Artificial sequence
  SiRNA target sequence
gcaatgattaaaagacttgga

SEQ ID NO: 34196 - DNA, 21 bp, Artificial sequence
  SiRNA target sequence
caatgattaaaagacttggag

SEQ ID NO: 34197 - DNA, 21 bp, Artificial sequence
  SiRNA target sequence
aatgattaaaagacttggaga

SEQ ID NO: 34198 - DNA, 21 bp, Artificial sequence
  SiRNA target sequence
atgattaaaagacttggagat

SEQ ID NO: 34199 - DNA, 21 bp, Artificial sequence
  SiRNA target sequence
tgattaaaagacttggagatt

SEQ ID NO: 34200 - DNA, 21 bp, Artificial sequence
  SiRNA target sequence
gattaaaagacttggagattt

SEQ ID NO: 34201 - DNA, 21 bp, Artificial sequence
  SiRNA target sequence
attaaaagacttggagatttg

SEQ ID NO: 34202 - DNA, 21 bp, Artificial sequence
  SiRNA target sequence
ttaaaagacttggagatttgg

SEQ ID NO: 34203 - DNA, 21 bp, Artificial sequence
  SiRNA target sequence
taaaagacttggagatttggg

SEQ ID NO: 34204 - DNA, 21 bp, Artificial sequence
  SiRNA target sequence
aaaagacttggagatttggga

SEQ ID NO: 34205 - DNA, 21 bp, Artificial sequence
  SiRNA target sequence
aaagacttggagatttgggaa

SEQ ID NO: 34206 - DNA, 21 bp, Artificial sequence
  SiRNA target sequence
aagacttggagatttgggaag

SEQ ID NO: 34207 - DNA, 21 bp, Artificial sequence
  SiRNA target sequence
agacttggagatttgggaaga

SEQ ID NO: 34208 - DNA, 21 bp, Artificial sequence
  SiRNA target sequence
gacttggagatttgggaagag

SEQ ID NO: 34209 - DNA, 21 bp, Artificial sequence
  SiRNA target sequence
acttggagatttgggaagagc

SEQ ID NO: 34210 - DNA, 21 bp, Artificial sequence
  SiRNA target sequence
cttggagatttgggaagagca

SEQ ID NO: 34211 - DNA, 21 bp, Artificial sequence
  SiRNA target sequence
ttggagatttgggaagagcag

SEQ ID NO: 34212 - DNA, 21 bp, Artificial sequence
  SiRNA target sequence
tggagatttgggaagagcagc

SEQ ID NO: 34213 - DNA, 21 bp, Artificial sequence
  SiRNA target sequence
ggagatttgggaagagcagcc

SEQ ID NO: 34214 - DNA, 21 bp, Artificial sequence
  SiRNA target sequence
gagatttgggaagagcagcca

SEQ ID NO: 34215 - DNA, 21 bp, Artificial sequence
  SiRNA target sequence
agatttgggaagagcagccaa

SEQ ID NO: 34216 - DNA, 21 bp, Artificial sequence
  SiRNA target sequence
gatttgggaagagcagccaaa

SEQ ID NO: 34217 - DNA, 21 bp, Artificial sequence
  SiRNA target sequence
atttgggaagagcagccaaag

SEQ ID NO: 34218 - DNA, 21 bp, Artificial sequence
  SiRNA target sequence
tttgggaagagcagccaaagg

SEQ ID NO: 34219 - DNA, 21 bp, Artificial sequence
  SiRNA target sequence
ttgggaagagcagccaaaggc

SEQ ID NO: 34220 - DNA, 21 bp, Artificial sequence
  SiRNA target sequence
tgggaagagcagccaaaggct

SEQ ID NO: 34221 - DNA, 21 bp, Artificial sequence
  SiRNA target sequence
gggaagagcagccaaaggctg

SEQ ID NO: 34222 - DNA, 21 bp, Artificial sequence
  SiRNA target sequence
ggaagagcagccaaaggctgt

SEQ ID NO: 34223 - DNA, 21 bp, Artificial sequence
  SiRNA target sequence
gaagagcagccaaaggctgtt

SEQ ID NO: 34224 - DNA, 21 bp, Artificial sequence
  SiRNA target sequence
aagagcagccaaaggctgttc

SEQ ID NO: 34225 - DNA, 21 bp, Artificial sequence
  SiRNA target sequence
agagcagccaaaggctgttca

SEQ ID NO: 34226 - DNA, 21 bp, Artificial sequence
  SiRNA target sequence
gagcagccaaaggctgttcag

SEQ ID NO: 34227 - DNA, 21 bp, Artificial sequence
  SiRNA target sequence
agcagccaaaggctgttcaga

SEQ ID NO: 34228 - DNA, 21 bp, Artificial sequence
  SiRNA target sequence
gcagccaaaggctgttcagat

SEQ ID NO: 34229 - DNA, 21 bp, Artificial sequence
  SiRNA target sequence
cagccaaaggctgttcagatt

SEQ ID NO: 34230 - DNA, 21 bp, Artificial sequence
  SiRNA target sequence
agccaaaggctgttcagattt

SEQ ID NO: 34231 - DNA, 21 bp, Artificial sequence
  SiRNA target sequence
gccaaaggctgttcagatttg

SEQ ID NO: 34232 - DNA, 21 bp, Artificial sequence
  SiRNA target sequence
ccaaaggctgttcagatttga

SEQ ID NO: 34233 - DNA, 21 bp, Artificial sequence
  SiRNA target sequence
caaaggctgttcagatttgaa

SEQ ID NO: 34234 - DNA, 21 bp, Artificial sequence
  SiRNA target sequence
aaaggctgttcagatttgaat

SEQ ID NO: 34235 - DNA, 21 bp, Artificial sequence
  SiRNA target sequence
aaggctgttcagatttgaatg

SEQ ID NO: 34236 - DNA, 21 bp, Artificial sequence
  SiRNA target sequence
aggctgttcagatttgaatgt

SEQ ID NO: 34237 - DNA, 21 bp, Artificial sequence
  SiRNA target sequence
ggctgttcagatttgaatgtg

SEQ ID NO: 34238 - DNA, 21 bp, Artificial sequence
  SiRNA target sequence
gctgttcagatttgaatgtgg

SEQ ID NO: 34239 - DNA, 21 bp, Artificial sequence
  SiRNA target sequence
ctgttcagatttgaatgtggt

SEQ ID NO: 34240 - DNA, 21 bp, Artificial sequence
  SiRNA target sequence
tgttcagatttgaatgtggtg

SEQ ID NO: 34241 - DNA, 21 bp, Artificial sequence
  SiRNA target sequence
gttcagatttgaatgtggtgc

SEQ ID NO: 34242 - DNA, 21 bp, Artificial sequence
  SiRNA target sequence
ttcagatttgaatgtggtgct

SEQ ID NO: 34243 - DNA, 21 bp, Artificial sequence
  SiRNA target sequence
tcagatttgaatgtggtgctc

SEQ ID NO: 34244 - DNA, 21 bp, Artificial sequence
  SiRNA target sequence
cagatttgaatgtggtgctca

SEQ ID NO: 34245 - DNA, 21 bp, Artificial sequence
  SiRNA target sequence
agatttgaatgtggtgctcaa

SEQ ID NO: 34246 - DNA, 21 bp, Artificial sequence
  SiRNA target sequence
gatttgaatgtggtgctcaac

SEQ ID NO: 34247 - DNA, 21 bp, Artificial sequence
  SiRNA target sequence
atttgaatgtggtgctcaacc

SEQ ID NO: 34248 - DNA, 21 bp, Artificial sequence
  SiRNA target sequence
tttgaatgtggtgctcaacca

SEQ ID NO: 34249 - DNA, 21 bp, Artificial sequence
  SiRNA target sequence
ttgaatgtggtgctcaaccag

SEQ ID NO: 34250 - DNA, 21 bp, Artificial sequence
  SiRNA target sequence
tgaatgtggtgctcaaccagg

SEQ ID NO: 34251 - DNA, 21 bp, Artificial sequence
  SiRNA target sequence
gaatgtggtgctcaaccaggc

SEQ ID NO: 34252 - DNA, 21 bp, Artificial sequence
  SiRNA target sequence
aatgtggtgctcaaccaggct

SEQ ID NO: 34253 - DNA, 21 bp, Artificial sequence
  SiRNA target sequence
atgtggtgctcaaccaggcta

SEQ ID NO: 34254 - DNA, 21 bp, Artificial sequence
  SiRNA target sequence
tgtggtgctcaaccaggctat

SEQ ID NO: 34255 - DNA, 21 bp, Artificial sequence
  SiRNA target sequence
gtggtgctcaaccaggctata

SEQ ID NO: 34256 - DNA, 21 bp, Artificial sequence
  SiRNA target sequence
tggtgctcaaccaggctataa

SEQ ID NO: 34257 - DNA, 21 bp, Artificial sequence
  SiRNA target sequence
ggtgctcaaccaggctataac

SEQ ID NO: 34258 - DNA, 21 bp, Artificial sequence
  SiRNA target sequence
gtgctcaaccaggctataacc

SEQ ID NO: 34259 - DNA, 21 bp, Artificial sequence
  SiRNA target sequence
tgctcaaccaggctataacca

SEQ ID NO: 34260 - DNA, 21 bp, Artificial sequence
  SiRNA target sequence
gctcaaccaggctataaccaa

SEQ ID NO: 34261 - DNA, 21 bp, Artificial sequence
  SiRNA target sequence
ctcaaccaggctataaccaac

SEQ ID NO: 34262 - DNA, 21 bp, Artificial sequence
  SiRNA target sequence
tcaaccaggctataaccaacc

SEQ ID NO: 34263 - DNA, 21 bp, Artificial sequence
  SiRNA target sequence
caaccaggctataaccaacca

SEQ ID NO: 34264 - DNA, 21 bp, Artificial sequence
  SiRNA target sequence
aaccaggctataaccaaccac

SEQ ID NO: 34265 - DNA, 21 bp, Artificial sequence
  SiRNA target sequence
accaggctataaccaaccaca

SEQ ID NO: 34266 - DNA, 21 bp, Artificial sequence
  SiRNA target sequence
ccaggctataaccaaccacat

SEQ ID NO: 34267 - DNA, 21 bp, Artificial sequence
  SiRNA target sequence
caggctataaccaaccacatg

SEQ ID NO: 34268 - DNA, 21 bp, Artificial sequence
  SiRNA target sequence
aggctataaccaaccacatgt

SEQ ID NO: 34269 - DNA, 21 bp, Artificial sequence
  SiRNA target sequence
ggctataaccaaccacatgtt

SEQ ID NO: 34270 - DNA, 21 bp, Artificial sequence
  SiRNA target sequence
gctataaccaaccacatgtta

SEQ ID NO: 34271 - DNA, 21 bp, Artificial sequence
  SiRNA target sequence
ctataaccaaccacatgttag

SEQ ID NO: 34272 - DNA, 21 bp, Artificial sequence
  SiRNA target sequence
tataaccaaccacatgttaga

SEQ ID NO: 34273 - DNA, 21 bp, Artificial sequence
  SiRNA target sequence
ataaccaaccacatgttagaa

SEQ ID NO: 34274 - DNA, 21 bp, Artificial sequence
  SiRNA target sequence
taaccaaccacatgttagaac

SEQ ID NO: 34275 - DNA, 21 bp, Artificial sequence
  SiRNA target sequence
aaccaaccacatgttagaaca

SEQ ID NO: 34276 - DNA, 21 bp, Artificial sequence
  SiRNA target sequence
accaaccacatgttagaacat

SEQ ID NO: 34277 - DNA, 21 bp, Artificial sequence
  SiRNA target sequence
ccaaccacatgttagaacatt

SEQ ID NO: 34278 - DNA, 21 bp, Artificial sequence
  SiRNA target sequence
caaccacatgttagaacattt

SEQ ID NO: 34279 - DNA, 21 bp, Artificial sequence
  SiRNA target sequence
aaccacatgttagaacatttt

SEQ ID NO: 34280 - DNA, 21 bp, Artificial sequence
  SiRNA target sequence
accacatgttagaacattttg

SEQ ID NO: 34281 - DNA, 21 bp, Artificial sequence
  SiRNA target sequence
ccacatgttagaacattttgg

SEQ ID NO: 34282 - DNA, 21 bp, Artificial sequence
  SiRNA target sequence
cacatgttagaacattttggg

SEQ ID NO: 34283 - DNA, 21 bp, Artificial sequence
  SiRNA target sequence
acatgttagaacattttggga

SEQ ID NO: 34284 - DNA, 21 bp, Artificial sequence
  SiRNA target sequence
catgttagaacattttgggaa

SEQ ID NO: 34285 - DNA, 21 bp, Artificial sequence
  SiRNA target sequence
atgttagaacattttgggaag

SEQ ID NO: 34286 - DNA, 21 bp, Artificial sequence
  SiRNA target sequence
tgttagaacattttgggaaga

SEQ ID NO: 34287 - DNA, 21 bp, Artificial sequence
  SiRNA target sequence
gttagaacattttgggaagaa

SEQ ID NO: 34288 - DNA, 21 bp, Artificial sequence
  SiRNA target sequence
ttagaacattttgggaagaat

SEQ ID NO: 34289 - DNA, 21 bp, Artificial sequence
  SiRNA target sequence
tagaacattttgggaagaatg

SEQ ID NO: 34290 - DNA, 21 bp, Artificial sequence
  SiRNA target sequence
agaacattttgggaagaatgt

SEQ ID NO: 34291 - DNA, 21 bp, Artificial sequence
  SiRNA target sequence
gaacattttgggaagaatgtt

SEQ ID NO: 34292 - DNA, 21 bp, Artificial sequence
  SiRNA target sequence
aacattttgggaagaatgttc

SEQ ID NO: 34293 - DNA, 21 bp, Artificial sequence
  SiRNA target sequence
acattttgggaagaatgttct

SEQ ID NO: 34294 - DNA, 21 bp, Artificial sequence
  SiRNA target sequence
cattttgggaagaatgttctt

SEQ ID NO: 34295 - DNA, 21 bp, Artificial sequence
  SiRNA target sequence
attttgggaagaatgttcttg

SEQ ID NO: 34296 - DNA, 21 bp, Artificial sequence
  SiRNA target sequence
ttttgggaagaatgttcttgg

SEQ ID NO: 34297 - DNA, 21 bp, Artificial sequence
  SiRNA target sequence
tttgggaagaatgttcttggt

SEQ ID NO: 34298 - DNA, 21 bp, Artificial sequence
  SiRNA target sequence
ttgggaagaatgttcttggtt

SEQ ID NO: 34299 - DNA, 21 bp, Artificial sequence
  SiRNA target sequence
tgggaagaatgttcttggttt

SEQ ID NO: 34300 - DNA, 21 bp, Artificial sequence
  SiRNA target sequence
gggaagaatgttcttggttta

SEQ ID NO: 34301 - DNA, 21 bp, Artificial sequence
  SiRNA target sequence
ggaagaatgttcttggtttaa

SEQ ID NO: 34302 - DNA, 21 bp, Artificial sequence
  SiRNA target sequence
gaagaatgttcttggtttaaa

SEQ ID NO: 34303 - DNA, 21 bp, Artificial sequence
  SiRNA target sequence
aagaatgttcttggtttaaaa

SEQ ID NO: 34304 - DNA, 21 bp, Artificial sequence
  SiRNA target sequence
agaatgttcttggtttaaaac

SEQ ID NO: 34305 - DNA, 21 bp, Artificial sequence
  SiRNA target sequence
gaatgttcttggtttaaaaca

SEQ ID NO: 34306 - DNA, 21 bp, Artificial sequence
  SiRNA target sequence
aatgttcttggtttaaaacaa

SEQ ID NO: 34307 - DNA, 21 bp, Artificial sequence
  SiRNA target sequence
atgttcttggtttaaaacaag

SEQ ID NO: 34308 - DNA, 21 bp, Artificial sequence
  SiRNA target sequence
tgttcttggtttaaaacaaga

SEQ ID NO: 34309 - DNA, 21 bp, Artificial sequence
  SiRNA target sequence
gttcttggtttaaaacaagaa

SEQ ID NO: 34310 - DNA, 21 bp, Artificial sequence
  SiRNA target sequence
ttcttggtttaaaacaagaag

SEQ ID NO: 34311 - DNA, 21 bp, Artificial sequence
  SiRNA target sequence
tcttggtttaaaacaagaaga

SEQ ID NO: 34312 - DNA, 21 bp, Artificial sequence
  SiRNA target sequence
cttggtttaaaacaagaagat

SEQ ID NO: 34313 - DNA, 21 bp, Artificial sequence
  SiRNA target sequence
ttggtttaaaacaagaagatg

SEQ ID NO: 34314 - DNA, 21 bp, Artificial sequence
  SiRNA target sequence
tggtttaaaacaagaagatga

SEQ ID NO: 34315 - DNA, 21 bp, Artificial sequence
  SiRNA target sequence
ggtttaaaacaagaagatgaa

SEQ ID NO: 34316 - DNA, 21 bp, Artificial sequence
  SiRNA target sequence
gtttaaaacaagaagatgaac

SEQ ID NO: 34317 - DNA, 21 bp, Artificial sequence
  SiRNA target sequence
tttaaaacaagaagatgaact

SEQ ID NO: 34318 - DNA, 21 bp, Artificial sequence
  SiRNA target sequence
ttaaaacaagaagatgaactc

SEQ ID NO: 34319 - DNA, 21 bp, Artificial sequence
  SiRNA target sequence
taaaacaagaagatgaactca

SEQ ID NO: 34320 - DNA, 21 bp, Artificial sequence
  SiRNA target sequence
aaaacaagaagatgaactcaa

SEQ ID NO: 34321 - DNA, 21 bp, Artificial sequence
  SiRNA target sequence
aaacaagaagatgaactcaaa

SEQ ID NO: 34322 - DNA, 21 bp, Artificial sequence
  SiRNA target sequence
aacaagaagatgaactcaaag

SEQ ID NO: 34323 - DNA, 21 bp, Artificial sequence
  SiRNA target sequence
acaagaagatgaactcaaagt

SEQ ID NO: 34324 - DNA, 21 bp, Artificial sequence
  SiRNA target sequence
caagaagatgaactcaaagtc

SEQ ID NO: 34325 - DNA, 21 bp, Artificial sequence
  SiRNA target sequence
aagaagatgaactcaaagtcc

SEQ ID NO: 34326 - DNA, 21 bp, Artificial sequence
  SiRNA target sequence
agaagatgaactcaaagtcct

SEQ ID NO: 34327 - DNA, 21 bp, Artificial sequence
  SiRNA target sequence
gaagatgaactcaaagtccta

SEQ ID NO: 34328 - DNA, 21 bp, Artificial sequence
  SiRNA target sequence
aagatgaactcaaagtcctag

SEQ ID NO: 34329 - DNA, 21 bp, Artificial sequence
  SiRNA target sequence
agatgaactcaaagtcctagt

SEQ ID NO: 34330 - DNA, 21 bp, Artificial sequence
  SiRNA target sequence
gatgaactcaaagtcctagtg

SEQ ID NO: 34331 - DNA, 21 bp, Artificial sequence
  SiRNA target sequence
atgaactcaaagtcctagtgg

SEQ ID NO: 34332 - DNA, 21 bp, Artificial sequence
  SiRNA target sequence
tgaactcaaagtcctagtgga

SEQ ID NO: 34333 - DNA, 21 bp, Artificial sequence
  SiRNA target sequence
gaactcaaagtcctagtggaa

SEQ ID NO: 34334 - DNA, 21 bp, Artificial sequence
  SiRNA target sequence
aactcaaagtcctagtggaag

SEQ ID NO: 34335 - DNA, 21 bp, Artificial sequence
  SiRNA target sequence
actcaaagtcctagtggaagg

SEQ ID NO: 34336 - DNA, 21 bp, Artificial sequence
  SiRNA target sequence
ctcaaagtcctagtggaagga

SEQ ID NO: 34337 - DNA, 21 bp, Artificial sequence
  SiRNA target sequence
tcaaagtcctagtggaaggat

SEQ ID NO: 34338 - DNA, 21 bp, Artificial sequence
  SiRNA target sequence
caaagtcctagtggaaggata

SEQ ID NO: 34339 - DNA, 21 bp, Artificial sequence
  SiRNA target sequence
aaagtcctagtggaaggatat

SEQ ID NO: 34340 - DNA, 21 bp, Artificial sequence
  SiRNA target sequence
aagtcctagtggaaggatata

SEQ ID NO: 34341 - DNA, 21 bp, Artificial sequence
  SiRNA target sequence
agtcctagtggaaggatatag

SEQ ID NO: 34342 - DNA, 21 bp, Artificial sequence
  SiRNA target sequence
gtcctagtggaaggatataga

SEQ ID NO: 34343 - DNA, 21 bp, Artificial sequence
  SiRNA target sequence
tcctagtggaaggatatagaa

SEQ ID NO: 34344 - DNA, 21 bp, Artificial sequence
  SiRNA target sequence
cctagtggaaggatatagaaa

SEQ ID NO: 34345 - DNA, 21 bp, Artificial sequence
  SiRNA target sequence
ctagtggaaggatatagaaat

SEQ ID NO: 34346 - DNA, 21 bp, Artificial sequence
  SiRNA target sequence
tagtggaaggatatagaaatt

SEQ ID NO: 34347 - DNA, 21 bp, Artificial sequence
  SiRNA target sequence
agtggaaggatatagaaattg

SEQ ID NO: 34348 - DNA, 21 bp, Artificial sequence
  SiRNA target sequence
gtggaaggatatagaaattgg

SEQ ID NO: 34349 - DNA, 21 bp, Artificial sequence
  SiRNA target sequence
tggaaggatatagaaattggt

SEQ ID NO: 34350 - DNA, 21 bp, Artificial sequence
  SiRNA target sequence
ggaaggatatagaaattggtg

SEQ ID NO: 34351 - DNA, 21 bp, Artificial sequence
  SiRNA target sequence
gaaggatatagaaattggtgt

SEQ ID NO: 34352 - DNA, 21 bp, Artificial sequence
  SiRNA target sequence
aaggatatagaaattggtgtg

SEQ ID NO: 34353 - DNA, 21 bp, Artificial sequence
  SiRNA target sequence
aggatatagaaattggtgtga

SEQ ID NO: 34354 - DNA, 21 bp, Artificial sequence
  SiRNA target sequence
ggatatagaaattggtgtgat

SEQ ID NO: 34355 - DNA, 21 bp, Artificial sequence
  SiRNA target sequence
gatatagaaattggtgtgatg

SEQ ID NO: 34356 - DNA, 21 bp, Artificial sequence
  SiRNA target sequence
atatagaaattggtgtgatga

SEQ ID NO: 34357 - DNA, 21 bp, Artificial sequence
  SiRNA target sequence
tatagaaattggtgtgatgaa

SEQ ID NO: 34358 - DNA, 21 bp, Artificial sequence
  SiRNA target sequence
atagaaattggtgtgatgaag

SEQ ID NO: 34359 - DNA, 21 bp, Artificial sequence
  SiRNA target sequence
tagaaattggtgtgatgaagt

SEQ ID NO: 34360 - DNA, 21 bp, Artificial sequence
  SiRNA target sequence
agaaattggtgtgatgaagtc

SEQ ID NO: 34361 - DNA, 21 bp, Artificial sequence
  SiRNA target sequence
gaaattggtgtgatgaagtca

SEQ ID NO: 34362 - DNA, 21 bp, Artificial sequence
  SiRNA target sequence
aaattggtgtgatgaagtcag

SEQ ID NO: 34363 - DNA, 21 bp, Artificial sequence
  SiRNA target sequence
aattggtgtgatgaagtcaga

SEQ ID NO: 34364 - DNA, 21 bp, Artificial sequence
  SiRNA target sequence
attggtgtgatgaagtcagag

SEQ ID NO: 34365 - DNA, 21 bp, Artificial sequence
  SiRNA target sequence
ttggtgtgatgaagtcagaga

SEQ ID NO: 34366 - DNA, 21 bp, Artificial sequence
  SiRNA target sequence
tggtgtgatgaagtcagagat

SEQ ID NO: 34367 - DNA, 21 bp, Artificial sequence
  SiRNA target sequence
ggtgtgatgaagtcagagatt

SEQ ID NO: 34368 - DNA, 21 bp, Artificial sequence
  SiRNA target sequence
gtgtgatgaagtcagagattt

SEQ ID NO: 34369 - DNA, 21 bp, Artificial sequence
  SiRNA target sequence
tgtgatgaagtcagagattta

SEQ ID NO: 34370 - DNA, 21 bp, Artificial sequence
  SiRNA target sequence
gtgatgaagtcagagatttag

SEQ ID NO: 34371 - DNA, 21 bp, Artificial sequence
  SiRNA target sequence
tgatgaagtcagagatttagt

SEQ ID NO: 34372 - DNA, 21 bp, Artificial sequence
  SiRNA target sequence
gatgaagtcagagatttagta

SEQ ID NO: 34373 - DNA, 21 bp, Artificial sequence
  SiRNA target sequence
atgaagtcagagatttagtag

SEQ ID NO: 34374 - DNA, 21 bp, Artificial sequence
  SiRNA target sequence
tgaagtcagagatttagtagg

SEQ ID NO: 34375 - DNA, 21 bp, Artificial sequence
  SiRNA target sequence
gaagtcagagatttagtagga

SEQ ID NO: 34376 - DNA, 21 bp, Artificial sequence
  SiRNA target sequence
aagtcagagatttagtaggac

SEQ ID NO: 34377 - DNA, 21 bp, Artificial sequence
  SiRNA target sequence
agtcagagatttagtaggaca

SEQ ID NO: 34378 - DNA, 21 bp, Artificial sequence
  SiRNA target sequence
gtcagagatttagtaggacat

SEQ ID NO: 34379 - DNA, 21 bp, Artificial sequence
  SiRNA target sequence
tcagagatttagtaggacata

SEQ ID NO: 34380 - DNA, 21 bp, Artificial sequence
  SiRNA target sequence
cagagatttagtaggacataa

SEQ ID NO: 34381 - DNA, 21 bp, Artificial sequence
  SiRNA target sequence
agagatttagtaggacataaa

SEQ ID NO: 34382 - DNA, 21 bp, Artificial sequence
  SiRNA target sequence
gagatttagtaggacataaaa

SEQ ID NO: 34383 - DNA, 21 bp, Artificial sequence
  SiRNA target sequence
agatttagtaggacataaaat

SEQ ID NO: 34384 - DNA, 21 bp, Artificial sequence
  SiRNA target sequence
gatttagtaggacataaaatc

SEQ ID NO: 34385 - DNA, 21 bp, Artificial sequence
  SiRNA target sequence
atttagtaggacataaaatca

SEQ ID NO: 34386 - DNA, 21 bp, Artificial sequence
  SiRNA target sequence
tttagtaggacataaaatcaa

SEQ ID NO: 34387 - DNA, 21 bp, Artificial sequence
  SiRNA target sequence
ttagtaggacataaaatcaat

SEQ ID NO: 34388 - DNA, 21 bp, Artificial sequence
  SiRNA target sequence
tagtaggacataaaatcaatt

SEQ ID NO: 34389 - DNA, 21 bp, Artificial sequence
  SiRNA target sequence
agtaggacataaaatcaattc

SEQ ID NO: 34390 - DNA, 21 bp, Artificial sequence
  SiRNA target sequence
gtaggacataaaatcaattca

SEQ ID NO: 34391 - DNA, 21 bp, Artificial sequence
  SiRNA target sequence
taggacataaaatcaattcag

SEQ ID NO: 34392 - DNA, 21 bp, Artificial sequence
  SiRNA target sequence
aggacataaaatcaattcaga

SEQ ID NO: 34393 - DNA, 21 bp, Artificial sequence
  SiRNA target sequence
ggacataaaatcaattcagat

SEQ ID NO: 34394 - DNA, 21 bp, Artificial sequence
  SiRNA target sequence
gacataaaatcaattcagatg

SEQ ID NO: 34395 - DNA, 21 bp, Artificial sequence
  SiRNA target sequence
acataaaatcaattcagatgg

SEQ ID NO: 34396 - DNA, 21 bp, Artificial sequence
  SiRNA target sequence
cataaaatcaattcagatggg

SEQ ID NO: 34397 - DNA, 21 bp, Artificial sequence
  SiRNA target sequence
ataaaatcaattcagatgggg

SEQ ID NO: 34398 - DNA, 21 bp, Artificial sequence
  SiRNA target sequence
taaaatcaattcagatgggga

SEQ ID NO: 34399 - DNA, 21 bp, Artificial sequence
  SiRNA target sequence
aaaatcaattcagatggggaa

SEQ ID NO: 34400 - DNA, 21 bp, Artificial sequence
  SiRNA target sequence
aaatcaattcagatggggaat

SEQ ID NO: 34401 - DNA, 21 bp, Artificial sequence
  SiRNA target sequence
aatcaattcagatggggaatt

SEQ ID NO: 34402 - DNA, 21 bp, Artificial sequence
  SiRNA target sequence
atcaattcagatggggaatta

SEQ ID NO: 34403 - DNA, 21 bp, Artificial sequence
  SiRNA target sequence
tcaattcagatggggaattag

SEQ ID NO: 34404 - DNA, 21 bp, Artificial sequence
  SiRNA target sequence
caattcagatggggaattaga

SEQ ID NO: 34405 - DNA, 21 bp, Artificial sequence
  SiRNA target sequence
aattcagatggggaattagac

SEQ ID NO: 34406 - DNA, 21 bp, Artificial sequence
  SiRNA target sequence
attcagatggggaattagaca

SEQ ID NO: 34407 - DNA, 21 bp, Artificial sequence
  SiRNA target sequence
ttcagatggggaattagacag

SEQ ID NO: 34408 - DNA, 21 bp, Artificial sequence
  SiRNA target sequence
tcagatggggaattagacagc

SEQ ID NO: 34409 - DNA, 21 bp, Artificial sequence
  SiRNA target sequence
cagatggggaattagacagca

SEQ ID NO: 34410 - DNA, 21 bp, Artificial sequence
  SiRNA target sequence
agatggggaattagacagcaa

SEQ ID NO: 34411 - DNA, 21 bp, Artificial sequence
  SiRNA target sequence
gatggggaattagacagcaaa

SEQ ID NO: 34412 - DNA, 21 bp, Artificial sequence
  SiRNA target sequence
atggggaattagacagcaaaa

SEQ ID NO: 34413 - DNA, 21 bp, Artificial sequence
  SiRNA target sequence
tggggaattagacagcaaaag

SEQ ID NO: 34414 - DNA, 21 bp, Artificial sequence
  SiRNA target sequence
ggggaattagacagcaaaagt

SEQ ID NO: 34415 - DNA, 21 bp, Artificial sequence
  SiRNA target sequence
gggaattagacagcaaaagta

SEQ ID NO: 34416 - DNA, 21 bp, Artificial sequence
  SiRNA target sequence
ggaattagacagcaaaagtat

SEQ ID NO: 34417 - DNA, 21 bp, Artificial sequence
  SiRNA target sequence
gaattagacagcaaaagtatc

SEQ ID NO: 34418 - DNA, 21 bp, Artificial sequence
  SiRNA target sequence
aattagacagcaaaagtatcg

SEQ ID NO: 34419 - DNA, 21 bp, Artificial sequence
  SiRNA target sequence
attagacagcaaaagtatcgt

SEQ ID NO: 34420 - DNA, 21 bp, Artificial sequence
  SiRNA target sequence
ttagacagcaaaagtatcgtt

SEQ ID NO: 34421 - DNA, 21 bp, Artificial sequence
  SiRNA target sequence
tagacagcaaaagtatcgttg

SEQ ID NO: 34422 - DNA, 21 bp, Artificial sequence
  SiRNA target sequence
agacagcaaaagtatcgttga

SEQ ID NO: 34423 - DNA, 21 bp, Artificial sequence
  SiRNA target sequence
gacagcaaaagtatcgttgaa

SEQ ID NO: 34424 - DNA, 21 bp, Artificial sequence
  SiRNA target sequence
acagcaaaagtatcgttgaaa

SEQ ID NO: 34425 - DNA, 21 bp, Artificial sequence
  SiRNA target sequence
cagcaaaagtatcgttgaaaa

SEQ ID NO: 34426 - DNA, 21 bp, Artificial sequence
  SiRNA target sequence
agcaaaagtatcgttgaaaat

SEQ ID NO: 34427 - DNA, 21 bp, Artificial sequence
  SiRNA target sequence
gcaaaagtatcgttgaaaata

SEQ ID NO: 34428 - DNA, 21 bp, Artificial sequence
  SiRNA target sequence
caaaagtatcgttgaaaatat

SEQ ID NO: 34429 - DNA, 21 bp, Artificial sequence
  SiRNA target sequence
aaaagtatcgttgaaaatata

SEQ ID NO: 34430 - DNA, 21 bp, Artificial sequence
  SiRNA target sequence
aaagtatcgttgaaaatataa

SEQ ID NO: 34431 - DNA, 21 bp, Artificial sequence
  SiRNA target sequence
aagtatcgttgaaaatataat

SEQ ID NO: 34432 - DNA, 21 bp, Artificial sequence
  SiRNA target sequence
agtatcgttgaaaatataatg

SEQ ID NO: 34433 - DNA, 21 bp, Artificial sequence
  SiRNA target sequence
gtatcgttgaaaatataatga

SEQ ID NO: 34434 - DNA, 21 bp, Artificial sequence
  SiRNA target sequence
tatcgttgaaaatataatgaa

SEQ ID NO: 34435 - DNA, 21 bp, Artificial sequence
  SiRNA target sequence
atcgttgaaaatataatgaag

SEQ ID NO: 34436 - DNA, 21 bp, Artificial sequence
  SiRNA target sequence
tcgttgaaaatataatgaagg

SEQ ID NO: 34437 - DNA, 21 bp, Artificial sequence
  SiRNA target sequence
cgttgaaaatataatgaagga

SEQ ID NO: 34438 - DNA, 21 bp, Artificial sequence
  SiRNA target sequence
gttgaaaatataatgaaggat

SEQ ID NO: 34439 - DNA, 21 bp, Artificial sequence
  SiRNA target sequence
ttgaaaatataatgaaggatg

SEQ ID NO: 34440 - DNA, 21 bp, Artificial sequence
  SiRNA target sequence
tgaaaatataatgaaggatgt

SEQ ID NO: 34441 - DNA, 21 bp, Artificial sequence
  SiRNA target sequence
gaaaatataatgaaggatgtt

SEQ ID NO: 34442 - DNA, 21 bp, Artificial sequence
  SiRNA target sequence
aaaatataatgaaggatgttt

SEQ ID NO: 34443 - DNA, 21 bp, Artificial sequence
  SiRNA target sequence
aaatataatgaaggatgttta

SEQ ID NO: 34444 - DNA, 21 bp, Artificial sequence
  SiRNA target sequence
aatataatgaaggatgtttat

SEQ ID NO: 34445 - DNA, 21 bp, Artificial sequence
  SiRNA target sequence
atataatgaaggatgtttatg

SEQ ID NO: 34446 - DNA, 21 bp, Artificial sequence
  SiRNA target sequence
tataatgaaggatgtttatga

SEQ ID NO: 34447 - DNA, 21 bp, Artificial sequence
  SiRNA target sequence
ataatgaaggatgtttatgag

SEQ ID NO: 34448 - DNA, 21 bp, Artificial sequence
  SiRNA target sequence
taatgaaggatgtttatgaga

SEQ ID NO: 34449 - DNA, 21 bp, Artificial sequence
  SiRNA target sequence
aatgaaggatgtttatgagat

SEQ ID NO: 34450 - DNA, 21 bp, Artificial sequence
  SiRNA target sequence
atgaaggatgtttatgagata

SEQ ID NO: 34451 - DNA, 21 bp, Artificial sequence
  SiRNA target sequence
tgaaggatgtttatgagatac

SEQ ID NO: 34452 - DNA, 21 bp, Artificial sequence
  SiRNA target sequence
gaaggatgtttatgagataca

SEQ ID NO: 34453 - DNA, 21 bp, Artificial sequence
  SiRNA target sequence
aaggatgtttatgagatacaa

SEQ ID NO: 34454 - DNA, 21 bp, Artificial sequence
  SiRNA target sequence
aggatgtttatgagatacaaa

SEQ ID NO: 34455 - DNA, 21 bp, Artificial sequence
  SiRNA target sequence
ggatgtttatgagatacaaag

SEQ ID NO: 34456 - DNA, 21 bp, Artificial sequence
  SiRNA target sequence
gatgtttatgagatacaaaga

SEQ ID NO: 34457 - DNA, 21 bp, Artificial sequence
  SiRNA target sequence
atgtttatgagatacaaagaa

SEQ ID NO: 34458 - DNA, 21 bp, Artificial sequence
  SiRNA target sequence
tgtttatgagatacaaagaat

SEQ ID NO: 34459 - DNA, 21 bp, Artificial sequence
  SiRNA target sequence
gtttatgagatacaaagaatt

SEQ ID NO: 34460 - DNA, 21 bp, Artificial sequence
  SiRNA target sequence
tttatgagatacaaagaattg

SEQ ID NO: 34461 - DNA, 21 bp, Artificial sequence
  SiRNA target sequence
ttatgagatacaaagaattga

SEQ ID NO: 34462 - DNA, 21 bp, Artificial sequence
  SiRNA target sequence
tatgagatacaaagaattgag

SEQ ID NO: 34463 - DNA, 21 bp, Artificial sequence
  SiRNA target sequence
atgagatacaaagaattgaga

SEQ ID NO: 34464 - DNA, 21 bp, Artificial sequence
  SiRNA target sequence
tgagatacaaagaattgagaa

SEQ ID NO: 34465 - DNA, 21 bp, Artificial sequence
  SiRNA target sequence
gagatacaaagaattgagaat

SEQ ID NO: 34466 - DNA, 21 bp, Artificial sequence
  SiRNA target sequence
agatacaaagaattgagaata

SEQ ID NO: 34467 - DNA, 21 bp, Artificial sequence
  SiRNA target sequence
gatacaaagaattgagaatat

SEQ ID NO: 34468 - DNA, 21 bp, Artificial sequence
  SiRNA target sequence
atacaaagaattgagaatatg

SEQ ID NO: 34469 - DNA, 21 bp, Artificial sequence
  SiRNA target sequence
tacaaagaattgagaatatgt

SEQ ID NO: 34470 - DNA, 21 bp, Artificial sequence
  SiRNA target sequence
acaaagaattgagaatatgta

SEQ ID NO: 34471 - DNA, 21 bp, Artificial sequence
  SiRNA target sequence
caaagaattgagaatatgtat

SEQ ID NO: 34472 - DNA, 21 bp, Artificial sequence
  SiRNA target sequence
aaagaattgagaatatgtata

SEQ ID NO: 34473 - DNA, 21 bp, Artificial sequence
  SiRNA target sequence
aagaattgagaatatgtataa

SEQ ID NO: 34474 - DNA, 21 bp, Artificial sequence
  SiRNA target sequence
agaattgagaatatgtataag

SEQ ID NO: 34475 - DNA, 21 bp, Artificial sequence
  SiRNA target sequence
gaattgagaatatgtataaga

SEQ ID NO: 34476 - DNA, 21 bp, Artificial sequence
  SiRNA target sequence
aattgagaatatgtataagaa

SEQ ID NO: 34477 - DNA, 21 bp, Artificial sequence
  SiRNA target sequence
attgagaatatgtataagaaa

SEQ ID NO: 34478 - DNA, 21 bp, Artificial sequence
  SiRNA target sequence
ttgagaatatgtataagaaag

SEQ ID NO: 34479 - DNA, 21 bp, Artificial sequence
  SiRNA target sequence
tgagaatatgtataagaaagg

SEQ ID NO: 34480 - DNA, 21 bp, Artificial sequence
  SiRNA target sequence
gagaatatgtataagaaaggt

SEQ ID NO: 34481 - DNA, 21 bp, Artificial sequence
  SiRNA target sequence
agaatatgtataagaaaggtt

SEQ ID NO: 34482 - DNA, 21 bp, Artificial sequence
  SiRNA target sequence
gaatatgtataagaaaggttt

SEQ ID NO: 34483 - DNA, 21 bp, Artificial sequence
  SiRNA target sequence
aatatgtataagaaaggtttg

SEQ ID NO: 34484 - DNA, 21 bp, Artificial sequence
  SiRNA target sequence
atatgtataagaaaggtttgg

SEQ ID NO: 34485 - DNA, 21 bp, Artificial sequence
  SiRNA target sequence
tatgtataagaaaggtttgga

SEQ ID NO: 34486 - DNA, 21 bp, Artificial sequence
  SiRNA target sequence
atgtataagaaaggtttggag

SEQ ID NO: 34487 - DNA, 21 bp, Artificial sequence
  SiRNA target sequence
tgtataagaaaggtttggaga

SEQ ID NO: 34488 - DNA, 21 bp, Artificial sequence
  SiRNA target sequence
gtataagaaaggtttggagat

SEQ ID NO: 34489 - DNA, 21 bp, Artificial sequence
  SiRNA target sequence
tataagaaaggtttggagatt

SEQ ID NO: 34490 - DNA, 21 bp, Artificial sequence
  SiRNA target sequence
ataagaaaggtttggagattt

SEQ ID NO: 34491 - DNA, 21 bp, Artificial sequence
  SiRNA target sequence
taagaaaggtttggagatttc

SEQ ID NO: 34492 - DNA, 21 bp, Artificial sequence
  SiRNA target sequence
aagaaaggtttggagatttct

SEQ ID NO: 34493 - DNA, 21 bp, Artificial sequence
  SiRNA target sequence
agaaaggtttggagatttctc

SEQ ID NO: 34494 - DNA, 21 bp, Artificial sequence
  SiRNA target sequence
gaaaggtttggagatttctcg

SEQ ID NO: 34495 - DNA, 21 bp, Artificial sequence
  SiRNA target sequence
aaaggtttggagatttctcgt

SEQ ID NO: 34496 - DNA, 21 bp, Artificial sequence
  SiRNA target sequence
aaggtttggagatttctcgta

SEQ ID NO: 34497 - DNA, 21 bp, Artificial sequence
  SiRNA target sequence
aggtttggagatttctcgtaa

SEQ ID NO: 34498 - DNA, 21 bp, Artificial sequence
  SiRNA target sequence
ggtttggagatttctcgtaac

SEQ ID NO: 34499 - DNA, 21 bp, Artificial sequence
  SiRNA target sequence
gtttggagatttctcgtaaca

SEQ ID NO: 34500 - DNA, 21 bp, Artificial sequence
  SiRNA target sequence
tttggagatttctcgtaacat

SEQ ID NO: 34501 - DNA, 21 bp, Artificial sequence
  SiRNA target sequence
ttggagatttctcgtaacata

SEQ ID NO: 34502 - DNA, 21 bp, Artificial sequence
  SiRNA target sequence
tggagatttctcgtaacatag

SEQ ID NO: 34503 - DNA, 21 bp, Artificial sequence
  SiRNA target sequence
ggagatttctcgtaacatagc

SEQ ID NO: 34504 - DNA, 21 bp, Artificial sequence
  SiRNA target sequence
gagatttctcgtaacatagct

SEQ ID NO: 34505 - DNA, 21 bp, Artificial sequence
  SiRNA target sequence
agatttctcgtaacatagctg

SEQ ID NO: 34506 - DNA, 21 bp, Artificial sequence
  SiRNA target sequence
gatttctcgtaacatagctga

SEQ ID NO: 34507 - DNA, 21 bp, Artificial sequence
  SiRNA target sequence
atttctcgtaacatagctgaa

SEQ ID NO: 34508 - DNA, 21 bp, Artificial sequence
  SiRNA target sequence
tttctcgtaacatagctgaat

SEQ ID NO: 34509 - DNA, 21 bp, Artificial sequence
  SiRNA target sequence
ttctcgtaacatagctgaatt

SEQ ID NO: 34510 - DNA, 21 bp, Artificial sequence
  SiRNA target sequence
tctcgtaacatagctgaatta

SEQ ID NO: 34511 - DNA, 21 bp, Artificial sequence
  SiRNA target sequence
ctcgtaacatagctgaattaa

SEQ ID NO: 34512 - DNA, 21 bp, Artificial sequence
  SiRNA target sequence
tcgtaacatagctgaattaaa

SEQ ID NO: 34513 - DNA, 21 bp, Artificial sequence
  SiRNA target sequence
cgtaacatagctgaattaaag

SEQ ID NO: 34514 - DNA, 21 bp, Artificial sequence
  SiRNA target sequence
gtaacatagctgaattaaagt

SEQ ID NO: 34515 - DNA, 21 bp, Artificial sequence
  SiRNA target sequence
taacatagctgaattaaagtt

SEQ ID NO: 34516 - DNA, 21 bp, Artificial sequence
  SiRNA target sequence
aacatagctgaattaaagtta

SEQ ID NO: 34517 - DNA, 21 bp, Artificial sequence
  SiRNA target sequence
acatagctgaattaaagttac

SEQ ID NO: 34518 - DNA, 21 bp, Artificial sequence
  SiRNA target sequence
catagctgaattaaagttacc

SEQ ID NO: 34519 - DNA, 21 bp, Artificial sequence
  SiRNA target sequence
atagctgaattaaagttacca

SEQ ID NO: 34520 - DNA, 21 bp, Artificial sequence
  SiRNA target sequence
tagctgaattaaagttaccaa

SEQ ID NO: 34521 - DNA, 21 bp, Artificial sequence
  SiRNA target sequence
agctgaattaaagttaccaac

SEQ ID NO: 34522 - DNA, 21 bp, Artificial sequence
  SiRNA target sequence
gctgaattaaagttaccaaca

SEQ ID NO: 34523 - DNA, 21 bp, Artificial sequence
  SiRNA target sequence
ctgaattaaagttaccaacaa

SEQ ID NO: 34524 - DNA, 21 bp, Artificial sequence
  SiRNA target sequence
tgaattaaagttaccaacaaa

SEQ ID NO: 34525 - DNA, 21 bp, Artificial sequence
  SiRNA target sequence
gaattaaagttaccaacaaaa

SEQ ID NO: 34526 - DNA, 21 bp, Artificial sequence
  SiRNA target sequence
aattaaagttaccaacaaaat

SEQ ID NO: 34527 - DNA, 21 bp, Artificial sequence
  SiRNA target sequence
attaaagttaccaacaaaatt

SEQ ID NO: 34528 - DNA, 21 bp, Artificial sequence
  SiRNA target sequence
ttaaagttaccaacaaaatta

SEQ ID NO: 34529 - DNA, 21 bp, Artificial sequence
  SiRNA target sequence
taaagttaccaacaaaattaa

SEQ ID NO: 34530 - DNA, 21 bp, Artificial sequence
  SiRNA target sequence
aaagttaccaacaaaattaac

SEQ ID NO: 34531 - DNA, 21 bp, Artificial sequence
  SiRNA target sequence
aagttaccaacaaaattaaca

SEQ ID NO: 34532 - DNA, 21 bp, Artificial sequence
  SiRNA target sequence
agttaccaacaaaattaacaa

SEQ ID NO: 34533 - DNA, 21 bp, Artificial sequence
  SiRNA target sequence
gttaccaacaaaattaacaat

SEQ ID NO: 34534 - DNA, 21 bp, Artificial sequence
  SiRNA target sequence
ttaccaacaaaattaacaatt

SEQ ID NO: 34535 - DNA, 21 bp, Artificial sequence
  SiRNA target sequence
taccaacaaaattaacaatta

SEQ ID NO: 34536 - DNA, 21 bp, Artificial sequence
  SiRNA target sequence
accaacaaaattaacaattag

SEQ ID NO: 34537 - DNA, 21 bp, Artificial sequence
  SiRNA target sequence
ccaacaaaattaacaattagt

SEQ ID NO: 34538 - DNA, 21 bp, Artificial sequence
  SiRNA target sequence
caacaaaattaacaattagtt

SEQ ID NO: 34539 - DNA, 21 bp, Artificial sequence
  SiRNA target sequence
aacaaaattaacaattagttt

SEQ ID NO: 34540 - DNA, 21 bp, Artificial sequence
  SiRNA target sequence
acaaaattaacaattagtttt

SEQ ID NO: 34541 - DNA, 21 bp, Artificial sequence
  SiRNA target sequence
caaaattaacaattagtttta

SEQ ID NO: 34542 - DNA, 21 bp, Artificial sequence
  SiRNA target sequence
aaaattaacaattagttttaa

SEQ ID NO: 34543 - DNA, 21 bp, Artificial sequence
  SiRNA target sequence
aaattaacaattagttttaat

SEQ ID NO: 34544 - DNA, 21 bp, Artificial sequence
  SiRNA target sequence
aattaacaattagttttaata

SEQ ID NO: 34545 - DNA, 21 bp, Artificial sequence
  SiRNA target sequence
attaacaattagttttaatac

SEQ ID NO: 34546 - DNA, 21 bp, Artificial sequence
  SiRNA target sequence
ttaacaattagttttaatacg

SEQ ID NO: 34547 - DNA, 21 bp, Artificial sequence
  SiRNA target sequence
taacaattagttttaatacgc

SEQ ID NO: 34548 - DNA, 21 bp, Artificial sequence
  SiRNA target sequence
aacaattagttttaatacgca

SEQ ID NO: 34549 - DNA, 21 bp, Artificial sequence
  SiRNA target sequence
acaattagttttaatacgcac

SEQ ID NO: 34550 - DNA, 21 bp, Artificial sequence
  SiRNA target sequence
caattagttttaatacgcaca

SEQ ID NO: 34551 - DNA, 21 bp, Artificial sequence
  SiRNA target sequence
aattagttttaatacgcacat

SEQ ID NO: 34552 - DNA, 21 bp, Artificial sequence
  SiRNA target sequence
attagttttaatacgcacatg

SEQ ID NO: 34553 - DNA, 21 bp, Artificial sequence
  SiRNA target sequence
ttagttttaatacgcacatga

SEQ ID NO: 34554 - DNA, 21 bp, Artificial sequence
  SiRNA target sequence
tagttttaatacgcacatgag

SEQ ID NO: 34555 - DNA, 21 bp, Artificial sequence
  SiRNA target sequence
agttttaatacgcacatgaga

SEQ ID NO: 34556 - DNA, 21 bp, Artificial sequence
  SiRNA target sequence
gttttaatacgcacatgagat

SEQ ID NO: 34557 - DNA, 21 bp, Artificial sequence
  SiRNA target sequence
ttttaatacgcacatgagata

SEQ ID NO: 34558 - DNA, 21 bp, Artificial sequence
  SiRNA target sequence
tttaatacgcacatgagatac

SEQ ID NO: 34559 - DNA, 21 bp, Artificial sequence
  SiRNA target sequence
ttaatacgcacatgagatact

SEQ ID NO: 34560 - DNA, 21 bp, Artificial sequence
  SiRNA target sequence
taatacgcacatgagatactt

SEQ ID NO: 34561 - DNA, 21 bp, Artificial sequence
  SiRNA target sequence
aatacgcacatgagatacttg

SEQ ID NO: 34562 - DNA, 21 bp, Artificial sequence
  SiRNA target sequence
atacgcacatgagatacttga

SEQ ID NO: 34563 - DNA, 21 bp, Artificial sequence
  SiRNA target sequence
tacgcacatgagatacttgac

SEQ ID NO: 34564 - DNA, 21 bp, Artificial sequence
  SiRNA target sequence
acgcacatgagatacttgact

SEQ ID NO: 34565 - DNA, 21 bp, Artificial sequence
  SiRNA target sequence
cgcacatgagatacttgactg

SEQ ID NO: 34566 - DNA, 21 bp, Artificial sequence
  SiRNA target sequence
gcacatgagatacttgactga

SEQ ID NO: 34567 - DNA, 21 bp, Artificial sequence
  SiRNA target sequence
cacatgagatacttgactgaa

SEQ ID NO: 34568 - DNA, 21 bp, Artificial sequence
  SiRNA target sequence
acatgagatacttgactgaag

SEQ ID NO: 34569 - DNA, 21 bp, Artificial sequence
  SiRNA target sequence
catgagatacttgactgaagt

SEQ ID NO: 34570 - DNA, 21 bp, Artificial sequence
  SiRNA target sequence
atgagatacttgactgaagtt

SEQ ID NO: 34571 - DNA, 21 bp, Artificial sequence
  SiRNA target sequence
tgagatacttgactgaagttt

SEQ ID NO: 34572 - DNA, 21 bp, Artificial sequence
  SiRNA target sequence
gagatacttgactgaagtttt

SEQ ID NO: 34573 - DNA, 21 bp, Artificial sequence
  SiRNA target sequence
agatacttgactgaagttttc

SEQ ID NO: 34574 - DNA, 21 bp, Artificial sequence
  SiRNA target sequence
gatacttgactgaagttttca

SEQ ID NO: 34575 - DNA, 21 bp, Artificial sequence
  SiRNA target sequence
atacttgactgaagttttcaa

SEQ ID NO: 34576 - DNA, 21 bp, Artificial sequence
  SiRNA target sequence
tacttgactgaagttttcaaa

SEQ ID NO: 34577 - DNA, 21 bp, Artificial sequence
  SiRNA target sequence
acttgactgaagttttcaaat

SEQ ID NO: 34578 - DNA, 21 bp, Artificial sequence
  SiRNA target sequence
cttgactgaagttttcaaatc

SEQ ID NO: 34579 - DNA, 21 bp, Artificial sequence
  SiRNA target sequence
ttgactgaagttttcaaatca

SEQ ID NO: 34580 - DNA, 21 bp, Artificial sequence
  SiRNA target sequence
tgactgaagttttcaaatcag

SEQ ID NO: 34581 - DNA, 21 bp, Artificial sequence
  SiRNA target sequence
gactgaagttttcaaatcagt

SEQ ID NO: 34582 - DNA, 21 bp, Artificial sequence
  SiRNA target sequence
actgaagttttcaaatcagtt

SEQ ID NO: 34583 - DNA, 21 bp, Artificial sequence
  SiRNA target sequence
ctgaagttttcaaatcagttg

SEQ ID NO: 34584 - DNA, 21 bp, Artificial sequence
  SiRNA target sequence
tgaagttttcaaatcagttga

SEQ ID NO: 34585 - DNA, 21 bp, Artificial sequence
  SiRNA target sequence
gaagttttcaaatcagttgac

SEQ ID NO: 34586 - DNA, 21 bp, Artificial sequence
  SiRNA target sequence
aagttttcaaatcagttgaca

SEQ ID NO: 34587 - DNA, 21 bp, Artificial sequence
  SiRNA target sequence
agttttcaaatcagttgacac

SEQ ID NO: 34588 - DNA, 21 bp, Artificial sequence
  SiRNA target sequence
gttttcaaatcagttgacaca

SEQ ID NO: 34589 - DNA, 21 bp, Artificial sequence
  SiRNA target sequence
ttttcaaatcagttgacacat

SEQ ID NO: 34590 - DNA, 21 bp, Artificial sequence
  SiRNA target sequence
tttcaaatcagttgacacatc

SEQ ID NO: 34591 - DNA, 21 bp, Artificial sequence
  SiRNA target sequence
ttcaaatcagttgacacatct

SEQ ID NO: 34592 - DNA, 21 bp, Artificial sequence
  SiRNA target sequence
tcaaatcagttgacacatctg

SEQ ID NO: 34593 - DNA, 21 bp, Artificial sequence
  SiRNA target sequence
caaatcagttgacacatctgg

SEQ ID NO: 34594 - DNA, 21 bp, Artificial sequence
  SiRNA target sequence
aaatcagttgacacatctgga

SEQ ID NO: 34595 - DNA, 21 bp, Artificial sequence
  SiRNA target sequence
aatcagttgacacatctggag

SEQ ID NO: 34596 - DNA, 21 bp, Artificial sequence
  SiRNA target sequence
atcagttgacacatctggagc

SEQ ID NO: 34597 - DNA, 21 bp, Artificial sequence
  SiRNA target sequence
tcagttgacacatctggagct

SEQ ID NO: 34598 - DNA, 21 bp, Artificial sequence
  SiRNA target sequence
cagttgacacatctggagctt

SEQ ID NO: 34599 - DNA, 21 bp, Artificial sequence
  SiRNA target sequence
agttgacacatctggagcttt

SEQ ID NO: 34600 - DNA, 21 bp, Artificial sequence
  SiRNA target sequence
gttgacacatctggagctttt

SEQ ID NO: 34601 - DNA, 21 bp, Artificial sequence
  SiRNA target sequence
ttgacacatctggagcttttg

SEQ ID NO: 34602 - DNA, 21 bp, Artificial sequence
  SiRNA target sequence
tgacacatctggagcttttgg

SEQ ID NO: 34603 - DNA, 21 bp, Artificial sequence
  SiRNA target sequence
gacacatctggagcttttgga

SEQ ID NO: 34604 - DNA, 21 bp, Artificial sequence
  SiRNA target sequence
acacatctggagcttttggaa

SEQ ID NO: 34605 - DNA, 21 bp, Artificial sequence
  SiRNA target sequence
cacatctggagcttttggaaa

SEQ ID NO: 34606 - DNA, 21 bp, Artificial sequence
  SiRNA target sequence
acatctggagcttttggaaac

SEQ ID NO: 34607 - DNA, 21 bp, Artificial sequence
  SiRNA target sequence
catctggagcttttggaaaca

SEQ ID NO: 34608 - DNA, 21 bp, Artificial sequence
  SiRNA target sequence
atctggagcttttggaaacaa

SEQ ID NO: 34609 - DNA, 21 bp, Artificial sequence
  SiRNA target sequence
tctggagcttttggaaacaaa

SEQ ID NO: 34610 - DNA, 21 bp, Artificial sequence
  SiRNA target sequence
ctggagcttttggaaacaaac

SEQ ID NO: 34611 - DNA, 21 bp, Artificial sequence
  SiRNA target sequence
tggagcttttggaaacaaacc

SEQ ID NO: 34612 - DNA, 21 bp, Artificial sequence
  SiRNA target sequence
ggagcttttggaaacaaacct

SEQ ID NO: 34613 - DNA, 21 bp, Artificial sequence
  SiRNA target sequence
gagcttttggaaacaaacctc

SEQ ID NO: 34614 - DNA, 21 bp, Artificial sequence
  SiRNA target sequence
agcttttggaaacaaacctcg

SEQ ID NO: 34615 - DNA, 21 bp, Artificial sequence
  SiRNA target sequence
gcttttggaaacaaacctcga

SEQ ID NO: 34616 - DNA, 21 bp, Artificial sequence
  SiRNA target sequence
cttttggaaacaaacctcgaa

SEQ ID NO: 34617 - DNA, 21 bp, Artificial sequence
  SiRNA target sequence
ttttggaaacaaacctcgaac

SEQ ID NO: 34618 - DNA, 21 bp, Artificial sequence
  SiRNA target sequence
tttggaaacaaacctcgaacg

SEQ ID NO: 34619 - DNA, 21 bp, Artificial sequence
  SiRNA target sequence
ttggaaacaaacctcgaacgc

SEQ ID NO: 34620 - DNA, 21 bp, Artificial sequence
  SiRNA target sequence
tggaaacaaacctcgaacgca

SEQ ID NO: 34621 - DNA, 21 bp, Artificial sequence
  SiRNA target sequence
ggaaacaaacctcgaacgcaa

SEQ ID NO: 34622 - DNA, 21 bp, Artificial sequence
  SiRNA target sequence
gaaacaaacctcgaacgcaac

SEQ ID NO: 34623 - DNA, 21 bp, Artificial sequence
  SiRNA target sequence
aaacaaacctcgaacgcaacc

SEQ ID NO: 34624 - DNA, 21 bp, Artificial sequence
  SiRNA target sequence
aacaaacctcgaacgcaacca

SEQ ID NO: 34625 - DNA, 21 bp, Artificial sequence
  SiRNA target sequence
acaaacctcgaacgcaaccaa

SEQ ID NO: 34626 - DNA, 21 bp, Artificial sequence
  SiRNA target sequence
caaacctcgaacgcaaccaat

SEQ ID NO: 34627 - DNA, 21 bp, Artificial sequence
  SiRNA target sequence
aaacctcgaacgcaaccaata

SEQ ID NO: 34628 - DNA, 21 bp, Artificial sequence
  SiRNA target sequence
aacctcgaacgcaaccaatag

SEQ ID NO: 34629 - DNA, 21 bp, Artificial sequence
  SiRNA target sequence
acctcgaacgcaaccaatagt

SEQ ID NO: 34630 - DNA, 21 bp, Artificial sequence
  SiRNA target sequence
cctcgaacgcaaccaatagtt

SEQ ID NO: 34631 - DNA, 21 bp, Artificial sequence
  SiRNA target sequence
ctcgaacgcaaccaatagtta

SEQ ID NO: 34632 - DNA, 21 bp, Artificial sequence
  SiRNA target sequence
tcgaacgcaaccaatagttat

SEQ ID NO: 34633 - DNA, 21 bp, Artificial sequence
  SiRNA target sequence
cgaacgcaaccaatagttatt

SEQ ID NO: 34634 - DNA, 21 bp, Artificial sequence
  SiRNA target sequence
gaacgcaaccaatagttattt

SEQ ID NO: 34635 - DNA, 21 bp, Artificial sequence
  SiRNA target sequence
aacgcaaccaatagttatttg

SEQ ID NO: 34636 - DNA, 21 bp, Artificial sequence
  SiRNA target sequence
acgcaaccaatagttatttgg

SEQ ID NO: 34637 - DNA, 21 bp, Artificial sequence
  SiRNA target sequence
cgcaaccaatagttatttggc

SEQ ID NO: 34638 - DNA, 21 bp, Artificial sequence
  SiRNA target sequence
gcaaccaatagttatttggct

SEQ ID NO: 34639 - DNA, 21 bp, Artificial sequence
  SiRNA target sequence
caaccaatagttatttggctt

SEQ ID NO: 34640 - DNA, 21 bp, Artificial sequence
  SiRNA target sequence
aaccaatagttatttggcttt

SEQ ID NO: 34641 - DNA, 21 bp, Artificial sequence
  SiRNA target sequence
accaatagttatttggctttt

SEQ ID NO: 34642 - DNA, 21 bp, Artificial sequence
  SiRNA target sequence
ccaatagttatttggcttttt

SEQ ID NO: 34643 - DNA, 21 bp, Artificial sequence
  SiRNA target sequence
caatagttatttggctttttg

SEQ ID NO: 34644 - DNA, 21 bp, Artificial sequence
  SiRNA target sequence
aatagttatttggctttttgg

SEQ ID NO: 34645 - DNA, 21 bp, Artificial sequence
  SiRNA target sequence
atagttatttggctttttgga

SEQ ID NO: 34646 - DNA, 21 bp, Artificial sequence
  SiRNA target sequence
tagttatttggctttttggag

SEQ ID NO: 34647 - DNA, 21 bp, Artificial sequence
  SiRNA target sequence
agttatttggctttttggaga

SEQ ID NO: 34648 - DNA, 21 bp, Artificial sequence
  SiRNA target sequence
gttatttggctttttggagaa

SEQ ID NO: 34649 - DNA, 21 bp, Artificial sequence
  SiRNA target sequence
ttatttggctttttggagaat

SEQ ID NO: 34650 - DNA, 21 bp, Artificial sequence
  SiRNA target sequence
tatttggctttttggagaatc

SEQ ID NO: 34651 - DNA, 21 bp, Artificial sequence
  SiRNA target sequence
atttggctttttggagaatca

SEQ ID NO: 34652 - DNA, 21 bp, Artificial sequence
  SiRNA target sequence
tttggctttttggagaatcag

SEQ ID NO: 34653 - DNA, 21 bp, Artificial sequence
  SiRNA target sequence
ttggctttttggagaatcagg

SEQ ID NO: 34654 - DNA, 21 bp, Artificial sequence
  SiRNA target sequence
tggctttttggagaatcagga

SEQ ID NO: 34655 - DNA, 21 bp, Artificial sequence
  SiRNA target sequence
ggctttttggagaatcaggaa

SEQ ID NO: 34656 - DNA, 21 bp, Artificial sequence
  SiRNA target sequence
gctttttggagaatcaggaag

SEQ ID NO: 34657 - DNA, 21 bp, Artificial sequence
  SiRNA target sequence
ctttttggagaatcaggaaga

SEQ ID NO: 34658 - DNA, 21 bp, Artificial sequence
  SiRNA target sequence
tttttggagaatcaggaagag

SEQ ID NO: 34659 - DNA, 21 bp, Artificial sequence
  SiRNA target sequence
ttttggagaatcaggaagagg

SEQ ID NO: 34660 - DNA, 21 bp, Artificial sequence
  SiRNA target sequence
tttggagaatcaggaagagga

SEQ ID NO: 34661 - DNA, 21 bp, Artificial sequence
  SiRNA target sequence
ttggagaatcaggaagaggaa

SEQ ID NO: 34662 - DNA, 21 bp, Artificial sequence
  SiRNA target sequence
tggagaatcaggaagaggaaa

SEQ ID NO: 34663 - DNA, 21 bp, Artificial sequence
  SiRNA target sequence
ggagaatcaggaagaggaaaa

SEQ ID NO: 34664 - DNA, 21 bp, Artificial sequence
  SiRNA target sequence
gagaatcaggaagaggaaaat

SEQ ID NO: 34665 - DNA, 21 bp, Artificial sequence
  SiRNA target sequence
agaatcaggaagaggaaaatc

SEQ ID NO: 34666 - DNA, 21 bp, Artificial sequence
  SiRNA target sequence
gaatcaggaagaggaaaatcg

SEQ ID NO: 34667 - DNA, 21 bp, Artificial sequence
  SiRNA target sequence
aatcaggaagaggaaaatcgg

SEQ ID NO: 34668 - DNA, 21 bp, Artificial sequence
  SiRNA target sequence
atcaggaagaggaaaatcggg

SEQ ID NO: 34669 - DNA, 21 bp, Artificial sequence
  SiRNA target sequence
tcaggaagaggaaaatcgggg

SEQ ID NO: 34670 - DNA, 21 bp, Artificial sequence
  SiRNA target sequence
caggaagaggaaaatcgggga

SEQ ID NO: 34671 - DNA, 21 bp, Artificial sequence
  SiRNA target sequence
aggaagaggaaaatcggggat

SEQ ID NO: 34672 - DNA, 21 bp, Artificial sequence
  SiRNA target sequence
ggaagaggaaaatcggggatg

SEQ ID NO: 34673 - DNA, 21 bp, Artificial sequence
  SiRNA target sequence
gaagaggaaaatcggggatga

SEQ ID NO: 34674 - DNA, 21 bp, Artificial sequence
  SiRNA target sequence
aagaggaaaatcggggatgac

SEQ ID NO: 34675 - DNA, 21 bp, Artificial sequence
  SiRNA target sequence
agaggaaaatcggggatgact

SEQ ID NO: 34676 - DNA, 21 bp, Artificial sequence
  SiRNA target sequence
gaggaaaatcggggatgactt

SEQ ID NO: 34677 - DNA, 21 bp, Artificial sequence
  SiRNA target sequence
aggaaaatcggggatgacttg

SEQ ID NO: 34678 - DNA, 21 bp, Artificial sequence
  SiRNA target sequence
ggaaaatcggggatgacttgg

SEQ ID NO: 34679 - DNA, 21 bp, Artificial sequence
  SiRNA target sequence
gaaaatcggggatgacttggc

SEQ ID NO: 34680 - DNA, 21 bp, Artificial sequence
  SiRNA target sequence
aaaatcggggatgacttggcc

SEQ ID NO: 34681 - DNA, 21 bp, Artificial sequence
  SiRNA target sequence
aaatcggggatgacttggcct

SEQ ID NO: 34682 - DNA, 21 bp, Artificial sequence
  SiRNA target sequence
aatcggggatgacttggcctc

SEQ ID NO: 34683 - DNA, 21 bp, Artificial sequence
  SiRNA target sequence
atcggggatgacttggcctct

SEQ ID NO: 34684 - DNA, 21 bp, Artificial sequence
  SiRNA target sequence
tcggggatgacttggcctcta

SEQ ID NO: 34685 - DNA, 21 bp, Artificial sequence
  SiRNA target sequence
cggggatgacttggcctctag

SEQ ID NO: 34686 - DNA, 21 bp, Artificial sequence
  SiRNA target sequence
ggggatgacttggcctctagc

SEQ ID NO: 34687 - DNA, 21 bp, Artificial sequence
  SiRNA target sequence
gggatgacttggcctctagca

SEQ ID NO: 34688 - DNA, 21 bp, Artificial sequence
  SiRNA target sequence
ggatgacttggcctctagcaa

SEQ ID NO: 34689 - DNA, 21 bp, Artificial sequence
  SiRNA target sequence
gatgacttggcctctagcaat

SEQ ID NO: 34690 - DNA, 21 bp, Artificial sequence
  SiRNA target sequence
atgacttggcctctagcaata

SEQ ID NO: 34691 - DNA, 21 bp, Artificial sequence
  SiRNA target sequence
tgacttggcctctagcaatag

SEQ ID NO: 34692 - DNA, 21 bp, Artificial sequence
  SiRNA target sequence
gacttggcctctagcaataga

SEQ ID NO: 34693 - DNA, 21 bp, Artificial sequence
  SiRNA target sequence
acttggcctctagcaatagat

SEQ ID NO: 34694 - DNA, 21 bp, Artificial sequence
  SiRNA target sequence
cttggcctctagcaatagatc

SEQ ID NO: 34695 - DNA, 21 bp, Artificial sequence
  SiRNA target sequence
ttggcctctagcaatagatct

SEQ ID NO: 34696 - DNA, 21 bp, Artificial sequence
  SiRNA target sequence
tggcctctagcaatagatcta

SEQ ID NO: 34697 - DNA, 21 bp, Artificial sequence
  SiRNA target sequence
ggcctctagcaatagatctaa

SEQ ID NO: 34698 - DNA, 21 bp, Artificial sequence
  SiRNA target sequence
gcctctagcaatagatctaaa

SEQ ID NO: 34699 - DNA, 21 bp, Artificial sequence
  SiRNA target sequence
cctctagcaatagatctaaat

SEQ ID NO: 34700 - DNA, 21 bp, Artificial sequence
  SiRNA target sequence
ctctagcaatagatctaaata

SEQ ID NO: 34701 - DNA, 21 bp, Artificial sequence
  SiRNA target sequence
tctagcaatagatctaaataa

SEQ ID NO: 34702 - DNA, 21 bp, Artificial sequence
  SiRNA target sequence
ctagcaatagatctaaataac

SEQ ID NO: 34703 - DNA, 21 bp, Artificial sequence
  SiRNA target sequence
tagcaatagatctaaataaca

SEQ ID NO: 34704 - DNA, 21 bp, Artificial sequence
  SiRNA target sequence
agcaatagatctaaataacag

SEQ ID NO: 34705 - DNA, 21 bp, Artificial sequence
  SiRNA target sequence
gcaatagatctaaataacagc

SEQ ID NO: 34706 - DNA, 21 bp, Artificial sequence
  SiRNA target sequence
caatagatctaaataacagct

SEQ ID NO: 34707 - DNA, 21 bp, Artificial sequence
  SiRNA target sequence
aatagatctaaataacagctt

SEQ ID NO: 34708 - DNA, 21 bp, Artificial sequence
  SiRNA target sequence
atagatctaaataacagctta

SEQ ID NO: 34709 - DNA, 21 bp, Artificial sequence
  SiRNA target sequence
tagatctaaataacagcttac

SEQ ID NO: 34710 - DNA, 21 bp, Artificial sequence
  SiRNA target sequence
agatctaaataacagcttact

SEQ ID NO: 34711 - DNA, 21 bp, Artificial sequence
  SiRNA target sequence
gatctaaataacagcttactt

SEQ ID NO: 34712 - DNA, 21 bp, Artificial sequence
  SiRNA target sequence
atctaaataacagcttacttg

SEQ ID NO: 34713 - DNA, 21 bp, Artificial sequence
  SiRNA target sequence
tctaaataacagcttacttga

SEQ ID NO: 34714 - DNA, 21 bp, Artificial sequence
  SiRNA target sequence
ctaaataacagcttacttgat

SEQ ID NO: 34715 - DNA, 21 bp, Artificial sequence
  SiRNA target sequence
taaataacagcttacttgata

SEQ ID NO: 34716 - DNA, 21 bp, Artificial sequence
  SiRNA target sequence
aaataacagcttacttgataa

SEQ ID NO: 34717 - DNA, 21 bp, Artificial sequence
  SiRNA target sequence
aataacagcttacttgataat

SEQ ID NO: 34718 - DNA, 21 bp, Artificial sequence
  SiRNA target sequence
ataacagcttacttgataatg

SEQ ID NO: 34719 - DNA, 21 bp, Artificial sequence
  SiRNA target sequence
taacagcttacttgataatgt

SEQ ID NO: 34720 - DNA, 21 bp, Artificial sequence
  SiRNA target sequence
aacagcttacttgataatgta

SEQ ID NO: 34721 - DNA, 21 bp, Artificial sequence
  SiRNA target sequence
acagcttacttgataatgtag

SEQ ID NO: 34722 - DNA, 21 bp, Artificial sequence
  SiRNA target sequence
cagcttacttgataatgtaga

SEQ ID NO: 34723 - DNA, 21 bp, Artificial sequence
  SiRNA target sequence
agcttacttgataatgtagat

SEQ ID NO: 34724 - DNA, 21 bp, Artificial sequence
  SiRNA target sequence
gcttacttgataatgtagatg

SEQ ID NO: 34725 - DNA, 21 bp, Artificial sequence
  SiRNA target sequence
cttacttgataatgtagatga

SEQ ID NO: 34726 - DNA, 21 bp, Artificial sequence
  SiRNA target sequence
ttacttgataatgtagatgaa

SEQ ID NO: 34727 - DNA, 21 bp, Artificial sequence
  SiRNA target sequence
tacttgataatgtagatgaaa

SEQ ID NO: 34728 - DNA, 21 bp, Artificial sequence
  SiRNA target sequence
acttgataatgtagatgaaat

SEQ ID NO: 34729 - DNA, 21 bp, Artificial sequence
  SiRNA target sequence
cttgataatgtagatgaaatg

SEQ ID NO: 34730 - DNA, 21 bp, Artificial sequence
  SiRNA target sequence
ttgataatgtagatgaaatga

SEQ ID NO: 34731 - DNA, 21 bp, Artificial sequence
  SiRNA target sequence
tgataatgtagatgaaatgag

SEQ ID NO: 34732 - DNA, 21 bp, Artificial sequence
  SiRNA target sequence
gataatgtagatgaaatgagg

SEQ ID NO: 34733 - DNA, 21 bp, Artificial sequence
  SiRNA target sequence
ataatgtagatgaaatgagga

SEQ ID NO: 34734 - DNA, 21 bp, Artificial sequence
  SiRNA target sequence
taatgtagatgaaatgaggaa

SEQ ID NO: 34735 - DNA, 21 bp, Artificial sequence
  SiRNA target sequence
aatgtagatgaaatgaggaat

SEQ ID NO: 34736 - DNA, 21 bp, Artificial sequence
  SiRNA target sequence
atgtagatgaaatgaggaatt

SEQ ID NO: 34737 - DNA, 21 bp, Artificial sequence
  SiRNA target sequence
tgtagatgaaatgaggaattt

SEQ ID NO: 34738 - DNA, 21 bp, Artificial sequence
  SiRNA target sequence
gtagatgaaatgaggaatttt

SEQ ID NO: 34739 - DNA, 21 bp, Artificial sequence
  SiRNA target sequence
tagatgaaatgaggaattttt

SEQ ID NO: 34740 - DNA, 21 bp, Artificial sequence
  SiRNA target sequence
agatgaaatgaggaatttttc

SEQ ID NO: 34741 - DNA, 21 bp, Artificial sequence
  SiRNA target sequence
gatgaaatgaggaatttttca

SEQ ID NO: 34742 - DNA, 21 bp, Artificial sequence
  SiRNA target sequence
atgaaatgaggaatttttcaa

SEQ ID NO: 34743 - DNA, 21 bp, Artificial sequence
  SiRNA target sequence
tgaaatgaggaatttttcaaa

SEQ ID NO: 34744 - DNA, 21 bp, Artificial sequence
  SiRNA target sequence
gaaatgaggaatttttcaaag

SEQ ID NO: 34745 - DNA, 21 bp, Artificial sequence
  SiRNA target sequence
aaatgaggaatttttcaaaga

SEQ ID NO: 34746 - DNA, 21 bp, Artificial sequence
  SiRNA target sequence
aatgaggaatttttcaaagaa

SEQ ID NO: 34747 - DNA, 21 bp, Artificial sequence
  SiRNA target sequence
atgaggaatttttcaaagaac

SEQ ID NO: 34748 - DNA, 21 bp, Artificial sequence
  SiRNA target sequence
tgaggaatttttcaaagaaca

SEQ ID NO: 34749 - DNA, 21 bp, Artificial sequence
  SiRNA target sequence
gaggaatttttcaaagaacat

SEQ ID NO: 34750 - DNA, 21 bp, Artificial sequence
  SiRNA target sequence
aggaatttttcaaagaacatc

SEQ ID NO: 34751 - DNA, 21 bp, Artificial sequence
  SiRNA target sequence
ggaatttttcaaagaacatct

SEQ ID NO: 34752 - DNA, 21 bp, Artificial sequence
  SiRNA target sequence
gaatttttcaaagaacatcta

SEQ ID NO: 34753 - DNA, 21 bp, Artificial sequence
  SiRNA target sequence
aatttttcaaagaacatctat

SEQ ID NO: 34754 - DNA, 21 bp, Artificial sequence
  SiRNA target sequence
atttttcaaagaacatctata

SEQ ID NO: 34755 - DNA, 21 bp, Artificial sequence
  SiRNA target sequence
tttttcaaagaacatctatat

SEQ ID NO: 34756 - DNA, 21 bp, Artificial sequence
  SiRNA target sequence
ttttcaaagaacatctatatg

SEQ ID NO: 34757 - DNA, 21 bp, Artificial sequence
  SiRNA target sequence
tttcaaagaacatctatatga

SEQ ID NO: 34758 - DNA, 21 bp, Artificial sequence
  SiRNA target sequence
ttcaaagaacatctatatgag

SEQ ID NO: 34759 - DNA, 21 bp, Artificial sequence
  SiRNA target sequence
tcaaagaacatctatatgaga

SEQ ID NO: 34760 - DNA, 21 bp, Artificial sequence
  SiRNA target sequence
caaagaacatctatatgagaa

SEQ ID NO: 34761 - DNA, 21 bp, Artificial sequence
  SiRNA target sequence
aaagaacatctatatgagaaa

SEQ ID NO: 34762 - DNA, 21 bp, Artificial sequence
  SiRNA target sequence
aagaacatctatatgagaaat

SEQ ID NO: 34763 - DNA, 21 bp, Artificial sequence
  SiRNA target sequence
agaacatctatatgagaaatg

SEQ ID NO: 34764 - DNA, 21 bp, Artificial sequence
  SiRNA target sequence
gaacatctatatgagaaatgt

SEQ ID NO: 34765 - DNA, 21 bp, Artificial sequence
  SiRNA target sequence
aacatctatatgagaaatgtt

SEQ ID NO: 34766 - DNA, 21 bp, Artificial sequence
  SiRNA target sequence
acatctatatgagaaatgttg

SEQ ID NO: 34767 - DNA, 21 bp, Artificial sequence
  SiRNA target sequence
catctatatgagaaatgttga

SEQ ID NO: 34768 - DNA, 21 bp, Artificial sequence
  SiRNA target sequence
atctatatgagaaatgttgaa

SEQ ID NO: 34769 - DNA, 21 bp, Artificial sequence
  SiRNA target sequence
tctatatgagaaatgttgaac

SEQ ID NO: 34770 - DNA, 21 bp, Artificial sequence
  SiRNA target sequence
ctatatgagaaatgttgaaca

SEQ ID NO: 34771 - DNA, 21 bp, Artificial sequence
  SiRNA target sequence
tatatgagaaatgttgaacag

SEQ ID NO: 34772 - DNA, 21 bp, Artificial sequence
  SiRNA target sequence
atatgagaaatgttgaacagg

SEQ ID NO: 34773 - DNA, 21 bp, Artificial sequence
  SiRNA target sequence
tatgagaaatgttgaacagga

SEQ ID NO: 34774 - DNA, 21 bp, Artificial sequence
  SiRNA target sequence
atgagaaatgttgaacaggaa

SEQ ID NO: 34775 - DNA, 21 bp, Artificial sequence
  SiRNA target sequence
tgagaaatgttgaacaggaat

SEQ ID NO: 34776 - DNA, 21 bp, Artificial sequence
  SiRNA target sequence
gagaaatgttgaacaggaatt

SEQ ID NO: 34777 - DNA, 21 bp, Artificial sequence
  SiRNA target sequence
agaaatgttgaacaggaattc

SEQ ID NO: 34778 - DNA, 21 bp, Artificial sequence
  SiRNA target sequence
gaaatgttgaacaggaattct

SEQ ID NO: 34779 - DNA, 21 bp, Artificial sequence
  SiRNA target sequence
aaatgttgaacaggaattctg

SEQ ID NO: 34780 - DNA, 21 bp, Artificial sequence
  SiRNA target sequence
aatgttgaacaggaattctgg

SEQ ID NO: 34781 - DNA, 21 bp, Artificial sequence
  SiRNA target sequence
atgttgaacaggaattctggg

SEQ ID NO: 34782 - DNA, 21 bp, Artificial sequence
  SiRNA target sequence
tgttgaacaggaattctggga

SEQ ID NO: 34783 - DNA, 21 bp, Artificial sequence
  SiRNA target sequence
gttgaacaggaattctgggat

SEQ ID NO: 34784 - DNA, 21 bp, Artificial sequence
  SiRNA target sequence
ttgaacaggaattctgggata

SEQ ID NO: 34785 - DNA, 21 bp, Artificial sequence
  SiRNA target sequence
tgaacaggaattctgggataa

SEQ ID NO: 34786 - DNA, 21 bp, Artificial sequence
  SiRNA target sequence
gaacaggaattctgggataat

SEQ ID NO: 34787 - DNA, 21 bp, Artificial sequence
  SiRNA target sequence
aacaggaattctgggataatt

SEQ ID NO: 34788 - DNA, 21 bp, Artificial sequence
  SiRNA target sequence
acaggaattctgggataatta

SEQ ID NO: 34789 - DNA, 21 bp, Artificial sequence
  SiRNA target sequence
caggaattctgggataattat

SEQ ID NO: 34790 - DNA, 21 bp, Artificial sequence
  SiRNA target sequence
aggaattctgggataattatc

SEQ ID NO: 34791 - DNA, 21 bp, Artificial sequence
  SiRNA target sequence
ggaattctgggataattatca

SEQ ID NO: 34792 - DNA, 21 bp, Artificial sequence
  SiRNA target sequence
gaattctgggataattatcaa

SEQ ID NO: 34793 - DNA, 21 bp, Artificial sequence
  SiRNA target sequence
aattctgggataattatcaag

SEQ ID NO: 34794 - DNA, 21 bp, Artificial sequence
  SiRNA target sequence
attctgggataattatcaagg

SEQ ID NO: 34795 - DNA, 21 bp, Artificial sequence
  SiRNA target sequence
ttctgggataattatcaagga

SEQ ID NO: 34796 - DNA, 21 bp, Artificial sequence
  SiRNA target sequence
tctgggataattatcaaggac

SEQ ID NO: 34797 - DNA, 21 bp, Artificial sequence
  SiRNA target sequence
ctgggataattatcaaggaca

SEQ ID NO: 34798 - DNA, 21 bp, Artificial sequence
  SiRNA target sequence
tgggataattatcaaggacaa

SEQ ID NO: 34799 - DNA, 21 bp, Artificial sequence
  SiRNA target sequence
gggataattatcaaggacaaa

SEQ ID NO: 34800 - DNA, 21 bp, Artificial sequence
  SiRNA target sequence
ggataattatcaaggacaaaa

SEQ ID NO: 34801 - DNA, 21 bp, Artificial sequence
  SiRNA target sequence
gataattatcaaggacaaaat

SEQ ID NO: 34802 - DNA, 21 bp, Artificial sequence
  SiRNA target sequence
ataattatcaaggacaaaata

SEQ ID NO: 34803 - DNA, 21 bp, Artificial sequence
  SiRNA target sequence
taattatcaaggacaaaatat

SEQ ID NO: 34804 - DNA, 21 bp, Artificial sequence
  SiRNA target sequence
aattatcaaggacaaaatatt

SEQ ID NO: 34805 - DNA, 21 bp, Artificial sequence
  SiRNA target sequence
attatcaaggacaaaatattg

SEQ ID NO: 34806 - DNA, 21 bp, Artificial sequence
  SiRNA target sequence
ttatcaaggacaaaatattgt

SEQ ID NO: 34807 - DNA, 21 bp, Artificial sequence
  SiRNA target sequence
tatcaaggacaaaatattgta

SEQ ID NO: 34808 - DNA, 21 bp, Artificial sequence
  SiRNA target sequence
atcaaggacaaaatattgtat

SEQ ID NO: 34809 - DNA, 21 bp, Artificial sequence
  SiRNA target sequence
tcaaggacaaaatattgtatg

SEQ ID NO: 34810 - DNA, 21 bp, Artificial sequence
  SiRNA target sequence
caaggacaaaatattgtatgt

SEQ ID NO: 34811 - DNA, 21 bp, Artificial sequence
  SiRNA target sequence
aaggacaaaatattgtatgty

SEQ ID NO: 34812 - DNA, 21 bp, Artificial sequence
  SiRNA target sequence
aggacaaaatattgtatgtya

SEQ ID NO: 34813 - DNA, 21 bp, Artificial sequence
  SiRNA target sequence
ggacaaaatattgtatgtyat

SEQ ID NO: 34814 - DNA, 21 bp, Artificial sequence
  SiRNA target sequence
gacaaaatattgtatgtyatg

SEQ ID NO: 34815 - DNA, 21 bp, Artificial sequence
  SiRNA target sequence
acaaaatattgtatgtyatga

SEQ ID NO: 34816 - DNA, 21 bp, Artificial sequence
  SiRNA target sequence
caaaatattgtatgtyatgat

SEQ ID NO: 34817 - DNA, 21 bp, Artificial sequence
  SiRNA target sequence
aaaatattgtatgtyatgatg

SEQ ID NO: 34818 - DNA, 21 bp, Artificial sequence
  SiRNA target sequence
aaatattgtatgtyatgatga

SEQ ID NO: 34819 - DNA, 21 bp, Artificial sequence
  SiRNA target sequence
aatattgtatgtyatgatgat

SEQ ID NO: 34820 - DNA, 21 bp, Artificial sequence
  SiRNA target sequence
atattgtatgtyatgatgatt

SEQ ID NO: 34821 - DNA, 21 bp, Artificial sequence
  SiRNA target sequence
tattgtatgtyatgatgattt

SEQ ID NO: 34822 - DNA, 21 bp, Artificial sequence
  SiRNA target sequence
attgtatgtyatgatgatttt

SEQ ID NO: 34823 - DNA, 21 bp, Artificial sequence
  SiRNA target sequence
ttgtatgtyatgatgattttg

SEQ ID NO: 34824 - DNA, 21 bp, Artificial sequence
  SiRNA target sequence
tgtatgtyatgatgattttgg

SEQ ID NO: 34825 - DNA, 21 bp, Artificial sequence
  SiRNA target sequence
gtatgtyatgatgattttgga

SEQ ID NO: 34826 - DNA, 21 bp, Artificial sequence
  SiRNA target sequence
tatgtyatgatgattttggac

SEQ ID NO: 34827 - DNA, 21 bp, Artificial sequence
  SiRNA target sequence
atgtyatgatgattttggaca

SEQ ID NO: 34828 - DNA, 21 bp, Artificial sequence
  SiRNA target sequence
tgtyatgatgattttggacaa

SEQ ID NO: 34829 - DNA, 21 bp, Artificial sequence
  SiRNA target sequence
gtyatgatgattttggacaaa

SEQ ID NO: 34830 - DNA, 21 bp, Artificial sequence
  SiRNA target sequence
tyatgatgattttggacaaat

SEQ ID NO: 34831 - DNA, 21 bp, Artificial sequence
  SiRNA target sequence
yatgatgattttggacaaatg

SEQ ID NO: 34832 - DNA, 21 bp, Artificial sequence
  SiRNA target sequence
atgatgattttggacaaatga

SEQ ID NO: 34833 - DNA, 21 bp, Artificial sequence
  SiRNA target sequence
tgatgattttggacaaatgag

SEQ ID NO: 34834 - DNA, 21 bp, Artificial sequence
  SiRNA target sequence
gatgattttggacaaatgagg

SEQ ID NO: 34835 - DNA, 21 bp, Artificial sequence
  SiRNA target sequence
atgattttggacaaatgaggg

SEQ ID NO: 34836 - DNA, 21 bp, Artificial sequence
  SiRNA target sequence
tgattttggacaaatgaggga

SEQ ID NO: 34837 - DNA, 21 bp, Artificial sequence
  SiRNA target sequence
gattttggacaaatgagggat

SEQ ID NO: 34838 - DNA, 21 bp, Artificial sequence
  SiRNA target sequence
attttggacaaatgagggatt

SEQ ID NO: 34839 - DNA, 21 bp, Artificial sequence
  SiRNA target sequence
ttttggacaaatgagggattc

SEQ ID NO: 34840 - DNA, 21 bp, Artificial sequence
  SiRNA target sequence
tttggacaaatgagggattca

SEQ ID NO: 34841 - DNA, 21 bp, Artificial sequence
  SiRNA target sequence
ttggacaaatgagggattcat

SEQ ID NO: 34842 - DNA, 21 bp, Artificial sequence
  SiRNA target sequence
tggacaaatgagggattcatc

SEQ ID NO: 34843 - DNA, 21 bp, Artificial sequence
  SiRNA target sequence
ggacaaatgagggattcatca

SEQ ID NO: 34844 - DNA, 21 bp, Artificial sequence
  SiRNA target sequence
gacaaatgagggattcatcat

SEQ ID NO: 34845 - DNA, 21 bp, Artificial sequence
  SiRNA target sequence
acaaatgagggattcatcatc

SEQ ID NO: 34846 - DNA, 21 bp, Artificial sequence
  SiRNA target sequence
caaatgagggattcatcatct

SEQ ID NO: 34847 - DNA, 21 bp, Artificial sequence
  SiRNA target sequence
aaatgagggattcatcatcta

SEQ ID NO: 34848 - DNA, 21 bp, Artificial sequence
  SiRNA target sequence
aatgagggattcatcatctaa

SEQ ID NO: 34849 - DNA, 21 bp, Artificial sequence
  SiRNA target sequence
atgagggattcatcatctaac

SEQ ID NO: 34850 - DNA, 21 bp, Artificial sequence
  SiRNA target sequence
tgagggattcatcatctaacc

SEQ ID NO: 34851 - DNA, 21 bp, Artificial sequence
  SiRNA target sequence
gagggattcatcatctaaccc

SEQ ID NO: 34852 - DNA, 21 bp, Artificial sequence
  SiRNA target sequence
agggattcatcatctaaccct

SEQ ID NO: 34853 - DNA, 21 bp, Artificial sequence
  SiRNA target sequence
gggattcatcatctaacccta

SEQ ID NO: 34854 - DNA, 21 bp, Artificial sequence
  SiRNA target sequence
ggattcatcatctaaccctaa

SEQ ID NO: 34855 - DNA, 21 bp, Artificial sequence
  SiRNA target sequence
gattcatcatctaaccctaac

SEQ ID NO: 34856 - DNA, 21 bp, Artificial sequence
  SiRNA target sequence
attcatcatctaaccctaacc

SEQ ID NO: 34857 - DNA, 21 bp, Artificial sequence
  SiRNA target sequence
ttcatcatctaaccctaaccc

SEQ ID NO: 34858 - DNA, 21 bp, Artificial sequence
  SiRNA target sequence
tcatcatctaaccctaaccct

SEQ ID NO: 34859 - DNA, 21 bp, Artificial sequence
  SiRNA target sequence
catcatctaaccctaaccctg

SEQ ID NO: 34860 - DNA, 21 bp, Artificial sequence
  SiRNA target sequence
atcatctaaccctaaccctga

SEQ ID NO: 34861 - DNA, 21 bp, Artificial sequence
  SiRNA target sequence
tcatctaaccctaaccctgaa

SEQ ID NO: 34862 - DNA, 21 bp, Artificial sequence
  SiRNA target sequence
catctaaccctaaccctgaat

SEQ ID NO: 34863 - DNA, 21 bp, Artificial sequence
  SiRNA target sequence
atctaaccctaaccctgaatt

SEQ ID NO: 34864 - DNA, 21 bp, Artificial sequence
  SiRNA target sequence
tctaaccctaaccctgaattt

SEQ ID NO: 34865 - DNA, 21 bp, Artificial sequence
  SiRNA target sequence
ctaaccctaaccctgaattta

SEQ ID NO: 34866 - DNA, 21 bp, Artificial sequence
  SiRNA target sequence
taaccctaaccctgaatttat

SEQ ID NO: 34867 - DNA, 21 bp, Artificial sequence
  SiRNA target sequence
aaccctaaccctgaatttatg

SEQ ID NO: 34868 - DNA, 21 bp, Artificial sequence
  SiRNA target sequence
accctaaccctgaatttatgg

SEQ ID NO: 34869 - DNA, 21 bp, Artificial sequence
  SiRNA target sequence
ccctaaccctgaatttatgga

SEQ ID NO: 34870 - DNA, 21 bp, Artificial sequence
  SiRNA target sequence
cctaaccctgaatttatggag

SEQ ID NO: 34871 - DNA, 21 bp, Artificial sequence
  SiRNA target sequence
ctaaccctgaatttatggagt

SEQ ID NO: 34872 - DNA, 21 bp, Artificial sequence
  SiRNA target sequence
taaccctgaatttatggagtt

SEQ ID NO: 34873 - DNA, 21 bp, Artificial sequence
  SiRNA target sequence
aaccctgaatttatggagtta

SEQ ID NO: 34874 - DNA, 21 bp, Artificial sequence
  SiRNA target sequence
accctgaatttatggagttaa

SEQ ID NO: 34875 - DNA, 21 bp, Artificial sequence
  SiRNA target sequence
ccctgaatttatggagttaat

SEQ ID NO: 34876 - DNA, 21 bp, Artificial sequence
  SiRNA target sequence
cctgaatttatggagttaata

SEQ ID NO: 34877 - DNA, 21 bp, Artificial sequence
  SiRNA target sequence
ctgaatttatggagttaatac

SEQ ID NO: 34878 - DNA, 21 bp, Artificial sequence
  SiRNA target sequence
tgaatttatggagttaatacg

SEQ ID NO: 34879 - DNA, 21 bp, Artificial sequence
  SiRNA target sequence
gaatttatggagttaatacgt

SEQ ID NO: 34880 - DNA, 21 bp, Artificial sequence
  SiRNA target sequence
aatttatggagttaatacgta

SEQ ID NO: 34881 - DNA, 21 bp, Artificial sequence
  SiRNA target sequence
atttatggagttaatacgtac

SEQ ID NO: 34882 - DNA, 21 bp, Artificial sequence
  SiRNA target sequence
tttatggagttaatacgtaca

SEQ ID NO: 34883 - DNA, 21 bp, Artificial sequence
  SiRNA target sequence
ttatggagttaatacgtacag

SEQ ID NO: 34884 - DNA, 21 bp, Artificial sequence
  SiRNA target sequence
tatggagttaatacgtacagc

SEQ ID NO: 34885 - DNA, 21 bp, Artificial sequence
  SiRNA target sequence
atggagttaatacgtacagct

SEQ ID NO: 34886 - DNA, 21 bp, Artificial sequence
  SiRNA target sequence
tggagttaatacgtacagcta

SEQ ID NO: 34887 - DNA, 21 bp, Artificial sequence
  SiRNA target sequence
ggagttaatacgtacagctaa

SEQ ID NO: 34888 - DNA, 21 bp, Artificial sequence
  SiRNA target sequence
gagttaatacgtacagctaac

SEQ ID NO: 34889 - DNA, 21 bp, Artificial sequence
  SiRNA target sequence
agttaatacgtacagctaaca

SEQ ID NO: 34890 - DNA, 21 bp, Artificial sequence
  SiRNA target sequence
gttaatacgtacagctaacat

SEQ ID NO: 34891 - DNA, 21 bp, Artificial sequence
  SiRNA target sequence
ttaatacgtacagctaacata

SEQ ID NO: 34892 - DNA, 21 bp, Artificial sequence
  SiRNA target sequence
taatacgtacagctaacatag

SEQ ID NO: 34893 - DNA, 21 bp, Artificial sequence
  SiRNA target sequence
aatacgtacagctaacatagc

SEQ ID NO: 34894 - DNA, 21 bp, Artificial sequence
  SiRNA target sequence
atacgtacagctaacatagct

SEQ ID NO: 34895 - DNA, 21 bp, Artificial sequence
  SiRNA target sequence
tacgtacagctaacatagctc

SEQ ID NO: 34896 - DNA, 21 bp, Artificial sequence
  SiRNA target sequence
acgtacagctaacatagctcc

SEQ ID NO: 34897 - DNA, 21 bp, Artificial sequence
  SiRNA target sequence
cgtacagctaacatagctcca

SEQ ID NO: 34898 - DNA, 21 bp, Artificial sequence
  SiRNA target sequence
gtacagctaacatagctccat

SEQ ID NO: 34899 - DNA, 21 bp, Artificial sequence
  SiRNA target sequence
tacagctaacatagctccata

SEQ ID NO: 34900 - DNA, 21 bp, Artificial sequence
  SiRNA target sequence
acagctaacatagctccatac

SEQ ID NO: 34901 - DNA, 21 bp, Artificial sequence
  SiRNA target sequence
cagctaacatagctccatacc

SEQ ID NO: 34902 - DNA, 21 bp, Artificial sequence
  SiRNA target sequence
agctaacatagctccataccc

SEQ ID NO: 34903 - DNA, 21 bp, Artificial sequence
  SiRNA target sequence
gctaacatagctccatacccc

SEQ ID NO: 34904 - DNA, 21 bp, Artificial sequence
  SiRNA target sequence
ctaacatagctccatacccct

SEQ ID NO: 34905 - DNA, 21 bp, Artificial sequence
  SiRNA target sequence
taacatagctccatacccctt

SEQ ID NO: 34906 - DNA, 21 bp, Artificial sequence
  SiRNA target sequence
aacatagctccatacccctta

SEQ ID NO: 34907 - DNA, 21 bp, Artificial sequence
  SiRNA target sequence
acatagctccataccccttac

SEQ ID NO: 34908 - DNA, 21 bp, Artificial sequence
  SiRNA target sequence
catagctccataccccttaca

SEQ ID NO: 34909 - DNA, 21 bp, Artificial sequence
  SiRNA target sequence
atagctccataccccttacac

SEQ ID NO: 34910 - DNA, 21 bp, Artificial sequence
  SiRNA target sequence
tagctccataccccttacaca

SEQ ID NO: 34911 - DNA, 21 bp, Artificial sequence
  SiRNA target sequence
agctccataccccttacacat

SEQ ID NO: 34912 - DNA, 21 bp, Artificial sequence
  SiRNA target sequence
gctccataccccttacacatg

SEQ ID NO: 34913 - DNA, 21 bp, Artificial sequence
  SiRNA target sequence
ctccataccccttacacatgg

SEQ ID NO: 34914 - DNA, 21 bp, Artificial sequence
  SiRNA target sequence
tccataccccttacacatggc

SEQ ID NO: 34915 - DNA, 21 bp, Artificial sequence
  SiRNA target sequence
ccataccccttacacatggct

SEQ ID NO: 34916 - DNA, 21 bp, Artificial sequence
  SiRNA target sequence
cataccccttacacatggctc

SEQ ID NO: 34917 - DNA, 21 bp, Artificial sequence
  SiRNA target sequence
ataccccttacacatggctca

SEQ ID NO: 34918 - DNA, 21 bp, Artificial sequence
  SiRNA target sequence
taccccttacacatggctcac

SEQ ID NO: 34919 - DNA, 21 bp, Artificial sequence
  SiRNA target sequence
accccttacacatggctcacc

SEQ ID NO: 34920 - DNA, 21 bp, Artificial sequence
  SiRNA target sequence
ccccttacacatggctcacct

SEQ ID NO: 34921 - DNA, 21 bp, Artificial sequence
  SiRNA target sequence
cccttacacatggctcacctc

SEQ ID NO: 34922 - DNA, 21 bp, Artificial sequence
  SiRNA target sequence
ccttacacatggctcacctcg

SEQ ID NO: 34923 - DNA, 21 bp, Artificial sequence
  SiRNA target sequence
cttacacatggctcacctcga

SEQ ID NO: 34924 - DNA, 21 bp, Artificial sequence
  SiRNA target sequence
ttacacatggctcacctcgaa

SEQ ID NO: 34925 - DNA, 21 bp, Artificial sequence
  SiRNA target sequence
tacacatggctcacctcgaag

SEQ ID NO: 34926 - DNA, 21 bp, Artificial sequence
  SiRNA target sequence
acacatggctcacctcgaaga

SEQ ID NO: 34927 - DNA, 21 bp, Artificial sequence
  SiRNA target sequence
cacatggctcacctcgaagat

SEQ ID NO: 34928 - DNA, 21 bp, Artificial sequence
  SiRNA target sequence
acatggctcacctcgaagata

SEQ ID NO: 34929 - DNA, 21 bp, Artificial sequence
  SiRNA target sequence
catggctcacctcgaagataa

SEQ ID NO: 34930 - DNA, 21 bp, Artificial sequence
  SiRNA target sequence
atggctcacctcgaagataaa

SEQ ID NO: 34931 - DNA, 21 bp, Artificial sequence
  SiRNA target sequence
tggctcacctcgaagataaaa

SEQ ID NO: 34932 - DNA, 21 bp, Artificial sequence
  SiRNA target sequence
ggctcacctcgaagataaaag

SEQ ID NO: 34933 - DNA, 21 bp, Artificial sequence
  SiRNA target sequence
gctcacctcgaagataaaagg

SEQ ID NO: 34934 - DNA, 21 bp, Artificial sequence
  SiRNA target sequence
ctcacctcgaagataaaagga

SEQ ID NO: 34935 - DNA, 21 bp, Artificial sequence
  SiRNA target sequence
tcacctcgaagataaaaggaa

SEQ ID NO: 34936 - DNA, 21 bp, Artificial sequence
  SiRNA target sequence
cacctcgaagataaaaggaaa

SEQ ID NO: 34937 - DNA, 21 bp, Artificial sequence
  SiRNA target sequence
acctcgaagataaaaggaaaa

SEQ ID NO: 34938 - DNA, 21 bp, Artificial sequence
  SiRNA target sequence
cctcgaagataaaaggaaaac

SEQ ID NO: 34939 - DNA, 21 bp, Artificial sequence
  SiRNA target sequence
ctcgaagataaaaggaaaaca

SEQ ID NO: 34940 - DNA, 21 bp, Artificial sequence
  SiRNA target sequence
tcgaagataaaaggaaaacaa

SEQ ID NO: 34941 - DNA, 21 bp, Artificial sequence
  SiRNA target sequence
cgaagataaaaggaaaacaaa

SEQ ID NO: 34942 - DNA, 21 bp, Artificial sequence
  SiRNA target sequence
gaagataaaaggaaaacaaaa

SEQ ID NO: 34943 - DNA, 21 bp, Artificial sequence
  SiRNA target sequence
aagataaaaggaaaacaaaat

SEQ ID NO: 34944 - DNA, 21 bp, Artificial sequence
  SiRNA target sequence
agataaaaggaaaacaaaatt

SEQ ID NO: 34945 - DNA, 21 bp, Artificial sequence
  SiRNA target sequence
gataaaaggaaaacaaaattc

SEQ ID NO: 34946 - DNA, 21 bp, Artificial sequence
  SiRNA target sequence
ataaaaggaaaacaaaattca

SEQ ID NO: 34947 - DNA, 21 bp, Artificial sequence
  SiRNA target sequence
taaaaggaaaacaaaattcac

SEQ ID NO: 34948 - DNA, 21 bp, Artificial sequence
  SiRNA target sequence
aaaaggaaaacaaaattcaca

SEQ ID NO: 34949 - DNA, 21 bp, Artificial sequence
  SiRNA target sequence
aaaggaaaacaaaattcacat

SEQ ID NO: 34950 - DNA, 21 bp, Artificial sequence
  SiRNA target sequence
aaggaaaacaaaattcacatc

SEQ ID NO: 34951 - DNA, 21 bp, Artificial sequence
  SiRNA target sequence
aggaaaacaaaattcacatca

SEQ ID NO: 34952 - DNA, 21 bp, Artificial sequence
  SiRNA target sequence
ggaaaacaaaattcacatcaa

SEQ ID NO: 34953 - DNA, 21 bp, Artificial sequence
  SiRNA target sequence
gaaaacaaaattcacatcaaa

SEQ ID NO: 34954 - DNA, 21 bp, Artificial sequence
  SiRNA target sequence
aaaacaaaattcacatcaaaa

SEQ ID NO: 34955 - DNA, 21 bp, Artificial sequence
  SiRNA target sequence
aaacaaaattcacatcaaaag

SEQ ID NO: 34956 - DNA, 21 bp, Artificial sequence
  SiRNA target sequence
aacaaaattcacatcaaaagt

SEQ ID NO: 34957 - DNA, 21 bp, Artificial sequence
  SiRNA target sequence
acaaaattcacatcaaaagta

SEQ ID NO: 34958 - DNA, 21 bp, Artificial sequence
  SiRNA target sequence
caaaattcacatcaaaagtaa

SEQ ID NO: 34959 - DNA, 21 bp, Artificial sequence
  SiRNA target sequence
aaaattcacatcaaaagtaat

SEQ ID NO: 34960 - DNA, 21 bp, Artificial sequence
  SiRNA target sequence
aaattcacatcaaaagtaatc

SEQ ID NO: 34961 - DNA, 21 bp, Artificial sequence
  SiRNA target sequence
aattcacatcaaaagtaatca

SEQ ID NO: 34962 - DNA, 21 bp, Artificial sequence
  SiRNA target sequence
attcacatcaaaagtaatcat

SEQ ID NO: 34963 - DNA, 21 bp, Artificial sequence
  SiRNA target sequence
ttcacatcaaaagtaatcatt

SEQ ID NO: 34964 - DNA, 21 bp, Artificial sequence
  SiRNA target sequence
tcacatcaaaagtaatcatta

SEQ ID NO: 34965 - DNA, 21 bp, Artificial sequence
  SiRNA target sequence
cacatcaaaagtaatcattat

SEQ ID NO: 34966 - DNA, 21 bp, Artificial sequence
  SiRNA target sequence
acatcaaaagtaatcattatg

SEQ ID NO: 34967 - DNA, 21 bp, Artificial sequence
  SiRNA target sequence
catcaaaagtaatcattatga

SEQ ID NO: 34968 - DNA, 21 bp, Artificial sequence
  SiRNA target sequence
atcaaaagtaatcattatgac

SEQ ID NO: 34969 - DNA, 21 bp, Artificial sequence
  SiRNA target sequence
tcaaaagtaatcattatgaca

SEQ ID NO: 34970 - DNA, 21 bp, Artificial sequence
  SiRNA target sequence
caaaagtaatcattatgacat

SEQ ID NO: 34971 - DNA, 21 bp, Artificial sequence
  SiRNA target sequence
aaaagtaatcattatgacatc

SEQ ID NO: 34972 - DNA, 21 bp, Artificial sequence
  SiRNA target sequence
aaagtaatcattatgacatct

SEQ ID NO: 34973 - DNA, 21 bp, Artificial sequence
  SiRNA target sequence
aagtaatcattatgacatcta

SEQ ID NO: 34974 - DNA, 21 bp, Artificial sequence
  SiRNA target sequence
agtaatcattatgacatctaa

SEQ ID NO: 34975 - DNA, 21 bp, Artificial sequence
  SiRNA target sequence
gtaatcattatgacatctaat

SEQ ID NO: 34976 - DNA, 21 bp, Artificial sequence
  SiRNA target sequence
taatcattatgacatctaatg

SEQ ID NO: 34977 - DNA, 21 bp, Artificial sequence
  SiRNA target sequence
aatcattatgacatctaatgt

SEQ ID NO: 34978 - DNA, 21 bp, Artificial sequence
  SiRNA target sequence
atcattatgacatctaatgtt

SEQ ID NO: 34979 - DNA, 21 bp, Artificial sequence
  SiRNA target sequence
tcattatgacatctaatgttt

SEQ ID NO: 34980 - DNA, 21 bp, Artificial sequence
  SiRNA target sequence
cattatgacatctaatgtttt

SEQ ID NO: 34981 - DNA, 21 bp, Artificial sequence
  SiRNA target sequence
attatgacatctaatgttttt

SEQ ID NO: 34982 - DNA, 21 bp, Artificial sequence
  SiRNA target sequence
ttatgacatctaatgtttttg

SEQ ID NO: 34983 - DNA, 21 bp, Artificial sequence
  SiRNA target sequence
tatgacatctaatgtttttga

SEQ ID NO: 34984 - DNA, 21 bp, Artificial sequence
  SiRNA target sequence
atgacatctaatgtttttgaa

SEQ ID NO: 34985 - DNA, 21 bp, Artificial sequence
  SiRNA target sequence
tgacatctaatgtttttgaac

SEQ ID NO: 34986 - DNA, 21 bp, Artificial sequence
  SiRNA target sequence
gacatctaatgtttttgaaca

SEQ ID NO: 34987 - DNA, 21 bp, Artificial sequence
  SiRNA target sequence
acatctaatgtttttgaacag

SEQ ID NO: 34988 - DNA, 21 bp, Artificial sequence
  SiRNA target sequence
catctaatgtttttgaacagg

SEQ ID NO: 34989 - DNA, 21 bp, Artificial sequence
  SiRNA target sequence
atctaatgtttttgaacagga

SEQ ID NO: 34990 - DNA, 21 bp, Artificial sequence
  SiRNA target sequence
tctaatgtttttgaacaggat

SEQ ID NO: 34991 - DNA, 21 bp, Artificial sequence
  SiRNA target sequence
ctaatgtttttgaacaggatg

SEQ ID NO: 34992 - DNA, 21 bp, Artificial sequence
  SiRNA target sequence
taatgtttttgaacaggatgt

SEQ ID NO: 34993 - DNA, 21 bp, Artificial sequence
  SiRNA target sequence
aatgtttttgaacaggatgtt

SEQ ID NO: 34994 - DNA, 21 bp, Artificial sequence
  SiRNA target sequence
atgtttttgaacaggatgtta

SEQ ID NO: 34995 - DNA, 21 bp, Artificial sequence
  SiRNA target sequence
tgtttttgaacaggatgttaa

SEQ ID NO: 34996 - DNA, 21 bp, Artificial sequence
  SiRNA target sequence
gtttttgaacaggatgttaat

SEQ ID NO: 34997 - DNA, 21 bp, Artificial sequence
  SiRNA target sequence
tttttgaacaggatgttaatt

SEQ ID NO: 34998 - DNA, 21 bp, Artificial sequence
  SiRNA target sequence
ttttgaacaggatgttaattc

SEQ ID NO: 34999 - DNA, 21 bp, Artificial sequence
  SiRNA target sequence
tttgaacaggatgttaattca

SEQ ID NO: 35000 - DNA, 21 bp, Artificial sequence
  SiRNA target sequence
ttgaacaggatgttaattcac

SEQ ID NO: 35001 - DNA, 21 bp, Artificial sequence
  SiRNA target sequence
tgaacaggatgttaattcact

SEQ ID NO: 35002 - DNA, 21 bp, Artificial sequence
  SiRNA target sequence
gaacaggatgttaattcacta

SEQ ID NO: 35003 - DNA, 21 bp, Artificial sequence
  SiRNA target sequence
aacaggatgttaattcactaa

SEQ ID NO: 35004 - DNA, 21 bp, Artificial sequence
  SiRNA target sequence
acaggatgttaattcactaac

SEQ ID NO: 35005 - DNA, 21 bp, Artificial sequence
  SiRNA target sequence
caggatgttaattcactaaca

SEQ ID NO: 35006 - DNA, 21 bp, Artificial sequence
  SiRNA target sequence
aggatgttaattcactaacat

SEQ ID NO: 35007 - DNA, 21 bp, Artificial sequence
  SiRNA target sequence
ggatgttaattcactaacatt

SEQ ID NO: 35008 - DNA, 21 bp, Artificial sequence
  SiRNA target sequence
gatgttaattcactaacattt

SEQ ID NO: 35009 - DNA, 21 bp, Artificial sequence
  SiRNA target sequence
atgttaattcactaacatttc

SEQ ID NO: 35010 - DNA, 21 bp, Artificial sequence
  SiRNA target sequence
tgttaattcactaacatttcc

SEQ ID NO: 35011 - DNA, 21 bp, Artificial sequence
  SiRNA target sequence
gttaattcactaacatttcca

SEQ ID NO: 35012 - DNA, 21 bp, Artificial sequence
  SiRNA target sequence
ttaattcactaacatttccag

SEQ ID NO: 35013 - DNA, 21 bp, Artificial sequence
  SiRNA target sequence
taattcactaacatttccaga

SEQ ID NO: 35014 - DNA, 21 bp, Artificial sequence
  SiRNA target sequence
aattcactaacatttccagat

SEQ ID NO: 35015 - DNA, 21 bp, Artificial sequence
  SiRNA target sequence
attcactaacatttccagatg

SEQ ID NO: 35016 - DNA, 21 bp, Artificial sequence
  SiRNA target sequence
ttcactaacatttccagatgc

SEQ ID NO: 35017 - DNA, 21 bp, Artificial sequence
  SiRNA target sequence
tcactaacatttccagatgca

SEQ ID NO: 35018 - DNA, 21 bp, Artificial sequence
  SiRNA target sequence
cactaacatttccagatgcat

SEQ ID NO: 35019 - DNA, 21 bp, Artificial sequence
  SiRNA target sequence
actaacatttccagatgcatt

SEQ ID NO: 35020 - DNA, 21 bp, Artificial sequence
  SiRNA target sequence
ctaacatttccagatgcattt

SEQ ID NO: 35021 - DNA, 21 bp, Artificial sequence
  SiRNA target sequence
taacatttccagatgcattta

SEQ ID NO: 35022 - DNA, 21 bp, Artificial sequence
  SiRNA target sequence
aacatttccagatgcatttag

SEQ ID NO: 35023 - DNA, 21 bp, Artificial sequence
  SiRNA target sequence
acatttccagatgcatttagg

SEQ ID NO: 35024 - DNA, 21 bp, Artificial sequence
  SiRNA target sequence
catttccagatgcatttagga

SEQ ID NO: 35025 - DNA, 21 bp, Artificial sequence
  SiRNA target sequence
atttccagatgcatttaggag

SEQ ID NO: 35026 - DNA, 21 bp, Artificial sequence
  SiRNA target sequence
tttccagatgcatttaggaga

SEQ ID NO: 35027 - DNA, 21 bp, Artificial sequence
  SiRNA target sequence
ttccagatgcatttaggagaa

SEQ ID NO: 35028 - DNA, 21 bp, Artificial sequence
  SiRNA target sequence
tccagatgcatttaggagaag

SEQ ID NO: 35029 - DNA, 21 bp, Artificial sequence
  SiRNA target sequence
ccagatgcatttaggagaaga

SEQ ID NO: 35030 - DNA, 21 bp, Artificial sequence
  SiRNA target sequence
cagatgcatttaggagaagag

SEQ ID NO: 35031 - DNA, 21 bp, Artificial sequence
  SiRNA target sequence
agatgcatttaggagaagagt

SEQ ID NO: 35032 - DNA, 21 bp, Artificial sequence
  SiRNA target sequence
gatgcatttaggagaagagta

SEQ ID NO: 35033 - DNA, 21 bp, Artificial sequence
  SiRNA target sequence
atgcatttaggagaagagtag

SEQ ID NO: 35034 - DNA, 21 bp, Artificial sequence
  SiRNA target sequence
tgcatttaggagaagagtaga

SEQ ID NO: 35035 - DNA, 21 bp, Artificial sequence
  SiRNA target sequence
gcatttaggagaagagtagat

SEQ ID NO: 35036 - DNA, 21 bp, Artificial sequence
  SiRNA target sequence
catttaggagaagagtagatt

SEQ ID NO: 35037 - DNA, 21 bp, Artificial sequence
  SiRNA target sequence
atttaggagaagagtagattt

SEQ ID NO: 35038 - DNA, 21 bp, Artificial sequence
  SiRNA target sequence
tttaggagaagagtagatttg

SEQ ID NO: 35039 - DNA, 21 bp, Artificial sequence
  SiRNA target sequence
ttaggagaagagtagatttgt

SEQ ID NO: 35040 - DNA, 21 bp, Artificial sequence
  SiRNA target sequence
taggagaagagtagatttgtg

SEQ ID NO: 35041 - DNA, 21 bp, Artificial sequence
  SiRNA target sequence
aggagaagagtagatttgtgc

SEQ ID NO: 35042 - DNA, 21 bp, Artificial sequence
  SiRNA target sequence
ggagaagagtagatttgtgcg

SEQ ID NO: 35043 - DNA, 21 bp, Artificial sequence
  SiRNA target sequence
gagaagagtagatttgtgcgc

SEQ ID NO: 35044 - DNA, 21 bp, Artificial sequence
  SiRNA target sequence
agaagagtagatttgtgcgct

SEQ ID NO: 35045 - DNA, 21 bp, Artificial sequence
  SiRNA target sequence
gaagagtagatttgtgcgctg

SEQ ID NO: 35046 - DNA, 21 bp, Artificial sequence
  SiRNA target sequence
aagagtagatttgtgcgctga

SEQ ID NO: 35047 - DNA, 21 bp, Artificial sequence
  SiRNA target sequence
agagtagatttgtgcgctgag

SEQ ID NO: 35048 - DNA, 21 bp, Artificial sequence
  SiRNA target sequence
gagtagatttgtgcgctgagg

SEQ ID NO: 35049 - DNA, 21 bp, Artificial sequence
  SiRNA target sequence
agtagatttgtgcgctgaggt

SEQ ID NO: 35050 - DNA, 21 bp, Artificial sequence
  SiRNA target sequence
gtagatttgtgcgctgaggta

SEQ ID NO: 35051 - DNA, 21 bp, Artificial sequence
  SiRNA target sequence
tagatttgtgcgctgaggtaa

SEQ ID NO: 35052 - DNA, 21 bp, Artificial sequence
  SiRNA target sequence
agatttgtgcgctgaggtaaa

SEQ ID NO: 35053 - DNA, 21 bp, Artificial sequence
  SiRNA target sequence
gatttgtgcgctgaggtaaag

SEQ ID NO: 35054 - DNA, 21 bp, Artificial sequence
  SiRNA target sequence
atttgtgcgctgaggtaaaga

SEQ ID NO: 35055 - DNA, 21 bp, Artificial sequence
  SiRNA target sequence
tttgtgcgctgaggtaaagaa

SEQ ID NO: 35056 - DNA, 21 bp, Artificial sequence
  SiRNA target sequence
ttgtgcgctgaggtaaagaat

SEQ ID NO: 35057 - DNA, 21 bp, Artificial sequence
  SiRNA target sequence
tgtgcgctgaggtaaagaata

SEQ ID NO: 35058 - DNA, 21 bp, Artificial sequence
  SiRNA target sequence
gtgcgctgaggtaaagaataa

SEQ ID NO: 35059 - DNA, 21 bp, Artificial sequence
  SiRNA target sequence
tgcgctgaggtaaagaataaa

SEQ ID NO: 35060 - DNA, 21 bp, Artificial sequence
  SiRNA target sequence
gcgctgaggtaaagaataaag

SEQ ID NO: 35061 - DNA, 21 bp, Artificial sequence
  SiRNA target sequence
cgctgaggtaaagaataaaga

SEQ ID NO: 35062 - DNA, 21 bp, Artificial sequence
  SiRNA target sequence
gctgaggtaaagaataaagat

SEQ ID NO: 35063 - DNA, 21 bp, Artificial sequence
  SiRNA target sequence
ctgaggtaaagaataaagatg

SEQ ID NO: 35064 - DNA, 21 bp, Artificial sequence
  SiRNA target sequence
tgaggtaaagaataaagatga

SEQ ID NO: 35065 - DNA, 21 bp, Artificial sequence
  SiRNA target sequence
gaggtaaagaataaagatgaa

SEQ ID NO: 35066 - DNA, 21 bp, Artificial sequence
  SiRNA target sequence
aggtaaagaataaagatgaat

SEQ ID NO: 35067 - DNA, 21 bp, Artificial sequence
  SiRNA target sequence
ggtaaagaataaagatgaatt

SEQ ID NO: 35068 - DNA, 21 bp, Artificial sequence
  SiRNA target sequence
gtaaagaataaagatgaattt

SEQ ID NO: 35069 - DNA, 21 bp, Artificial sequence
  SiRNA target sequence
taaagaataaagatgaattta

SEQ ID NO: 35070 - DNA, 21 bp, Artificial sequence
  SiRNA target sequence
aaagaataaagatgaatttac

SEQ ID NO: 35071 - DNA, 21 bp, Artificial sequence
  SiRNA target sequence
aagaataaagatgaatttaca

SEQ ID NO: 35072 - DNA, 21 bp, Artificial sequence
  SiRNA target sequence
agaataaagatgaatttacaa

SEQ ID NO: 35073 - DNA, 21 bp, Artificial sequence
  SiRNA target sequence
gaataaagatgaatttacaaa

SEQ ID NO: 35074 - DNA, 21 bp, Artificial sequence
  SiRNA target sequence
aataaagatgaatttacaaaa

SEQ ID NO: 35075 - DNA, 21 bp, Artificial sequence
  SiRNA target sequence
ataaagatgaatttacaaaaa

SEQ ID NO: 35076 - DNA, 21 bp, Artificial sequence
  SiRNA target sequence
taaagatgaatttacaaaaat

SEQ ID NO: 35077 - DNA, 21 bp, Artificial sequence
  SiRNA target sequence
aaagatgaatttacaaaaatg

SEQ ID NO: 35078 - DNA, 21 bp, Artificial sequence
  SiRNA target sequence
aagatgaatttacaaaaatgt

SEQ ID NO: 35079 - DNA, 21 bp, Artificial sequence
  SiRNA target sequence
agatgaatttacaaaaatgtg

SEQ ID NO: 35080 - DNA, 21 bp, Artificial sequence
  SiRNA target sequence
gatgaatttacaaaaatgtgc

SEQ ID NO: 35081 - DNA, 21 bp, Artificial sequence
  SiRNA target sequence
atgaatttacaaaaatgtgct

SEQ ID NO: 35082 - DNA, 21 bp, Artificial sequence
  SiRNA target sequence
tgaatttacaaaaatgtgctg

SEQ ID NO: 35083 - DNA, 21 bp, Artificial sequence
  SiRNA target sequence
gaatttacaaaaatgtgctgg

SEQ ID NO: 35084 - DNA, 21 bp, Artificial sequence
  SiRNA target sequence
aatttacaaaaatgtgctggt

SEQ ID NO: 35085 - DNA, 21 bp, Artificial sequence
  SiRNA target sequence
atttacaaaaatgtgctggtc

SEQ ID NO: 35086 - DNA, 21 bp, Artificial sequence
  SiRNA target sequence
tttacaaaaatgtgctggtct

SEQ ID NO: 35087 - DNA, 21 bp, Artificial sequence
  SiRNA target sequence
ttacaaaaatgtgctggtcta

SEQ ID NO: 35088 - DNA, 21 bp, Artificial sequence
  SiRNA target sequence
tacaaaaatgtgctggtctaa

SEQ ID NO: 35089 - DNA, 21 bp, Artificial sequence
  SiRNA target sequence
acaaaaatgtgctggtctaaa

SEQ ID NO: 35090 - DNA, 21 bp, Artificial sequence
  SiRNA target sequence
caaaaatgtgctggtctaaat

SEQ ID NO: 35091 - DNA, 21 bp, Artificial sequence
  SiRNA target sequence
aaaaatgtgctggtctaaatc

SEQ ID NO: 35092 - DNA, 21 bp, Artificial sequence
  SiRNA target sequence
aaaatgtgctggtctaaatca

SEQ ID NO: 35093 - DNA, 21 bp, Artificial sequence
  SiRNA target sequence
aaatgtgctggtctaaatcag

SEQ ID NO: 35094 - DNA, 21 bp, Artificial sequence
  SiRNA target sequence
aatgtgctggtctaaatcagc

SEQ ID NO: 35095 - DNA, 21 bp, Artificial sequence
  SiRNA target sequence
atgtgctggtctaaatcagca

SEQ ID NO: 35096 - DNA, 21 bp, Artificial sequence
  SiRNA target sequence
tgtgctggtctaaatcagcag

SEQ ID NO: 35097 - DNA, 21 bp, Artificial sequence
  SiRNA target sequence
gtgctggtctaaatcagcagg

SEQ ID NO: 35098 - DNA, 21 bp, Artificial sequence
  SiRNA target sequence
tgctggtctaaatcagcagga

SEQ ID NO: 35099 - DNA, 21 bp, Artificial sequence
  SiRNA target sequence
gctggtctaaatcagcaggaa

SEQ ID NO: 35100 - DNA, 21 bp, Artificial sequence
  SiRNA target sequence
ctggtctaaatcagcaggaaa

SEQ ID NO: 35101 - DNA, 21 bp, Artificial sequence
  SiRNA target sequence
tggtctaaatcagcaggaaaa

SEQ ID NO: 35102 - DNA, 21 bp, Artificial sequence
  SiRNA target sequence
ggtctaaatcagcaggaaaaa

SEQ ID NO: 35103 - DNA, 21 bp, Artificial sequence
  SiRNA target sequence
gtctaaatcagcaggaaaaat

SEQ ID NO: 35104 - DNA, 21 bp, Artificial sequence
  SiRNA target sequence
tctaaatcagcaggaaaaatg

SEQ ID NO: 35105 - DNA, 21 bp, Artificial sequence
  SiRNA target sequence
ctaaatcagcaggaaaaatgg

SEQ ID NO: 35106 - DNA, 21 bp, Artificial sequence
  SiRNA target sequence
taaatcagcaggaaaaatggt

SEQ ID NO: 35107 - DNA, 21 bp, Artificial sequence
  SiRNA target sequence
aaatcagcaggaaaaatggtt

SEQ ID NO: 35108 - DNA, 21 bp, Artificial sequence
  SiRNA target sequence
aatcagcaggaaaaatggttc

SEQ ID NO: 35109 - DNA, 21 bp, Artificial sequence
  SiRNA target sequence
atcagcaggaaaaatggttca

SEQ ID NO: 35110 - DNA, 21 bp, Artificial sequence
  SiRNA target sequence
tcagcaggaaaaatggttcag

SEQ ID NO: 35111 - DNA, 21 bp, Artificial sequence
  SiRNA target sequence
cagcaggaaaaatggttcaga

SEQ ID NO: 35112 - DNA, 21 bp, Artificial sequence
  SiRNA target sequence
agcaggaaaaatggttcagag

SEQ ID NO: 35113 - DNA, 21 bp, Artificial sequence
  SiRNA target sequence
gcaggaaaaatggttcagaga

SEQ ID NO: 35114 - DNA, 21 bp, Artificial sequence
  SiRNA target sequence
caggaaaaatggttcagagat

SEQ ID NO: 35115 - DNA, 21 bp, Artificial sequence
  SiRNA target sequence
aggaaaaatggttcagagatt

SEQ ID NO: 35116 - DNA, 21 bp, Artificial sequence
  SiRNA target sequence
ggaaaaatggttcagagatta

SEQ ID NO: 35117 - DNA, 21 bp, Artificial sequence
  SiRNA target sequence
gaaaaatggttcagagattag

SEQ ID NO: 35118 - DNA, 21 bp, Artificial sequence
  SiRNA target sequence
aaaaatggttcagagattaga

SEQ ID NO: 35119 - DNA, 21 bp, Artificial sequence
  SiRNA target sequence
aaaatggttcagagattagat

SEQ ID NO: 35120 - DNA, 21 bp, Artificial sequence
  SiRNA target sequence
aaatggttcagagattagata

SEQ ID NO: 35121 - DNA, 21 bp, Artificial sequence
  SiRNA target sequence
aatggttcagagattagataa

SEQ ID NO: 35122 - DNA, 21 bp, Artificial sequence
  SiRNA target sequence
atggttcagagattagataag

SEQ ID NO: 35123 - DNA, 21 bp, Artificial sequence
  SiRNA target sequence
tggttcagagattagataagg

SEQ ID NO: 35124 - DNA, 21 bp, Artificial sequence
  SiRNA target sequence
ggttcagagattagataaggg

SEQ ID NO: 35125 - DNA, 21 bp, Artificial sequence
  SiRNA target sequence
gttcagagattagataaggga

SEQ ID NO: 35126 - DNA, 21 bp, Artificial sequence
  SiRNA target sequence
ttcagagattagataagggaa

SEQ ID NO: 35127 - DNA, 21 bp, Artificial sequence
  SiRNA target sequence
tcagagattagataagggaaa

SEQ ID NO: 35128 - DNA, 21 bp, Artificial sequence
  SiRNA target sequence
cagagattagataagggaaag

SEQ ID NO: 35129 - DNA, 21 bp, Artificial sequence
  SiRNA target sequence
agagattagataagggaaagg

SEQ ID NO: 35130 - DNA, 21 bp, Artificial sequence
  SiRNA target sequence
gagattagataagggaaaggt

SEQ ID NO: 35131 - DNA, 21 bp, Artificial sequence
  SiRNA target sequence
agattagataagggaaaggtt

SEQ ID NO: 35132 - DNA, 21 bp, Artificial sequence
  SiRNA target sequence
gattagataagggaaaggtta

SEQ ID NO: 35133 - DNA, 21 bp, Artificial sequence
  SiRNA target sequence
attagataagggaaaggttaa

SEQ ID NO: 35134 - DNA, 21 bp, Artificial sequence
  SiRNA target sequence
ttagataagggaaaggttaag

SEQ ID NO: 35135 - DNA, 21 bp, Artificial sequence
  SiRNA target sequence
tagataagggaaaggttaaga

SEQ ID NO: 35136 - DNA, 21 bp, Artificial sequence
  SiRNA target sequence
agataagggaaaggttaagaa

SEQ ID NO: 35137 - DNA, 21 bp, Artificial sequence
  SiRNA target sequence
gataagggaaaggttaagaaa

SEQ ID NO: 35138 - DNA, 21 bp, Artificial sequence
  SiRNA target sequence
ataagggaaaggttaagaaaa

SEQ ID NO: 35139 - DNA, 21 bp, Artificial sequence
  SiRNA target sequence
taagggaaaggttaagaaaat

SEQ ID NO: 35140 - DNA, 21 bp, Artificial sequence
  SiRNA target sequence
aagggaaaggttaagaaaata

SEQ ID NO: 35141 - DNA, 21 bp, Artificial sequence
  SiRNA target sequence
agggaaaggttaagaaaataa

SEQ ID NO: 35142 - DNA, 21 bp, Artificial sequence
  SiRNA target sequence
gggaaaggttaagaaaataac

SEQ ID NO: 35143 - DNA, 21 bp, Artificial sequence
  SiRNA target sequence
ggaaaggttaagaaaataaca

SEQ ID NO: 35144 - DNA, 21 bp, Artificial sequence
  SiRNA target sequence
gaaaggttaagaaaataacag

SEQ ID NO: 35145 - DNA, 21 bp, Artificial sequence
  SiRNA target sequence
aaaggttaagaaaataacagg

SEQ ID NO: 35146 - DNA, 21 bp, Artificial sequence
  SiRNA target sequence
aaggttaagaaaataacagga

SEQ ID NO: 35147 - DNA, 21 bp, Artificial sequence
  SiRNA target sequence
aggttaagaaaataacaggag

SEQ ID NO: 35148 - DNA, 21 bp, Artificial sequence
  SiRNA target sequence
ggttaagaaaataacaggaga

SEQ ID NO: 35149 - DNA, 21 bp, Artificial sequence
  SiRNA target sequence
gttaagaaaataacaggagat

SEQ ID NO: 35150 - DNA, 21 bp, Artificial sequence
  SiRNA target sequence
ttaagaaaataacaggagata

SEQ ID NO: 35151 - DNA, 21 bp, Artificial sequence
  SiRNA target sequence
taagaaaataacaggagatat

SEQ ID NO: 35152 - DNA, 21 bp, Artificial sequence
  SiRNA target sequence
aagaaaataacaggagatatt

SEQ ID NO: 35153 - DNA, 21 bp, Artificial sequence
  SiRNA target sequence
agaaaataacaggagatattc

SEQ ID NO: 35154 - DNA, 21 bp, Artificial sequence
  SiRNA target sequence
gaaaataacaggagatattca

SEQ ID NO: 35155 - DNA, 21 bp, Artificial sequence
  SiRNA target sequence
aaaataacaggagatattcat

SEQ ID NO: 35156 - DNA, 21 bp, Artificial sequence
  SiRNA target sequence
aaataacaggagatattcatt

SEQ ID NO: 35157 - DNA, 21 bp, Artificial sequence
  SiRNA target sequence
aataacaggagatattcattc

SEQ ID NO: 35158 - DNA, 21 bp, Artificial sequence
  SiRNA target sequence
ataacaggagatattcattca

SEQ ID NO: 35159 - DNA, 21 bp, Artificial sequence
  SiRNA target sequence
taacaggagatattcattcaa

SEQ ID NO: 35160 - DNA, 21 bp, Artificial sequence
  SiRNA target sequence
aacaggagatattcattcaac

SEQ ID NO: 35161 - DNA, 21 bp, Artificial sequence
  SiRNA target sequence
acaggagatattcattcaaca

SEQ ID NO: 35162 - DNA, 21 bp, Artificial sequence
  SiRNA target sequence
caggagatattcattcaacag

SEQ ID NO: 35163 - DNA, 21 bp, Artificial sequence
  SiRNA target sequence
aggagatattcattcaacagt

SEQ ID NO: 35164 - DNA, 21 bp, Artificial sequence
  SiRNA target sequence
ggagatattcattcaacagta

SEQ ID NO: 35165 - DNA, 21 bp, Artificial sequence
  SiRNA target sequence
gagatattcattcaacagtac

SEQ ID NO: 35166 - DNA, 21 bp, Artificial sequence
  SiRNA target sequence
agatattcattcaacagtacc

SEQ ID NO: 35167 - DNA, 21 bp, Artificial sequence
  SiRNA target sequence
gatattcattcaacagtacca

SEQ ID NO: 35168 - DNA, 21 bp, Artificial sequence
  SiRNA target sequence
atattcattcaacagtaccat

SEQ ID NO: 35169 - DNA, 21 bp, Artificial sequence
  SiRNA target sequence
tattcattcaacagtaccata

SEQ ID NO: 35170 - DNA, 21 bp, Artificial sequence
  SiRNA target sequence
attcattcaacagtaccatac

SEQ ID NO: 35171 - DNA, 21 bp, Artificial sequence
  SiRNA target sequence
ttcattcaacagtaccataca

SEQ ID NO: 35172 - DNA, 21 bp, Artificial sequence
  SiRNA target sequence
tcattcaacagtaccatacat

SEQ ID NO: 35173 - DNA, 21 bp, Artificial sequence
  SiRNA target sequence
cattcaacagtaccatacatt

SEQ ID NO: 35174 - DNA, 21 bp, Artificial sequence
  SiRNA target sequence
attcaacagtaccatacattg

SEQ ID NO: 35175 - DNA, 21 bp, Artificial sequence
  SiRNA target sequence
ttcaacagtaccatacattgt

SEQ ID NO: 35176 - DNA, 21 bp, Artificial sequence
  SiRNA target sequence
tcaacagtaccatacattgtt

SEQ ID NO: 35177 - DNA, 21 bp, Artificial sequence
  SiRNA target sequence
caacagtaccatacattgttg

SEQ ID NO: 35178 - DNA, 21 bp, Artificial sequence
  SiRNA target sequence
aacagtaccatacattgttga

SEQ ID NO: 35179 - DNA, 21 bp, Artificial sequence
  SiRNA target sequence
acagtaccatacattgttgat

SEQ ID NO: 35180 - DNA, 21 bp, Artificial sequence
  SiRNA target sequence
cagtaccatacattgttgatc

SEQ ID NO: 35181 - DNA, 21 bp, Artificial sequence
  SiRNA target sequence
agtaccatacattgttgatct

SEQ ID NO: 35182 - DNA, 21 bp, Artificial sequence
  SiRNA target sequence
gtaccatacattgttgatctg

SEQ ID NO: 35183 - DNA, 21 bp, Artificial sequence
  SiRNA target sequence
taccatacattgttgatctga

SEQ ID NO: 35184 - DNA, 21 bp, Artificial sequence
  SiRNA target sequence
accatacattgttgatctgat

SEQ ID NO: 35185 - DNA, 21 bp, Artificial sequence
  SiRNA target sequence
ccatacattgttgatctgatt

SEQ ID NO: 35186 - DNA, 21 bp, Artificial sequence
  SiRNA target sequence
catacattgttgatctgattg

SEQ ID NO: 35187 - DNA, 21 bp, Artificial sequence
  SiRNA target sequence
atacattgttgatctgattga

SEQ ID NO: 35188 - DNA, 21 bp, Artificial sequence
  SiRNA target sequence
tacattgttgatctgattgat

SEQ ID NO: 35189 - DNA, 21 bp, Artificial sequence
  SiRNA target sequence
acattgttgatctgattgatc

SEQ ID NO: 35190 - DNA, 21 bp, Artificial sequence
  SiRNA target sequence
cattgttgatctgattgatcc

SEQ ID NO: 35191 - DNA, 21 bp, Artificial sequence
  SiRNA target sequence
attgttgatctgattgatcca

SEQ ID NO: 35192 - DNA, 21 bp, Artificial sequence
  SiRNA target sequence
ttgttgatctgattgatccag

SEQ ID NO: 35193 - DNA, 21 bp, Artificial sequence
  SiRNA target sequence
tgttgatctgattgatccaga

SEQ ID NO: 35194 - DNA, 21 bp, Artificial sequence
  SiRNA target sequence
gttgatctgattgatccagaa

SEQ ID NO: 35195 - DNA, 21 bp, Artificial sequence
  SiRNA target sequence
ttgatctgattgatccagaaa

SEQ ID NO: 35196 - DNA, 21 bp, Artificial sequence
  SiRNA target sequence
tgatctgattgatccagaaag

SEQ ID NO: 35197 - DNA, 21 bp, Artificial sequence
  SiRNA target sequence
gatctgattgatccagaaagc

SEQ ID NO: 35198 - DNA, 21 bp, Artificial sequence
  SiRNA target sequence
atctgattgatccagaaagcg

SEQ ID NO: 35199 - DNA, 21 bp, Artificial sequence
  SiRNA target sequence
tctgattgatccagaaagcgg

SEQ ID NO: 35200 - DNA, 21 bp, Artificial sequence
  SiRNA target sequence
ctgattgatccagaaagcggg

SEQ ID NO: 35201 - DNA, 21 bp, Artificial sequence
  SiRNA target sequence
tgattgatccagaaagcgggg

SEQ ID NO: 35202 - DNA, 21 bp, Artificial sequence
  SiRNA target sequence
gattgatccagaaagcgggga

SEQ ID NO: 35203 - DNA, 21 bp, Artificial sequence
  SiRNA target sequence
attgatccagaaagcggggaa

SEQ ID NO: 35204 - DNA, 21 bp, Artificial sequence
  SiRNA target sequence
ttgatccagaaagcggggaag

SEQ ID NO: 35205 - DNA, 21 bp, Artificial sequence
  SiRNA target sequence
tgatccagaaagcggggaagt

SEQ ID NO: 35206 - DNA, 21 bp, Artificial sequence
  SiRNA target sequence
gatccagaaagcggggaagtg

SEQ ID NO: 35207 - DNA, 21 bp, Artificial sequence
  SiRNA target sequence
atccagaaagcggggaagtgt

SEQ ID NO: 35208 - DNA, 21 bp, Artificial sequence
  SiRNA target sequence
tccagaaagcggggaagtgta

SEQ ID NO: 35209 - DNA, 21 bp, Artificial sequence
  SiRNA target sequence
ccagaaagcggggaagtgtat

SEQ ID NO: 35210 - DNA, 21 bp, Artificial sequence
  SiRNA target sequence
cagaaagcggggaagtgtata

SEQ ID NO: 35211 - DNA, 21 bp, Artificial sequence
  SiRNA target sequence
agaaagcggggaagtgtataa

SEQ ID NO: 35212 - DNA, 21 bp, Artificial sequence
  SiRNA target sequence
gaaagcggggaagtgtataag

SEQ ID NO: 35213 - DNA, 21 bp, Artificial sequence
  SiRNA target sequence
aaagcggggaagtgtataaga

SEQ ID NO: 35214 - DNA, 21 bp, Artificial sequence
  SiRNA target sequence
aagcggggaagtgtataagac

SEQ ID NO: 35215 - DNA, 21 bp, Artificial sequence
  SiRNA target sequence
agcggggaagtgtataagact

SEQ ID NO: 35216 - DNA, 21 bp, Artificial sequence
  SiRNA target sequence
gcggggaagtgtataagactg

SEQ ID NO: 35217 - DNA, 21 bp, Artificial sequence
  SiRNA target sequence
cggggaagtgtataagactgg

SEQ ID NO: 35218 - DNA, 21 bp, Artificial sequence
  SiRNA target sequence
ggggaagtgtataagactgga

SEQ ID NO: 35219 - DNA, 21 bp, Artificial sequence
  SiRNA target sequence
gggaagtgtataagactggat

SEQ ID NO: 35220 - DNA, 21 bp, Artificial sequence
  SiRNA target sequence
ggaagtgtataagactggatt

SEQ ID NO: 35221 - DNA, 21 bp, Artificial sequence
  SiRNA target sequence
gaagtgtataagactggatta

SEQ ID NO: 35222 - DNA, 21 bp, Artificial sequence
  SiRNA target sequence
aagtgtataagactggattag

SEQ ID NO: 35223 - DNA, 21 bp, Artificial sequence
  SiRNA target sequence
agtgtataagactggattaga

SEQ ID NO: 35224 - DNA, 21 bp, Artificial sequence
  SiRNA target sequence
gtgtataagactggattagaa

SEQ ID NO: 35225 - DNA, 21 bp, Artificial sequence
  SiRNA target sequence
tgtataagactggattagaat

SEQ ID NO: 35226 - DNA, 21 bp, Artificial sequence
  SiRNA target sequence
gtataagactggattagaata

SEQ ID NO: 35227 - DNA, 21 bp, Artificial sequence
  SiRNA target sequence
tataagactggattagaatat

SEQ ID NO: 35228 - DNA, 21 bp, Artificial sequence
  SiRNA target sequence
ataagactggattagaatatg

SEQ ID NO: 35229 - DNA, 21 bp, Artificial sequence
  SiRNA target sequence
taagactggattagaatatga

SEQ ID NO: 35230 - DNA, 21 bp, Artificial sequence
  SiRNA target sequence
aagactggattagaatatgaa

SEQ ID NO: 35231 - DNA, 21 bp, Artificial sequence
  SiRNA target sequence
agactggattagaatatgaag

SEQ ID NO: 35232 - DNA, 21 bp, Artificial sequence
  SiRNA target sequence
gactggattagaatatgaaga

SEQ ID NO: 35233 - DNA, 21 bp, Artificial sequence
  SiRNA target sequence
actggattagaatatgaagaa

SEQ ID NO: 35234 - DNA, 21 bp, Artificial sequence
  SiRNA target sequence
ctggattagaatatgaagaat

SEQ ID NO: 35235 - DNA, 21 bp, Artificial sequence
  SiRNA target sequence
tggattagaatatgaagaatt

SEQ ID NO: 35236 - DNA, 21 bp, Artificial sequence
  SiRNA target sequence
ggattagaatatgaagaattt

SEQ ID NO: 35237 - DNA, 21 bp, Artificial sequence
  SiRNA target sequence
gattagaatatgaagaatttc

SEQ ID NO: 35238 - DNA, 21 bp, Artificial sequence
  SiRNA target sequence
attagaatatgaagaatttct

SEQ ID NO: 35239 - DNA, 21 bp, Artificial sequence
  SiRNA target sequence
ttagaatatgaagaatttctc

SEQ ID NO: 35240 - DNA, 21 bp, Artificial sequence
  SiRNA target sequence
tagaatatgaagaatttctcg

SEQ ID NO: 35241 - DNA, 21 bp, Artificial sequence
  SiRNA target sequence
agaatatgaagaatttctcga

SEQ ID NO: 35242 - DNA, 21 bp, Artificial sequence
  SiRNA target sequence
gaatatgaagaatttctcgat

SEQ ID NO: 35243 - DNA, 21 bp, Artificial sequence
  SiRNA target sequence
aatatgaagaatttctcgata

SEQ ID NO: 35244 - DNA, 21 bp, Artificial sequence
  SiRNA target sequence
atatgaagaatttctcgatat

SEQ ID NO: 35245 - DNA, 21 bp, Artificial sequence
  SiRNA target sequence
tatgaagaatttctcgatatg

SEQ ID NO: 35246 - DNA, 21 bp, Artificial sequence
  SiRNA target sequence
atgaagaatttctcgatatgt

SEQ ID NO: 35247 - DNA, 21 bp, Artificial sequence
  SiRNA target sequence
tgaagaatttctcgatatgtg

SEQ ID NO: 35248 - DNA, 21 bp, Artificial sequence
  SiRNA target sequence
gaagaatttctcgatatgtgt

SEQ ID NO: 35249 - DNA, 21 bp, Artificial sequence
  SiRNA target sequence
aagaatttctcgatatgtgtc

SEQ ID NO: 35250 - DNA, 21 bp, Artificial sequence
  SiRNA target sequence
agaatttctcgatatgtgtct

SEQ ID NO: 35251 - DNA, 21 bp, Artificial sequence
  SiRNA target sequence
gaatttctcgatatgtgtcta

SEQ ID NO: 35252 - DNA, 21 bp, Artificial sequence
  SiRNA target sequence
aatttctcgatatgtgtctag

SEQ ID NO: 35253 - DNA, 21 bp, Artificial sequence
  SiRNA target sequence
atttctcgatatgtgtctaga

SEQ ID NO: 35254 - DNA, 21 bp, Artificial sequence
  SiRNA target sequence
tttctcgatatgtgtctagaa

SEQ ID NO: 35255 - DNA, 21 bp, Artificial sequence
  SiRNA target sequence
ttctcgatatgtgtctagaaa

SEQ ID NO: 35256 - DNA, 21 bp, Artificial sequence
  SiRNA target sequence
tctcgatatgtgtctagaaaa

SEQ ID NO: 35257 - DNA, 21 bp, Artificial sequence
  SiRNA target sequence
ctcgatatgtgtctagaaaag

SEQ ID NO: 35258 - DNA, 21 bp, Artificial sequence
  SiRNA target sequence
tcgatatgtgtctagaaaaga

SEQ ID NO: 35259 - DNA, 21 bp, Artificial sequence
  SiRNA target sequence
cgatatgtgtctagaaaagac

SEQ ID NO: 35260 - DNA, 21 bp, Artificial sequence
  SiRNA target sequence
gatatgtgtctagaaaagact

SEQ ID NO: 35261 - DNA, 21 bp, Artificial sequence
  SiRNA target sequence
atatgtgtctagaaaagacta

SEQ ID NO: 35262 - DNA, 21 bp, Artificial sequence
  SiRNA target sequence
tatgtgtctagaaaagactag

SEQ ID NO: 35263 - DNA, 21 bp, Artificial sequence
  SiRNA target sequence
atgtgtctagaaaagactagt

SEQ ID NO: 35264 - DNA, 21 bp, Artificial sequence
  SiRNA target sequence
tgtgtctagaaaagactagtc

SEQ ID NO: 35265 - DNA, 21 bp, Artificial sequence
  SiRNA target sequence
gtgtctagaaaagactagtca

SEQ ID NO: 35266 - DNA, 21 bp, Artificial sequence
  SiRNA target sequence
tgtctagaaaagactagtcaa

SEQ ID NO: 35267 - DNA, 21 bp, Artificial sequence
  SiRNA target sequence
gtctagaaaagactagtcaat

SEQ ID NO: 35268 - DNA, 21 bp, Artificial sequence
  SiRNA target sequence
tctagaaaagactagtcaatg

SEQ ID NO: 35269 - DNA, 21 bp, Artificial sequence
  SiRNA target sequence
ctagaaaagactagtcaatgt

SEQ ID NO: 35270 - DNA, 21 bp, Artificial sequence
  SiRNA target sequence
tagaaaagactagtcaatgta

SEQ ID NO: 35271 - DNA, 21 bp, Artificial sequence
  SiRNA target sequence
agaaaagactagtcaatgtag

SEQ ID NO: 35272 - DNA, 21 bp, Artificial sequence
  SiRNA target sequence
gaaaagactagtcaatgtaga

SEQ ID NO: 35273 - DNA, 21 bp, Artificial sequence
  SiRNA target sequence
aaaagactagtcaatgtagag

SEQ ID NO: 35274 - DNA, 21 bp, Artificial sequence
  SiRNA target sequence
aaagactagtcaatgtagaga

SEQ ID NO: 35275 - DNA, 21 bp, Artificial sequence
  SiRNA target sequence
aagactagtcaatgtagagat

SEQ ID NO: 35276 - DNA, 21 bp, Artificial sequence
  SiRNA target sequence
agactagtcaatgtagagatg

SEQ ID NO: 35277 - DNA, 21 bp, Artificial sequence
  SiRNA target sequence
gactagtcaatgtagagatga

SEQ ID NO: 35278 - DNA, 21 bp, Artificial sequence
  SiRNA target sequence
actagtcaatgtagagatgat

SEQ ID NO: 35279 - DNA, 21 bp, Artificial sequence
  SiRNA target sequence
ctagtcaatgtagagatgatt

SEQ ID NO: 35280 - DNA, 21 bp, Artificial sequence
  SiRNA target sequence
tagtcaatgtagagatgattc

SEQ ID NO: 35281 - DNA, 21 bp, Artificial sequence
  SiRNA target sequence
agtcaatgtagagatgattct

SEQ ID NO: 35282 - DNA, 21 bp, Artificial sequence
  SiRNA target sequence
gtcaatgtagagatgattctg

SEQ ID NO: 35283 - DNA, 21 bp, Artificial sequence
  SiRNA target sequence
tcaatgtagagatgattctgc

SEQ ID NO: 35284 - DNA, 21 bp, Artificial sequence
  SiRNA target sequence
caatgtagagatgattctgca

SEQ ID NO: 35285 - DNA, 21 bp, Artificial sequence
  SiRNA target sequence
aatgtagagatgattctgcaa

SEQ ID NO: 35286 - DNA, 21 bp, Artificial sequence
  SiRNA target sequence
atgtagagatgattctgcaaa

SEQ ID NO: 35287 - DNA, 21 bp, Artificial sequence
  SiRNA target sequence
tgtagagatgattctgcaaaa

SEQ ID NO: 35288 - DNA, 21 bp, Artificial sequence
  SiRNA target sequence
gtagagatgattctgcaaaat

SEQ ID NO: 35289 - DNA, 21 bp, Artificial sequence
  SiRNA target sequence
tagagatgattctgcaaaatt

SEQ ID NO: 35290 - DNA, 21 bp, Artificial sequence
  SiRNA target sequence
agagatgattctgcaaaatta

SEQ ID NO: 35291 - DNA, 21 bp, Artificial sequence
  SiRNA target sequence
gagatgattctgcaaaattaa

SEQ ID NO: 35292 - DNA, 21 bp, Artificial sequence
  SiRNA target sequence
agatgattctgcaaaattaaa

SEQ ID NO: 35293 - DNA, 21 bp, Artificial sequence
  SiRNA target sequence
gatgattctgcaaaattaaat

SEQ ID NO: 35294 - DNA, 21 bp, Artificial sequence
  SiRNA target sequence
atgattctgcaaaattaaatg

SEQ ID NO: 35295 - DNA, 21 bp, Artificial sequence
  SiRNA target sequence
tgattctgcaaaattaaatga

SEQ ID NO: 35296 - DNA, 21 bp, Artificial sequence
  SiRNA target sequence
gattctgcaaaattaaatgat

SEQ ID NO: 35297 - DNA, 21 bp, Artificial sequence
  SiRNA target sequence
attctgcaaaattaaatgatt

SEQ ID NO: 35298 - DNA, 21 bp, Artificial sequence
  SiRNA target sequence
ttctgcaaaattaaatgattt

SEQ ID NO: 35299 - DNA, 21 bp, Artificial sequence
  SiRNA target sequence
tctgcaaaattaaatgatttt

SEQ ID NO: 35300 - DNA, 21 bp, Artificial sequence
  SiRNA target sequence
ctgcaaaattaaatgattttt

SEQ ID NO: 35301 - DNA, 21 bp, Artificial sequence
  SiRNA target sequence
tgcaaaattaaatgatttttt

SEQ ID NO: 35302 - DNA, 21 bp, Artificial sequence
  SiRNA target sequence
gcaaaattaaatgatttttta

SEQ ID NO: 35303 - DNA, 21 bp, Artificial sequence
  SiRNA target sequence
caaaattaaatgattttttaa

SEQ ID NO: 35304 - DNA, 21 bp, Artificial sequence
  SiRNA target sequence
aaaattaaatgattttttaat

SEQ ID NO: 35305 - DNA, 21 bp, Artificial sequence
  SiRNA target sequence
aaattaaatgattttttaatg

SEQ ID NO: 35306 - DNA, 21 bp, Artificial sequence
  SiRNA target sequence
aattaaatgattttttaatgg

SEQ ID NO: 35307 - DNA, 21 bp, Artificial sequence
  SiRNA target sequence
attaaatgattttttaatgga

SEQ ID NO: 35308 - DNA, 21 bp, Artificial sequence
  SiRNA target sequence
ttaaatgattttttaatggat

SEQ ID NO: 35309 - DNA, 21 bp, Artificial sequence
  SiRNA target sequence
taaatgattttttaatggatt

SEQ ID NO: 35310 - DNA, 21 bp, Artificial sequence
  SiRNA target sequence
aaatgattttttaatggatta

SEQ ID NO: 35311 - DNA, 21 bp, Artificial sequence
  SiRNA target sequence
aatgattttttaatggattat

SEQ ID NO: 35312 - DNA, 21 bp, Artificial sequence
  SiRNA target sequence
atgattttttaatggattatg

SEQ ID NO: 35313 - DNA, 21 bp, Artificial sequence
  SiRNA target sequence
tgattttttaatggattatgc

SEQ ID NO: 35314 - DNA, 21 bp, Artificial sequence
  SiRNA target sequence
gattttttaatggattatgca

SEQ ID NO: 35315 - DNA, 21 bp, Artificial sequence
  SiRNA target sequence
attttttaatggattatgcag

SEQ ID NO: 35316 - DNA, 21 bp, Artificial sequence
  SiRNA target sequence
ttttttaatggattatgcaga

SEQ ID NO: 35317 - DNA, 21 bp, Artificial sequence
  SiRNA target sequence
tttttaatggattatgcagag

SEQ ID NO: 35318 - DNA, 21 bp, Artificial sequence
  SiRNA target sequence
ttttaatggattatgcagaga

SEQ ID NO: 35319 - DNA, 21 bp, Artificial sequence
  SiRNA target sequence
tttaatggattatgcagagaa

SEQ ID NO: 35320 - DNA, 21 bp, Artificial sequence
  SiRNA target sequence
ttaatggattatgcagagaaa

SEQ ID NO: 35321 - DNA, 21 bp, Artificial sequence
  SiRNA target sequence
taatggattatgcagagaaaa

SEQ ID NO: 35322 - DNA, 21 bp, Artificial sequence
  SiRNA target sequence
aatggattatgcagagaaaag

SEQ ID NO: 35323 - DNA, 21 bp, Artificial sequence
  SiRNA target sequence
atggattatgcagagaaaaga

SEQ ID NO: 35324 - DNA, 21 bp, Artificial sequence
  SiRNA target sequence
tggattatgcagagaaaagag

SEQ ID NO: 35325 - DNA, 21 bp, Artificial sequence
  SiRNA target sequence
ggattatgcagagaaaagagc

SEQ ID NO: 35326 - DNA, 21 bp, Artificial sequence
  SiRNA target sequence
gattatgcagagaaaagagca

SEQ ID NO: 35327 - DNA, 21 bp, Artificial sequence
  SiRNA target sequence
attatgcagagaaaagagcaa

SEQ ID NO: 35328 - DNA, 21 bp, Artificial sequence
  SiRNA target sequence
ttatgcagagaaaagagcaaa

SEQ ID NO: 35329 - DNA, 21 bp, Artificial sequence
  SiRNA target sequence
tatgcagagaaaagagcaaat

SEQ ID NO: 35330 - DNA, 21 bp, Artificial sequence
  SiRNA target sequence
atgcagagaaaagagcaaata

SEQ ID NO: 35331 - DNA, 21 bp, Artificial sequence
  SiRNA target sequence
tgcagagaaaagagcaaatag

SEQ ID NO: 35332 - DNA, 21 bp, Artificial sequence
  SiRNA target sequence
gcagagaaaagagcaaataga

SEQ ID NO: 35333 - DNA, 21 bp, Artificial sequence
  SiRNA target sequence
cagagaaaagagcaaatagaa

SEQ ID NO: 35334 - DNA, 21 bp, Artificial sequence
  SiRNA target sequence
agagaaaagagcaaatagaag

SEQ ID NO: 35335 - DNA, 21 bp, Artificial sequence
  SiRNA target sequence
gagaaaagagcaaatagaagc

SEQ ID NO: 35336 - DNA, 21 bp, Artificial sequence
  SiRNA target sequence
agaaaagagcaaatagaagca

SEQ ID NO: 35337 - DNA, 21 bp, Artificial sequence
  SiRNA target sequence
gaaaagagcaaatagaagcag

SEQ ID NO: 35338 - DNA, 21 bp, Artificial sequence
  SiRNA target sequence
aaaagagcaaatagaagcaga

SEQ ID NO: 35339 - DNA, 21 bp, Artificial sequence
  SiRNA target sequence
aaagagcaaatagaagcagag

SEQ ID NO: 35340 - DNA, 21 bp, Artificial sequence
  SiRNA target sequence
aagagcaaatagaagcagaga

SEQ ID NO: 35341 - DNA, 21 bp, Artificial sequence
  SiRNA target sequence
agagcaaatagaagcagagaa

SEQ ID NO: 35342 - DNA, 21 bp, Artificial sequence
  SiRNA target sequence
gagcaaatagaagcagagaaa

SEQ ID NO: 35343 - DNA, 21 bp, Artificial sequence
  SiRNA target sequence
agcaaatagaagcagagaaat

SEQ ID NO: 35344 - DNA, 21 bp, Artificial sequence
  SiRNA target sequence
gcaaatagaagcagagaaatt

SEQ ID NO: 35345 - DNA, 21 bp, Artificial sequence
  SiRNA target sequence
caaatagaagcagagaaattg

SEQ ID NO: 35346 - DNA, 21 bp, Artificial sequence
  SiRNA target sequence
aaatagaagcagagaaattga

SEQ ID NO: 35347 - DNA, 21 bp, Artificial sequence
  SiRNA target sequence
aatagaagcagagaaattgat

SEQ ID NO: 35348 - DNA, 21 bp, Artificial sequence
  SiRNA target sequence
atagaagcagagaaattgatg

SEQ ID NO: 35349 - DNA, 21 bp, Artificial sequence
  SiRNA target sequence
tagaagcagagaaattgatga

SEQ ID NO: 35350 - DNA, 21 bp, Artificial sequence
  SiRNA target sequence
agaagcagagaaattgatgaa

SEQ ID NO: 35351 - DNA, 21 bp, Artificial sequence
  SiRNA target sequence
gaagcagagaaattgatgaag

SEQ ID NO: 35352 - DNA, 21 bp, Artificial sequence
  SiRNA target sequence
aagcagagaaattgatgaagt

SEQ ID NO: 35353 - DNA, 21 bp, Artificial sequence
  SiRNA target sequence
agcagagaaattgatgaagtt

SEQ ID NO: 35354 - DNA, 21 bp, Artificial sequence
  SiRNA target sequence
gcagagaaattgatgaagttt

SEQ ID NO: 35355 - DNA, 21 bp, Artificial sequence
  SiRNA target sequence
cagagaaattgatgaagtttg

SEQ ID NO: 35356 - DNA, 21 bp, Artificial sequence
  SiRNA target sequence
agagaaattgatgaagtttgc

SEQ ID NO: 35357 - DNA, 21 bp, Artificial sequence
  SiRNA target sequence
gagaaattgatgaagtttgcg

SEQ ID NO: 35358 - DNA, 21 bp, Artificial sequence
  SiRNA target sequence
agaaattgatgaagtttgcgc

SEQ ID NO: 35359 - DNA, 21 bp, Artificial sequence
  SiRNA target sequence
gaaattgatgaagtttgcgca

SEQ ID NO: 35360 - DNA, 21 bp, Artificial sequence
  SiRNA target sequence
aaattgatgaagtttgcgcac

SEQ ID NO: 35361 - DNA, 21 bp, Artificial sequence
  SiRNA target sequence
aattgatgaagtttgcgcacg

SEQ ID NO: 35362 - DNA, 21 bp, Artificial sequence
  SiRNA target sequence
attgatgaagtttgcgcacgt

SEQ ID NO: 35363 - DNA, 21 bp, Artificial sequence
  SiRNA target sequence
ttgatgaagtttgcgcacgta

SEQ ID NO: 35364 - DNA, 21 bp, Artificial sequence
  SiRNA target sequence
tgatgaagtttgcgcacgtac

SEQ ID NO: 35365 - DNA, 21 bp, Artificial sequence
  SiRNA target sequence
gatgaagtttgcgcacgtact

SEQ ID NO: 35366 - DNA, 21 bp, Artificial sequence
  SiRNA target sequence
atgaagtttgcgcacgtacta

SEQ ID NO: 35367 - DNA, 21 bp, Artificial sequence
  SiRNA target sequence
tgaagtttgcgcacgtactat

SEQ ID NO: 35368 - DNA, 21 bp, Artificial sequence
  SiRNA target sequence
gaagtttgcgcacgtactatg

SEQ ID NO: 35369 - DNA, 21 bp, Artificial sequence
  SiRNA target sequence
aagtttgcgcacgtactatgg

SEQ ID NO: 35370 - DNA, 21 bp, Artificial sequence
  SiRNA target sequence
agtttgcgcacgtactatgga

SEQ ID NO: 35371 - DNA, 21 bp, Artificial sequence
  SiRNA target sequence
gtttgcgcacgtactatggat

SEQ ID NO: 35372 - DNA, 21 bp, Artificial sequence
  SiRNA target sequence
tttgcgcacgtactatggatg

SEQ ID NO: 35373 - DNA, 21 bp, Artificial sequence
  SiRNA target sequence
ttgcgcacgtactatggatga

SEQ ID NO: 35374 - DNA, 21 bp, Artificial sequence
  SiRNA target sequence
tgcgcacgtactatggatgaa

SEQ ID NO: 35375 - DNA, 21 bp, Artificial sequence
  SiRNA target sequence
gcgcacgtactatggatgaag

SEQ ID NO: 35376 - DNA, 21 bp, Artificial sequence
  SiRNA target sequence
cgcacgtactatggatgaagc

SEQ ID NO: 35377 - DNA, 21 bp, Artificial sequence
  SiRNA target sequence
gcacgtactatggatgaagct

SEQ ID NO: 35378 - DNA, 21 bp, Artificial sequence
  SiRNA target sequence
cacgtactatggatgaagctt

SEQ ID NO: 35379 - DNA, 21 bp, Artificial sequence
  SiRNA target sequence
acgtactatggatgaagcttt

SEQ ID NO: 35380 - DNA, 21 bp, Artificial sequence
  SiRNA target sequence
cgtactatggatgaagctttt

SEQ ID NO: 35381 - DNA, 21 bp, Artificial sequence
  SiRNA target sequence
gtactatggatgaagcttttg

SEQ ID NO: 35382 - DNA, 21 bp, Artificial sequence
  SiRNA target sequence
tactatggatgaagcttttgt

SEQ ID NO: 35383 - DNA, 21 bp, Artificial sequence
  SiRNA target sequence
actatggatgaagcttttgtt

SEQ ID NO: 35384 - DNA, 21 bp, Artificial sequence
  SiRNA target sequence
ctatggatgaagcttttgttg

SEQ ID NO: 35385 - DNA, 21 bp, Artificial sequence
  SiRNA target sequence
tatggatgaagcttttgttga

SEQ ID NO: 35386 - DNA, 21 bp, Artificial sequence
  SiRNA target sequence
atggatgaagcttttgttgac

SEQ ID NO: 35387 - DNA, 21 bp, Artificial sequence
  SiRNA target sequence
tggatgaagcttttgttgacg

SEQ ID NO: 35388 - DNA, 21 bp, Artificial sequence
  SiRNA target sequence
ggatgaagcttttgttgacgc

SEQ ID NO: 35389 - DNA, 21 bp, Artificial sequence
  SiRNA target sequence
gatgaagcttttgttgacgca

SEQ ID NO: 35390 - DNA, 21 bp, Artificial sequence
  SiRNA target sequence
atgaagcttttgttgacgcat

SEQ ID NO: 35391 - DNA, 21 bp, Artificial sequence
  SiRNA target sequence
tgaagcttttgttgacgcata

SEQ ID NO: 35392 - DNA, 21 bp, Artificial sequence
  SiRNA target sequence
gaagcttttgttgacgcatat

SEQ ID NO: 35393 - DNA, 21 bp, Artificial sequence
  SiRNA target sequence
aagcttttgttgacgcatatg

SEQ ID NO: 35394 - DNA, 21 bp, Artificial sequence
  SiRNA target sequence
agcttttgttgacgcatatga

SEQ ID NO: 35395 - DNA, 21 bp, Artificial sequence
  SiRNA target sequence
gcttttgttgacgcatatgat

SEQ ID NO: 35396 - DNA, 21 bp, Artificial sequence
  SiRNA target sequence
cttttgttgacgcatatgatg

SEQ ID NO: 35397 - DNA, 21 bp, Artificial sequence
  SiRNA target sequence
ttttgttgacgcatatgatga

SEQ ID NO: 35398 - DNA, 21 bp, Artificial sequence
  SiRNA target sequence
tttgttgacgcatatgatgac

SEQ ID NO: 35399 - DNA, 21 bp, Artificial sequence
  SiRNA target sequence
ttgttgacgcatatgatgacg

SEQ ID NO: 35400 - DNA, 21 bp, Artificial sequence
  SiRNA target sequence
tgttgacgcatatgatgacgt

SEQ ID NO: 35401 - DNA, 21 bp, Artificial sequence
  SiRNA target sequence
gttgacgcatatgatgacgtc

SEQ ID NO: 35402 - DNA, 21 bp, Artificial sequence
  SiRNA target sequence
ttgacgcatatgatgacgtca

SEQ ID NO: 35403 - DNA, 21 bp, Artificial sequence
  SiRNA target sequence
tgacgcatatgatgacgtcat

SEQ ID NO: 35404 - DNA, 21 bp, Artificial sequence
  SiRNA target sequence
gacgcatatgatgacgtcatc

SEQ ID NO: 35405 - DNA, 21 bp, Artificial sequence
  SiRNA target sequence
acgcatatgatgacgtcatcg

SEQ ID NO: 35406 - DNA, 21 bp, Artificial sequence
  SiRNA target sequence
cgcatatgatgacgtcatcga

SEQ ID NO: 35407 - DNA, 21 bp, Artificial sequence
  SiRNA target sequence
gcatatgatgacgtcatcgat

SEQ ID NO: 35408 - DNA, 21 bp, Artificial sequence
  SiRNA target sequence
catatgatgacgtcatcgatg

SEQ ID NO: 35409 - DNA, 21 bp, Artificial sequence
  SiRNA target sequence
atatgatgacgtcatcgatgt

SEQ ID NO: 35410 - DNA, 21 bp, Artificial sequence
  SiRNA target sequence
tatgatgacgtcatcgatgta

SEQ ID NO: 35411 - DNA, 21 bp, Artificial sequence
  SiRNA target sequence
atgatgacgtcatcgatgtaa

SEQ ID NO: 35412 - DNA, 21 bp, Artificial sequence
  SiRNA target sequence
tgatgacgtcatcgatgtaaa

SEQ ID NO: 35413 - DNA, 21 bp, Artificial sequence
  SiRNA target sequence
gatgacgtcatcgatgtaaac

SEQ ID NO: 35414 - DNA, 21 bp, Artificial sequence
  SiRNA target sequence
atgacgtcatcgatgtaaaca

SEQ ID NO: 35415 - DNA, 21 bp, Artificial sequence
  SiRNA target sequence
tgacgtcatcgatgtaaacat

SEQ ID NO: 35416 - DNA, 21 bp, Artificial sequence
  SiRNA target sequence
gacgtcatcgatgtaaacatg

SEQ ID NO: 35417 - DNA, 21 bp, Artificial sequence
  SiRNA target sequence
acgtcatcgatgtaaacatgc

SEQ ID NO: 35418 - DNA, 21 bp, Artificial sequence
  SiRNA target sequence
cgtcatcgatgtaaacatgca

SEQ ID NO: 35419 - DNA, 21 bp, Artificial sequence
  SiRNA target sequence
gtcatcgatgtaaacatgcaa

SEQ ID NO: 35420 - DNA, 21 bp, Artificial sequence
  SiRNA target sequence
tcatcgatgtaaacatgcaaa

SEQ ID NO: 35421 - DNA, 21 bp, Artificial sequence
  SiRNA target sequence
catcgatgtaaacatgcaaat

SEQ ID NO: 35422 - DNA, 21 bp, Artificial sequence
  SiRNA target sequence
atcgatgtaaacatgcaaatt

SEQ ID NO: 35423 - DNA, 21 bp, Artificial sequence
  SiRNA target sequence
tcgatgtaaacatgcaaattg

SEQ ID NO: 35424 - DNA, 21 bp, Artificial sequence
  SiRNA target sequence
cgatgtaaacatgcaaattga

SEQ ID NO: 35425 - DNA, 21 bp, Artificial sequence
  SiRNA target sequence
gatgtaaacatgcaaattgaa

SEQ ID NO: 35426 - DNA, 21 bp, Artificial sequence
  SiRNA target sequence
atgtaaacatgcaaattgaaa

SEQ ID NO: 35427 - DNA, 21 bp, Artificial sequence
  SiRNA target sequence
tgtaaacatgcaaattgaaac

SEQ ID NO: 35428 - DNA, 21 bp, Artificial sequence
  SiRNA target sequence
gtaaacatgcaaattgaaaca

SEQ ID NO: 35429 - DNA, 21 bp, Artificial sequence
  SiRNA target sequence
taaacatgcaaattgaaacag

SEQ ID NO: 35430 - DNA, 21 bp, Artificial sequence
  SiRNA target sequence
aaacatgcaaattgaaacagt

SEQ ID NO: 35431 - DNA, 21 bp, Artificial sequence
  SiRNA target sequence
aacatgcaaattgaaacagtt

SEQ ID NO: 35432 - DNA, 21 bp, Artificial sequence
  SiRNA target sequence
acatgcaaattgaaacagttg

SEQ ID NO: 35433 - DNA, 21 bp, Artificial sequence
  SiRNA target sequence
catgcaaattgaaacagttga

SEQ ID NO: 35434 - DNA, 21 bp, Artificial sequence
  SiRNA target sequence
atgcaaattgaaacagttgat

SEQ ID NO: 35435 - DNA, 21 bp, Artificial sequence
  SiRNA target sequence
tgcaaattgaaacagttgatg

SEQ ID NO: 35436 - DNA, 21 bp, Artificial sequence
  SiRNA target sequence
gcaaattgaaacagttgatga

SEQ ID NO: 35437 - DNA, 21 bp, Artificial sequence
  SiRNA target sequence
caaattgaaacagttgatgaa

SEQ ID NO: 35438 - DNA, 21 bp, Artificial sequence
  SiRNA target sequence
aaattgaaacagttgatgaaa

SEQ ID NO: 35439 - DNA, 21 bp, Artificial sequence
  SiRNA target sequence
aattgaaacagttgatgaaat

SEQ ID NO: 35440 - DNA, 21 bp, Artificial sequence
  SiRNA target sequence
attgaaacagttgatgaaatg

SEQ ID NO: 35441 - DNA, 21 bp, Artificial sequence
  SiRNA target sequence
ttgaaacagttgatgaaatgg

SEQ ID NO: 35442 - DNA, 21 bp, Artificial sequence
  SiRNA target sequence
tgaaacagttgatgaaatgga

SEQ ID NO: 35443 - DNA, 21 bp, Artificial sequence
  SiRNA target sequence
gaaacagttgatgaaatggaa

SEQ ID NO: 35444 - DNA, 21 bp, Artificial sequence
  SiRNA target sequence
aaacagttgatgaaatggaac

SEQ ID NO: 35445 - DNA, 21 bp, Artificial sequence
  SiRNA target sequence
aacagttgatgaaatggaact

SEQ ID NO: 35446 - DNA, 21 bp, Artificial sequence
  SiRNA target sequence
acagttgatgaaatggaactg

SEQ ID NO: 35447 - DNA, 21 bp, Artificial sequence
  SiRNA target sequence
cagttgatgaaatggaactga

SEQ ID NO: 35448 - DNA, 21 bp, Artificial sequence
  SiRNA target sequence
agttgatgaaatggaactgat

SEQ ID NO: 35449 - DNA, 21 bp, Artificial sequence
  SiRNA target sequence
gttgatgaaatggaactgatt

SEQ ID NO: 35450 - DNA, 21 bp, Artificial sequence
  SiRNA target sequence
ttgatgaaatggaactgattg

SEQ ID NO: 35451 - DNA, 21 bp, Artificial sequence
  SiRNA target sequence
tgatgaaatggaactgattga

SEQ ID NO: 35452 - DNA, 21 bp, Artificial sequence
  SiRNA target sequence
gatgaaatggaactgattgaa

SEQ ID NO: 35453 - DNA, 21 bp, Artificial sequence
  SiRNA target sequence
atgaaatggaactgattgaac

SEQ ID NO: 35454 - DNA, 21 bp, Artificial sequence
  SiRNA target sequence
tgaaatggaactgattgaacc

SEQ ID NO: 35455 - DNA, 21 bp, Artificial sequence
  SiRNA target sequence
gaaatggaactgattgaaccc

SEQ ID NO: 35456 - DNA, 21 bp, Artificial sequence
  SiRNA target sequence
aaatggaactgattgaaccca

SEQ ID NO: 35457 - DNA, 21 bp, Artificial sequence
  SiRNA target sequence
aatggaactgattgaacccaa

SEQ ID NO: 35458 - DNA, 21 bp, Artificial sequence
  SiRNA target sequence
atggaactgattgaacccaac

SEQ ID NO: 35459 - DNA, 21 bp, Artificial sequence
  SiRNA target sequence
tggaactgattgaacccaaca

SEQ ID NO: 35460 - DNA, 21 bp, Artificial sequence
  SiRNA target sequence
ggaactgattgaacccaacaa

SEQ ID NO: 35461 - DNA, 21 bp, Artificial sequence
  SiRNA target sequence
gaactgattgaacccaacaaa

SEQ ID NO: 35462 - DNA, 21 bp, Artificial sequence
  SiRNA target sequence
aactgattgaacccaacaaat

SEQ ID NO: 35463 - DNA, 21 bp, Artificial sequence
  SiRNA target sequence
actgattgaacccaacaaatt

SEQ ID NO: 35464 - DNA, 21 bp, Artificial sequence
  SiRNA target sequence
ctgattgaacccaacaaatta

SEQ ID NO: 35465 - DNA, 21 bp, Artificial sequence
  SiRNA target sequence
tgattgaacccaacaaattaa

SEQ ID NO: 35466 - DNA, 21 bp, Artificial sequence
  SiRNA target sequence
gattgaacccaacaaattaag

SEQ ID NO: 35467 - DNA, 21 bp, Artificial sequence
  SiRNA target sequence
attgaacccaacaaattaaga

SEQ ID NO: 35468 - DNA, 21 bp, Artificial sequence
  SiRNA target sequence
ttgaacccaacaaattaagag

SEQ ID NO: 35469 - DNA, 21 bp, Artificial sequence
  SiRNA target sequence
tgaacccaacaaattaagaga

SEQ ID NO: 35470 - DNA, 21 bp, Artificial sequence
  SiRNA target sequence
gaacccaacaaattaagagag

SEQ ID NO: 35471 - DNA, 21 bp, Artificial sequence
  SiRNA target sequence
aacccaacaaattaagagaga

SEQ ID NO: 35472 - DNA, 21 bp, Artificial sequence
  SiRNA target sequence
acccaacaaattaagagagat

SEQ ID NO: 35473 - DNA, 21 bp, Artificial sequence
  SiRNA target sequence
cccaacaaattaagagagatg

SEQ ID NO: 35474 - DNA, 21 bp, Artificial sequence
  SiRNA target sequence
ccaacaaattaagagagatga

SEQ ID NO: 35475 - DNA, 21 bp, Artificial sequence
  SiRNA target sequence
caacaaattaagagagatgat

SEQ ID NO: 35476 - DNA, 21 bp, Artificial sequence
  SiRNA target sequence
aacaaattaagagagatgata

SEQ ID NO: 35477 - DNA, 21 bp, Artificial sequence
  SiRNA target sequence
acaaattaagagagatgatag

SEQ ID NO: 35478 - DNA, 21 bp, Artificial sequence
  SiRNA target sequence
caaattaagagagatgataga

SEQ ID NO: 35479 - DNA, 21 bp, Artificial sequence
  SiRNA target sequence
aaattaagagagatgatagaa

SEQ ID NO: 35480 - DNA, 21 bp, Artificial sequence
  SiRNA target sequence
aattaagagagatgatagaac

SEQ ID NO: 35481 - DNA, 21 bp, Artificial sequence
  SiRNA target sequence
attaagagagatgatagaaca

SEQ ID NO: 35482 - DNA, 21 bp, Artificial sequence
  SiRNA target sequence
ttaagagagatgatagaacaa

SEQ ID NO: 35483 - DNA, 21 bp, Artificial sequence
  SiRNA target sequence
taagagagatgatagaacaat

SEQ ID NO: 35484 - DNA, 21 bp, Artificial sequence
  SiRNA target sequence
aagagagatgatagaacaatg

SEQ ID NO: 35485 - DNA, 21 bp, Artificial sequence
  SiRNA target sequence
agagagatgatagaacaatgc

SEQ ID NO: 35486 - DNA, 21 bp, Artificial sequence
  SiRNA target sequence
gagagatgatagaacaatgct

SEQ ID NO: 35487 - DNA, 21 bp, Artificial sequence
  SiRNA target sequence
agagatgatagaacaatgctc

SEQ ID NO: 35488 - DNA, 21 bp, Artificial sequence
  SiRNA target sequence
gagatgatagaacaatgctca

SEQ ID NO: 35489 - DNA, 21 bp, Artificial sequence
  SiRNA target sequence
agatgatagaacaatgctcaa

SEQ ID NO: 35490 - DNA, 21 bp, Artificial sequence
  SiRNA target sequence
gatgatagaacaatgctcaaa

SEQ ID NO: 35491 - DNA, 21 bp, Artificial sequence
  SiRNA target sequence
atgatagaacaatgctcaaat

SEQ ID NO: 35492 - DNA, 21 bp, Artificial sequence
  SiRNA target sequence
tgatagaacaatgctcaaata

SEQ ID NO: 35493 - DNA, 21 bp, Artificial sequence
  SiRNA target sequence
gatagaacaatgctcaaataa

SEQ ID NO: 35494 - DNA, 21 bp, Artificial sequence
  SiRNA target sequence
atagaacaatgctcaaataag

SEQ ID NO: 35495 - DNA, 21 bp, Artificial sequence
  SiRNA target sequence
tagaacaatgctcaaataaga

SEQ ID NO: 35496 - DNA, 21 bp, Artificial sequence
  SiRNA target sequence
agaacaatgctcaaataagat

SEQ ID NO: 35497 - DNA, 21 bp, Artificial sequence
  SiRNA target sequence
gaacaatgctcaaataagata

SEQ ID NO: 35498 - DNA, 21 bp, Artificial sequence
  SiRNA target sequence
aacaatgctcaaataagatag

SEQ ID NO: 35499 - DNA, 21 bp, Artificial sequence
  SiRNA target sequence
acaatgctcaaataagatagt

SEQ ID NO: 35500 - DNA, 21 bp, Artificial sequence
  SiRNA target sequence
caatgctcaaataagatagta

SEQ ID NO: 35501 - DNA, 21 bp, Artificial sequence
  SiRNA target sequence
aatgctcaaataagatagtat

SEQ ID NO: 35502 - DNA, 21 bp, Artificial sequence
  SiRNA target sequence
atgctcaaataagatagtata

SEQ ID NO: 35503 - DNA, 21 bp, Artificial sequence
  SiRNA target sequence
tgctcaaataagatagtatac

SEQ ID NO: 35504 - DNA, 21 bp, Artificial sequence
  SiRNA target sequence
gctcaaataagatagtataca

SEQ ID NO: 35505 - DNA, 21 bp, Artificial sequence
  SiRNA target sequence
ctcaaataagatagtatacac

SEQ ID NO: 35506 - DNA, 21 bp, Artificial sequence
  SiRNA target sequence
tcaaataagatagtatacacg

SEQ ID NO: 35507 - DNA, 21 bp, Artificial sequence
  SiRNA target sequence
caaataagatagtatacacgt

SEQ ID NO: 35508 - DNA, 21 bp, Artificial sequence
  SiRNA target sequence
aaataagatagtatacacgta

SEQ ID NO: 35509 - DNA, 21 bp, Artificial sequence
  SiRNA target sequence
aataagatagtatacacgtat

SEQ ID NO: 35510 - DNA, 21 bp, Artificial sequence
  SiRNA target sequence
ataagatagtatacacgtatg

SEQ ID NO: 35511 - DNA, 21 bp, Artificial sequence
  SiRNA target sequence
taagatagtatacacgtatga

SEQ ID NO: 35512 - DNA, 21 bp, Artificial sequence
  SiRNA target sequence
aagatagtatacacgtatgaa

SEQ ID NO: 35513 - DNA, 21 bp, Artificial sequence
  SiRNA target sequence
agatagtatacacgtatgaag

SEQ ID NO: 35514 - DNA, 21 bp, Artificial sequence
  SiRNA target sequence
gatagtatacacgtatgaagg

SEQ ID NO: 35515 - DNA, 21 bp, Artificial sequence
  SiRNA target sequence
atagtatacacgtatgaagga

SEQ ID NO: 35516 - DNA, 21 bp, Artificial sequence
  SiRNA target sequence
tagtatacacgtatgaaggaa

SEQ ID NO: 35517 - DNA, 21 bp, Artificial sequence
  SiRNA target sequence
agtatacacgtatgaaggaat

SEQ ID NO: 35518 - DNA, 21 bp, Artificial sequence
  SiRNA target sequence
gtatacacgtatgaaggaata

SEQ ID NO: 35519 - DNA, 21 bp, Artificial sequence
  SiRNA target sequence
tatacacgtatgaaggaatag

SEQ ID NO: 35520 - DNA, 21 bp, Artificial sequence
  SiRNA target sequence
atacacgtatgaaggaatagc

SEQ ID NO: 35521 - DNA, 21 bp, Artificial sequence
  SiRNA target sequence
tacacgtatgaaggaatagct

SEQ ID NO: 35522 - DNA, 21 bp, Artificial sequence
  SiRNA target sequence
acacgtatgaaggaatagctg

SEQ ID NO: 35523 - DNA, 21 bp, Artificial sequence
  SiRNA target sequence
cacgtatgaaggaatagctgt

SEQ ID NO: 35524 - DNA, 21 bp, Artificial sequence
  SiRNA target sequence
acgtatgaaggaatagctgtt

SEQ ID NO: 35525 - DNA, 21 bp, Artificial sequence
  SiRNA target sequence
cgtatgaaggaatagctgtta

SEQ ID NO: 35526 - DNA, 21 bp, Artificial sequence
  SiRNA target sequence
gtatgaaggaatagctgttaa

SEQ ID NO: 35527 - DNA, 21 bp, Artificial sequence
  SiRNA target sequence
tatgaaggaatagctgttaaa

SEQ ID NO: 35528 - DNA, 21 bp, Artificial sequence
  SiRNA target sequence
atgaaggaatagctgttaaaa

SEQ ID NO: 35529 - DNA, 21 bp, Artificial sequence
  SiRNA target sequence
tgaaggaatagctgttaaaat

SEQ ID NO: 35530 - DNA, 21 bp, Artificial sequence
  SiRNA target sequence
gaaggaatagctgttaaaata

SEQ ID NO: 35531 - DNA, 21 bp, Artificial sequence
  SiRNA target sequence
aaggaatagctgttaaaataa

SEQ ID NO: 35532 - DNA, 21 bp, Artificial sequence
  SiRNA target sequence
aggaatagctgttaaaataac

SEQ ID NO: 35533 - DNA, 21 bp, Artificial sequence
  SiRNA target sequence
ggaatagctgttaaaataaca

SEQ ID NO: 35534 - DNA, 21 bp, Artificial sequence
  SiRNA target sequence
gaatagctgttaaaataacat

SEQ ID NO: 35535 - DNA, 21 bp, Artificial sequence
  SiRNA target sequence
aatagctgttaaaataacatc

SEQ ID NO: 35536 - DNA, 21 bp, Artificial sequence
  SiRNA target sequence
atagctgttaaaataacatca

SEQ ID NO: 35537 - DNA, 21 bp, Artificial sequence
  SiRNA target sequence
tagctgttaaaataacatcat

SEQ ID NO: 35538 - DNA, 21 bp, Artificial sequence
  SiRNA target sequence
agctgttaaaataacatcatt

SEQ ID NO: 35539 - DNA, 21 bp, Artificial sequence
  SiRNA target sequence
gctgttaaaataacatcatta

SEQ ID NO: 35540 - DNA, 21 bp, Artificial sequence
  SiRNA target sequence
ctgttaaaataacatcattag

SEQ ID NO: 35541 - DNA, 21 bp, Artificial sequence
  SiRNA target sequence
tgttaaaataacatcattagc

SEQ ID NO: 35542 - DNA, 21 bp, Artificial sequence
  SiRNA target sequence
gttaaaataacatcattagca

SEQ ID NO: 35543 - DNA, 21 bp, Artificial sequence
  SiRNA target sequence
ttaaaataacatcattagcat

SEQ ID NO: 35544 - DNA, 21 bp, Artificial sequence
  SiRNA target sequence
taaaataacatcattagcatt

SEQ ID NO: 35545 - DNA, 21 bp, Artificial sequence
  SiRNA target sequence
aaaataacatcattagcattt

SEQ ID NO: 35546 - DNA, 21 bp, Artificial sequence
  SiRNA target sequence
aaataacatcattagcattta

SEQ ID NO: 35547 - DNA, 21 bp, Artificial sequence
  SiRNA target sequence
aataacatcattagcatttaa

SEQ ID NO: 35548 - DNA, 21 bp, Artificial sequence
  SiRNA target sequence
ataacatcattagcatttaaa

SEQ ID NO: 35549 - DNA, 21 bp, Artificial sequence
  SiRNA target sequence
taacatcattagcatttaaac

SEQ ID NO: 35550 - DNA, 21 bp, Artificial sequence
  SiRNA target sequence
aacatcattagcatttaaact

SEQ ID NO: 35551 - DNA, 21 bp, Artificial sequence
  SiRNA target sequence
acatcattagcatttaaacta

SEQ ID NO: 35552 - DNA, 21 bp, Artificial sequence
  SiRNA target sequence
catcattagcatttaaactag

SEQ ID NO: 35553 - DNA, 21 bp, Artificial sequence
  SiRNA target sequence
atcattagcatttaaactagc

SEQ ID NO: 35554 - DNA, 21 bp, Artificial sequence
  SiRNA target sequence
tcattagcatttaaactagcc

SEQ ID NO: 35555 - DNA, 21 bp, Artificial sequence
  SiRNA target sequence
cattagcatttaaactagcca

SEQ ID NO: 35556 - DNA, 21 bp, Artificial sequence
  SiRNA target sequence
attagcatttaaactagccac

SEQ ID NO: 35557 - DNA, 21 bp, Artificial sequence
  SiRNA target sequence
ttagcatttaaactagccaca

SEQ ID NO: 35558 - DNA, 21 bp, Artificial sequence
  SiRNA target sequence
tagcatttaaactagccacac

SEQ ID NO: 35559 - DNA, 21 bp, Artificial sequence
  SiRNA target sequence
agcatttaaactagccacact

SEQ ID NO: 35560 - DNA, 21 bp, Artificial sequence
  SiRNA target sequence
gcatttaaactagccacacta

SEQ ID NO: 35561 - DNA, 21 bp, Artificial sequence
  SiRNA target sequence
catttaaactagccacactaa

SEQ ID NO: 35562 - DNA, 21 bp, Artificial sequence
  SiRNA target sequence
atttaaactagccacactaaa

SEQ ID NO: 35563 - DNA, 21 bp, Artificial sequence
  SiRNA target sequence
tttaaactagccacactaaac

SEQ ID NO: 35564 - DNA, 21 bp, Artificial sequence
  SiRNA target sequence
ttaaactagccacactaaact

SEQ ID NO: 35565 - DNA, 21 bp, Artificial sequence
  SiRNA target sequence
taaactagccacactaaacta

SEQ ID NO: 35566 - DNA, 21 bp, Artificial sequence
  SiRNA target sequence
aaactagccacactaaactac

SEQ ID NO: 35567 - DNA, 21 bp, Artificial sequence
  SiRNA target sequence
aactagccacactaaactacg

SEQ ID NO: 35568 - DNA, 21 bp, Artificial sequence
  SiRNA target sequence
actagccacactaaactacga

SEQ ID NO: 35569 - DNA, 21 bp, Artificial sequence
  SiRNA target sequence
ctagccacactaaactacgaa

SEQ ID NO: 35570 - DNA, 21 bp, Artificial sequence
  SiRNA target sequence
tagccacactaaactacgaag

SEQ ID NO: 35571 - DNA, 21 bp, Artificial sequence
  SiRNA target sequence
agccacactaaactacgaaga

SEQ ID NO: 35572 - DNA, 21 bp, Artificial sequence
  SiRNA target sequence
gccacactaaactacgaagaa

SEQ ID NO: 35573 - DNA, 21 bp, Artificial sequence
  SiRNA target sequence
ccacactaaactacgaagaac

SEQ ID NO: 35574 - DNA, 21 bp, Artificial sequence
  SiRNA target sequence
cacactaaactacgaagaaca

SEQ ID NO: 35575 - DNA, 21 bp, Artificial sequence
  SiRNA target sequence
acactaaactacgaagaacaa

SEQ ID NO: 35576 - DNA, 21 bp, Artificial sequence
  SiRNA target sequence
cactaaactacgaagaacaat

SEQ ID NO: 35577 - DNA, 21 bp, Artificial sequence
  SiRNA target sequence
actaaactacgaagaacaatg

SEQ ID NO: 35578 - DNA, 21 bp, Artificial sequence
  SiRNA target sequence
ctaaactacgaagaacaatgg

SEQ ID NO: 35579 - DNA, 21 bp, Artificial sequence
  SiRNA target sequence
taaactacgaagaacaatggg

SEQ ID NO: 35580 - DNA, 21 bp, Artificial sequence
  SiRNA target sequence
aaactacgaagaacaatggga

SEQ ID NO: 35581 - DNA, 21 bp, Artificial sequence
  SiRNA target sequence
aactacgaagaacaatgggaa

SEQ ID NO: 35582 - DNA, 21 bp, Artificial sequence
  SiRNA target sequence
actacgaagaacaatgggaac

SEQ ID NO: 35583 - DNA, 21 bp, Artificial sequence
  SiRNA target sequence
ctacgaagaacaatgggaaca

SEQ ID NO: 35584 - DNA, 21 bp, Artificial sequence
  SiRNA target sequence
tacgaagaacaatgggaacag

SEQ ID NO: 35585 - DNA, 21 bp, Artificial sequence
  SiRNA target sequence
acgaagaacaatgggaacaga

SEQ ID NO: 35586 - DNA, 21 bp, Artificial sequence
  SiRNA target sequence
cgaagaacaatgggaacagat

SEQ ID NO: 35587 - DNA, 21 bp, Artificial sequence
  SiRNA target sequence
gaagaacaatgggaacagatt

SEQ ID NO: 35588 - DNA, 21 bp, Artificial sequence
  SiRNA target sequence
aagaacaatgggaacagatta

SEQ ID NO: 35589 - DNA, 21 bp, Artificial sequence
  SiRNA target sequence
agaacaatgggaacagattaa

SEQ ID NO: 35590 - DNA, 21 bp, Artificial sequence
  SiRNA target sequence
gaacaatgggaacagattaag

SEQ ID NO: 35591 - DNA, 21 bp, Artificial sequence
  SiRNA target sequence
aacaatgggaacagattaagg

SEQ ID NO: 35592 - DNA, 21 bp, Artificial sequence
  SiRNA target sequence
acaatgggaacagattaagga

SEQ ID NO: 35593 - DNA, 21 bp, Artificial sequence
  SiRNA target sequence
caatgggaacagattaaggaa

SEQ ID NO: 35594 - DNA, 21 bp, Artificial sequence
  SiRNA target sequence
aatgggaacagattaaggaaa

SEQ ID NO: 35595 - DNA, 21 bp, Artificial sequence
  SiRNA target sequence
atgggaacagattaaggaaat

SEQ ID NO: 35596 - DNA, 21 bp, Artificial sequence
  SiRNA target sequence
tgggaacagattaaggaaatg

SEQ ID NO: 35597 - DNA, 21 bp, Artificial sequence
  SiRNA target sequence
gggaacagattaaggaaatga

SEQ ID NO: 35598 - DNA, 21 bp, Artificial sequence
  SiRNA target sequence
ggaacagattaaggaaatgaa

SEQ ID NO: 35599 - DNA, 21 bp, Artificial sequence
  SiRNA target sequence
gaacagattaaggaaatgaaa

SEQ ID NO: 35600 - DNA, 21 bp, Artificial sequence
  SiRNA target sequence
aacagattaaggaaatgaaat

SEQ ID NO: 35601 - DNA, 21 bp, Artificial sequence
  SiRNA target sequence
acagattaaggaaatgaaata

SEQ ID NO: 35602 - DNA, 21 bp, Artificial sequence
  SiRNA target sequence
cagattaaggaaatgaaatat

SEQ ID NO: 35603 - DNA, 21 bp, Artificial sequence
  SiRNA target sequence
agattaaggaaatgaaatatt

SEQ ID NO: 35604 - DNA, 21 bp, Artificial sequence
  SiRNA target sequence
gattaaggaaatgaaatatta

SEQ ID NO: 35605 - DNA, 21 bp, Artificial sequence
  SiRNA target sequence
attaaggaaatgaaatattat

SEQ ID NO: 35606 - DNA, 21 bp, Artificial sequence
  SiRNA target sequence
ttaaggaaatgaaatattatg

SEQ ID NO: 35607 - DNA, 21 bp, Artificial sequence
  SiRNA target sequence
taaggaaatgaaatattatgt

SEQ ID NO: 35608 - DNA, 21 bp, Artificial sequence
  SiRNA target sequence
aaggaaatgaaatattatgtt

SEQ ID NO: 35609 - DNA, 21 bp, Artificial sequence
  SiRNA target sequence
aggaaatgaaatattatgtta

SEQ ID NO: 35610 - DNA, 21 bp, Artificial sequence
  SiRNA target sequence
ggaaatgaaatattatgttaa

SEQ ID NO: 35611 - DNA, 21 bp, Artificial sequence
  SiRNA target sequence
gaaatgaaatattatgttaaa

SEQ ID NO: 35612 - DNA, 21 bp, Artificial sequence
  SiRNA target sequence
aaatgaaatattatgttaaag

SEQ ID NO: 35613 - DNA, 21 bp, Artificial sequence
  SiRNA target sequence
aatgaaatattatgttaaagt

SEQ ID NO: 35614 - DNA, 21 bp, Artificial sequence
  SiRNA target sequence
atgaaatattatgttaaagtg

SEQ ID NO: 35615 - DNA, 21 bp, Artificial sequence
  SiRNA target sequence
tgaaatattatgttaaagtga

SEQ ID NO: 35616 - DNA, 21 bp, Artificial sequence
  SiRNA target sequence
gaaatattatgttaaagtgag

SEQ ID NO: 35617 - DNA, 21 bp, Artificial sequence
  SiRNA target sequence
aaatattatgttaaagtgagt

SEQ ID NO: 35618 - DNA, 21 bp, Artificial sequence
  SiRNA target sequence
aatattatgttaaagtgagtt

SEQ ID NO: 35619 - DNA, 21 bp, Artificial sequence
  SiRNA target sequence
atattatgttaaagtgagttc

SEQ ID NO: 35620 - DNA, 21 bp, Artificial sequence
  SiRNA target sequence
tattatgttaaagtgagttca

SEQ ID NO: 35621 - DNA, 21 bp, Artificial sequence
  SiRNA target sequence
attatgttaaagtgagttcag

SEQ ID NO: 35622 - DNA, 21 bp, Artificial sequence
  SiRNA target sequence
ttatgttaaagtgagttcagg

SEQ ID NO: 35623 - DNA, 21 bp, Artificial sequence
  SiRNA target sequence
tatgttaaagtgagttcaggt

SEQ ID NO: 35624 - DNA, 21 bp, Artificial sequence
  SiRNA target sequence
atgttaaagtgagttcaggtg

SEQ ID NO: 35625 - DNA, 21 bp, Artificial sequence
  SiRNA target sequence
tgttaaagtgagttcaggtgt

SEQ ID NO: 35626 - DNA, 21 bp, Artificial sequence
  SiRNA target sequence
gttaaagtgagttcaggtgtg

SEQ ID NO: 35627 - DNA, 21 bp, Artificial sequence
  SiRNA target sequence
ttaaagtgagttcaggtgtga

SEQ ID NO: 35628 - DNA, 21 bp, Artificial sequence
  SiRNA target sequence
taaagtgagttcaggtgtgaa

SEQ ID NO: 35629 - DNA, 21 bp, Artificial sequence
  SiRNA target sequence
aaagtgagttcaggtgtgaac

SEQ ID NO: 35630 - DNA, 21 bp, Artificial sequence
  SiRNA target sequence
aagtgagttcaggtgtgaact

SEQ ID NO: 35631 - DNA, 21 bp, Artificial sequence
  SiRNA target sequence
agtgagttcaggtgtgaacta

SEQ ID NO: 35632 - DNA, 21 bp, Artificial sequence
  SiRNA target sequence
gtgagttcaggtgtgaactat

SEQ ID NO: 35633 - DNA, 21 bp, Artificial sequence
  SiRNA target sequence
tgagttcaggtgtgaactatc

SEQ ID NO: 35634 - DNA, 21 bp, Artificial sequence
  SiRNA target sequence
gagttcaggtgtgaactatct

SEQ ID NO: 35635 - DNA, 21 bp, Artificial sequence
  SiRNA target sequence
agttcaggtgtgaactatctt

SEQ ID NO: 35636 - DNA, 21 bp, Artificial sequence
  SiRNA target sequence
gttcaggtgtgaactatctta

SEQ ID NO: 35637 - DNA, 21 bp, Artificial sequence
  SiRNA target sequence
ttcaggtgtgaactatcttaa

SEQ ID NO: 35638 - DNA, 21 bp, Artificial sequence
  SiRNA target sequence
tcaggtgtgaactatcttaaa

SEQ ID NO: 35639 - DNA, 21 bp, Artificial sequence
  SiRNA target sequence
caggtgtgaactatcttaaaa

SEQ ID NO: 35640 - DNA, 21 bp, Artificial sequence
  SiRNA target sequence
aggtgtgaactatcttaaaag

SEQ ID NO: 35641 - DNA, 21 bp, Artificial sequence
  SiRNA target sequence
ggtgtgaactatcttaaaaga

SEQ ID NO: 35642 - DNA, 21 bp, Artificial sequence
  SiRNA target sequence
gtgtgaactatcttaaaagag

SEQ ID NO: 35643 - DNA, 21 bp, Artificial sequence
  SiRNA target sequence
tgtgaactatcttaaaagagt

SEQ ID NO: 35644 - DNA, 21 bp, Artificial sequence
  SiRNA target sequence
gtgaactatcttaaaagagtg

SEQ ID NO: 35645 - DNA, 21 bp, Artificial sequence
  SiRNA target sequence
tgaactatcttaaaagagtgt

SEQ ID NO: 35646 - DNA, 21 bp, Artificial sequence
  SiRNA target sequence
gaactatcttaaaagagtgtt

SEQ ID NO: 35647 - DNA, 21 bp, Artificial sequence
  SiRNA target sequence
aactatcttaaaagagtgtta

SEQ ID NO: 35648 - DNA, 21 bp, Artificial sequence
  SiRNA target sequence
actatcttaaaagagtgttaa

SEQ ID NO: 35649 - DNA, 21 bp, Artificial sequence
  SiRNA target sequence
ctatcttaaaagagtgttaag

SEQ ID NO: 35650 - DNA, 21 bp, Artificial sequence
  SiRNA target sequence
tatcttaaaagagtgttaagt

SEQ ID NO: 35651 - DNA, 21 bp, Artificial sequence
  SiRNA target sequence
atcttaaaagagtgttaagtc

SEQ ID NO: 35652 - DNA, 21 bp, Artificial sequence
  SiRNA target sequence
tcttaaaagagtgttaagtca

SEQ ID NO: 35653 - DNA, 21 bp, Artificial sequence
  SiRNA target sequence
cttaaaagagtgttaagtcag

SEQ ID NO: 35654 - DNA, 21 bp, Artificial sequence
  SiRNA target sequence
ttaaaagagtgttaagtcagg

SEQ ID NO: 35655 - DNA, 21 bp, Artificial sequence
  SiRNA target sequence
taaaagagtgttaagtcaggg

SEQ ID NO: 35656 - DNA, 21 bp, Artificial sequence
  SiRNA target sequence
aaaagagtgttaagtcagggt

SEQ ID NO: 35657 - DNA, 21 bp, Artificial sequence
  SiRNA target sequence
aaagagtgttaagtcagggta

SEQ ID NO: 35658 - DNA, 21 bp, Artificial sequence
  SiRNA target sequence
aagagtgttaagtcagggtat

SEQ ID NO: 35659 - DNA, 21 bp, Artificial sequence
  SiRNA target sequence
agagtgttaagtcagggtatg

SEQ ID NO: 35660 - DNA, 21 bp, Artificial sequence
  SiRNA target sequence
gagtgttaagtcagggtatga

SEQ ID NO: 35661 - DNA, 21 bp, Artificial sequence
  SiRNA target sequence
agtgttaagtcagggtatgaa

SEQ ID NO: 35662 - DNA, 21 bp, Artificial sequence
  SiRNA target sequence
gtgttaagtcagggtatgaaa

SEQ ID NO: 35663 - DNA, 21 bp, Artificial sequence
  SiRNA target sequence
tgttaagtcagggtatgaaag

SEQ ID NO: 35664 - DNA, 21 bp, Artificial sequence
  SiRNA target sequence
gttaagtcagggtatgaaagt

SEQ ID NO: 35665 - DNA, 21 bp, Artificial sequence
  SiRNA target sequence
ttaagtcagggtatgaaagtg

SEQ ID NO: 35666 - DNA, 21 bp, Artificial sequence
  SiRNA target sequence
taagtcagggtatgaaagtgt

SEQ ID NO: 35667 - DNA, 21 bp, Artificial sequence
  SiRNA target sequence
aagtcagggtatgaaagtgtg

SEQ ID NO: 35668 - DNA, 21 bp, Artificial sequence
  SiRNA target sequence
agtcagggtatgaaagtgtgt

SEQ ID NO: 35669 - DNA, 21 bp, Artificial sequence
  SiRNA target sequence
gtcagggtatgaaagtgtgtg

SEQ ID NO: 35670 - DNA, 21 bp, Artificial sequence
  SiRNA target sequence
tcagggtatgaaagtgtgtga

SEQ ID NO: 35671 - DNA, 21 bp, Artificial sequence
  SiRNA target sequence
cagggtatgaaagtgtgtgaa

SEQ ID NO: 35672 - DNA, 21 bp, Artificial sequence
  SiRNA target sequence
agggtatgaaagtgtgtgaag

SEQ ID NO: 35673 - DNA, 21 bp, Artificial sequence
  SiRNA target sequence
gggtatgaaagtgtgtgaaga

SEQ ID NO: 35674 - DNA, 21 bp, Artificial sequence
  SiRNA target sequence
ggtatgaaagtgtgtgaagaa

SEQ ID NO: 35675 - DNA, 21 bp, Artificial sequence
  SiRNA target sequence
gtatgaaagtgtgtgaagaat

SEQ ID NO: 35676 - DNA, 21 bp, Artificial sequence
  SiRNA target sequence
tatgaaagtgtgtgaagaatg

SEQ ID NO: 35677 - DNA, 21 bp, Artificial sequence
  SiRNA target sequence
atgaaagtgtgtgaagaatgg

SEQ ID NO: 35678 - DNA, 21 bp, Artificial sequence
  SiRNA target sequence
tgaaagtgtgtgaagaatgga

SEQ ID NO: 35679 - DNA, 21 bp, Artificial sequence
  SiRNA target sequence
gaaagtgtgtgaagaatggat

SEQ ID NO: 35680 - DNA, 21 bp, Artificial sequence
  SiRNA target sequence
aaagtgtgtgaagaatggatg

SEQ ID NO: 35681 - DNA, 21 bp, Artificial sequence
  SiRNA target sequence
aagtgtgtgaagaatggatga

SEQ ID NO: 35682 - DNA, 21 bp, Artificial sequence
  SiRNA target sequence
agtgtgtgaagaatggatgaa

SEQ ID NO: 35683 - DNA, 21 bp, Artificial sequence
  SiRNA target sequence
gtgtgtgaagaatggatgaaa

SEQ ID NO: 35684 - DNA, 21 bp, Artificial sequence
  SiRNA target sequence
tgtgtgaagaatggatgaaag

SEQ ID NO: 35685 - DNA, 21 bp, Artificial sequence
  SiRNA target sequence
gtgtgaagaatggatgaaaga

SEQ ID NO: 35686 - DNA, 21 bp, Artificial sequence
  SiRNA target sequence
tgtgaagaatggatgaaagaa

SEQ ID NO: 35687 - DNA, 21 bp, Artificial sequence
  SiRNA target sequence
gtgaagaatggatgaaagaaa

SEQ ID NO: 35688 - DNA, 21 bp, Artificial sequence
  SiRNA target sequence
tgaagaatggatgaaagaaat

SEQ ID NO: 35689 - DNA, 21 bp, Artificial sequence
  SiRNA target sequence
gaagaatggatgaaagaaatg

SEQ ID NO: 35690 - DNA, 21 bp, Artificial sequence
  SiRNA target sequence
aagaatggatgaaagaaatga

SEQ ID NO: 35691 - DNA, 21 bp, Artificial sequence
  SiRNA target sequence
agaatggatgaaagaaatgat

SEQ ID NO: 35692 - DNA, 21 bp, Artificial sequence
  SiRNA target sequence
gaatggatgaaagaaatgatt

SEQ ID NO: 35693 - DNA, 21 bp, Artificial sequence
  SiRNA target sequence
aatggatgaaagaaatgatta

SEQ ID NO: 35694 - DNA, 21 bp, Artificial sequence
  SiRNA target sequence
atggatgaaagaaatgattaa

SEQ ID NO: 35695 - DNA, 21 bp, Artificial sequence
  SiRNA target sequence
tggatgaaagaaatgattaac

SEQ ID NO: 35696 - DNA, 21 bp, Artificial sequence
  SiRNA target sequence
ggatgaaagaaatgattaact

SEQ ID NO: 35697 - DNA, 21 bp, Artificial sequence
  SiRNA target sequence
gatgaaagaaatgattaacta

SEQ ID NO: 35698 - DNA, 21 bp, Artificial sequence
  SiRNA target sequence
atgaaagaaatgattaactac

SEQ ID NO: 35699 - DNA, 21 bp, Artificial sequence
  SiRNA target sequence
tgaaagaaatgattaactacg

SEQ ID NO: 35700 - DNA, 21 bp, Artificial sequence
  SiRNA target sequence
gaaagaaatgattaactacgt

SEQ ID NO: 35701 - DNA, 21 bp, Artificial sequence
  SiRNA target sequence
aaagaaatgattaactacgtt

SEQ ID NO: 35702 - DNA, 21 bp, Artificial sequence
  SiRNA target sequence
aagaaatgattaactacgtta

SEQ ID NO: 35703 - DNA, 21 bp, Artificial sequence
  SiRNA target sequence
agaaatgattaactacgttaa

SEQ ID NO: 35704 - DNA, 21 bp, Artificial sequence
  SiRNA target sequence
gaaatgattaactacgttaag

SEQ ID NO: 35705 - DNA, 21 bp, Artificial sequence
  SiRNA target sequence
aaatgattaactacgttaagg

SEQ ID NO: 35706 - DNA, 21 bp, Artificial sequence
  SiRNA target sequence
aatgattaactacgttaagga

SEQ ID NO: 35707 - DNA, 21 bp, Artificial sequence
  SiRNA target sequence
atgattaactacgttaaggaa

SEQ ID NO: 35708 - DNA, 21 bp, Artificial sequence
  SiRNA target sequence
tgattaactacgttaaggaac

SEQ ID NO: 35709 - DNA, 21 bp, Artificial sequence
  SiRNA target sequence
gattaactacgttaaggaaca

SEQ ID NO: 35710 - DNA, 21 bp, Artificial sequence
  SiRNA target sequence
attaactacgttaaggaacat

SEQ ID NO: 35711 - DNA, 21 bp, Artificial sequence
  SiRNA target sequence
ttaactacgttaaggaacatc

SEQ ID NO: 35712 - DNA, 21 bp, Artificial sequence
  SiRNA target sequence
taactacgttaaggaacatcc

SEQ ID NO: 35713 - DNA, 21 bp, Artificial sequence
  SiRNA target sequence
aactacgttaaggaacatcca

SEQ ID NO: 35714 - DNA, 21 bp, Artificial sequence
  SiRNA target sequence
actacgttaaggaacatccat

SEQ ID NO: 35715 - DNA, 21 bp, Artificial sequence
  SiRNA target sequence
ctacgttaaggaacatccatg

SEQ ID NO: 35716 - DNA, 21 bp, Artificial sequence
  SiRNA target sequence
tacgttaaggaacatccatgg

SEQ ID NO: 35717 - DNA, 21 bp, Artificial sequence
  SiRNA target sequence
acgttaaggaacatccatgga

SEQ ID NO: 35718 - DNA, 21 bp, Artificial sequence
  SiRNA target sequence
cgttaaggaacatccatggat

SEQ ID NO: 35719 - DNA, 21 bp, Artificial sequence
  SiRNA target sequence
gttaaggaacatccatggatg

SEQ ID NO: 35720 - DNA, 21 bp, Artificial sequence
  SiRNA target sequence
ttaaggaacatccatggatga

SEQ ID NO: 35721 - DNA, 21 bp, Artificial sequence
  SiRNA target sequence
taaggaacatccatggatgac

SEQ ID NO: 35722 - DNA, 21 bp, Artificial sequence
  SiRNA target sequence
aaggaacatccatggatgacc

SEQ ID NO: 35723 - DNA, 21 bp, Artificial sequence
  SiRNA target sequence
aggaacatccatggatgaccg

SEQ ID NO: 35724 - DNA, 21 bp, Artificial sequence
  SiRNA target sequence
ggaacatccatggatgaccgt

SEQ ID NO: 35725 - DNA, 21 bp, Artificial sequence
  SiRNA target sequence
gaacatccatggatgaccgtt

SEQ ID NO: 35726 - DNA, 21 bp, Artificial sequence
  SiRNA target sequence
aacatccatggatgaccgtta

SEQ ID NO: 35727 - DNA, 21 bp, Artificial sequence
  SiRNA target sequence
acatccatggatgaccgttag

SEQ ID NO: 35728 - DNA, 21 bp, Artificial sequence
  SiRNA target sequence
catccatggatgaccgttagt

SEQ ID NO: 35729 - DNA, 21 bp, Artificial sequence
  SiRNA target sequence
atccatggatgaccgttagtt

SEQ ID NO: 35730 - DNA, 21 bp, Artificial sequence
  SiRNA target sequence
tccatggatgaccgttagttt

SEQ ID NO: 35731 - DNA, 21 bp, Artificial sequence
  SiRNA target sequence
ccatggatgaccgttagttta

SEQ ID NO: 35732 - DNA, 21 bp, Artificial sequence
  SiRNA target sequence
catggatgaccgttagtttaa

SEQ ID NO: 35733 - DNA, 21 bp, Artificial sequence
  SiRNA target sequence
atggatgaccgttagtttaat

SEQ ID NO: 35734 - DNA, 21 bp, Artificial sequence
  SiRNA target sequence
tggatgaccgttagtttaata

SEQ ID NO: 35735 - DNA, 21 bp, Artificial sequence
  SiRNA target sequence
ggatgaccgttagtttaatac

SEQ ID NO: 35736 - DNA, 21 bp, Artificial sequence
  SiRNA target sequence
gatgaccgttagtttaatact

SEQ ID NO: 35737 - DNA, 21 bp, Artificial sequence
  SiRNA target sequence
atgaccgttagtttaatactg

SEQ ID NO: 35738 - DNA, 21 bp, Artificial sequence
  SiRNA target sequence
tgaccgttagtttaatactgg

SEQ ID NO: 35739 - DNA, 21 bp, Artificial sequence
  SiRNA target sequence
gaccgttagtttaatactggg

SEQ ID NO: 35740 - DNA, 21 bp, Artificial sequence
  SiRNA target sequence
accgttagtttaatactgggc

SEQ ID NO: 35741 - DNA, 21 bp, Artificial sequence
  SiRNA target sequence
ccgttagtttaatactgggca

SEQ ID NO: 35742 - DNA, 21 bp, Artificial sequence
  SiRNA target sequence
cgttagtttaatactgggcac

SEQ ID NO: 35743 - DNA, 21 bp, Artificial sequence
  SiRNA target sequence
gttagtttaatactgggcact

SEQ ID NO: 35744 - DNA, 21 bp, Artificial sequence
  SiRNA target sequence
ttagtttaatactgggcactc

SEQ ID NO: 35745 - DNA, 21 bp, Artificial sequence
  SiRNA target sequence
tagtttaatactgggcactct

SEQ ID NO: 35746 - DNA, 21 bp, Artificial sequence
  SiRNA target sequence
agtttaatactgggcactctc

SEQ ID NO: 35747 - DNA, 21 bp, Artificial sequence
  SiRNA target sequence
gtttaatactgggcactctca

SEQ ID NO: 35748 - DNA, 21 bp, Artificial sequence
  SiRNA target sequence
tttaatactgggcactctcat

SEQ ID NO: 35749 - DNA, 21 bp, Artificial sequence
  SiRNA target sequence
ttaatactgggcactctcatt

SEQ ID NO: 35750 - DNA, 21 bp, Artificial sequence
  SiRNA target sequence
taatactgggcactctcattg

SEQ ID NO: 35751 - DNA, 21 bp, Artificial sequence
  SiRNA target sequence
aatactgggcactctcattgg

SEQ ID NO: 35752 - DNA, 21 bp, Artificial sequence
  SiRNA target sequence
atactgggcactctcattgga

SEQ ID NO: 35753 - DNA, 21 bp, Artificial sequence
  SiRNA target sequence
tactgggcactctcattggaa

SEQ ID NO: 35754 - DNA, 21 bp, Artificial sequence
  SiRNA target sequence
actgggcactctcattggaat

SEQ ID NO: 35755 - DNA, 21 bp, Artificial sequence
  SiRNA target sequence
ctgggcactctcattggaata

SEQ ID NO: 35756 - DNA, 21 bp, Artificial sequence
  SiRNA target sequence
tgggcactctcattggaatac

SEQ ID NO: 35757 - DNA, 21 bp, Artificial sequence
  SiRNA target sequence
gggcactctcattggaatact

SEQ ID NO: 35758 - DNA, 21 bp, Artificial sequence
  SiRNA target sequence
ggcactctcattggaatactt

SEQ ID NO: 35759 - DNA, 21 bp, Artificial sequence
  SiRNA target sequence
gcactctcattggaatactta

SEQ ID NO: 35760 - DNA, 21 bp, Artificial sequence
  SiRNA target sequence
cactctcattggaatacttac

SEQ ID NO: 35761 - DNA, 21 bp, Artificial sequence
  SiRNA target sequence
actctcattggaatacttact

SEQ ID NO: 35762 - DNA, 21 bp, Artificial sequence
  SiRNA target sequence
ctctcattggaatacttactg

SEQ ID NO: 35763 - DNA, 21 bp, Artificial sequence
  SiRNA target sequence
tctcattggaatacttactgt

SEQ ID NO: 35764 - DNA, 21 bp, Artificial sequence
  SiRNA target sequence
ctcattggaatacttactgtt

SEQ ID NO: 35765 - DNA, 21 bp, Artificial sequence
  SiRNA target sequence
tcattggaatacttactgttg

SEQ ID NO: 35766 - DNA, 21 bp, Artificial sequence
  SiRNA target sequence
cattggaatacttactgttgt

SEQ ID NO: 35767 - DNA, 21 bp, Artificial sequence
  SiRNA target sequence
attggaatacttactgttgta

SEQ ID NO: 35768 - DNA, 21 bp, Artificial sequence
  SiRNA target sequence
ttggaatacttactgttgtag

SEQ ID NO: 35769 - DNA, 21 bp, Artificial sequence
  SiRNA target sequence
tggaatacttactgttgtagg

SEQ ID NO: 35770 - DNA, 21 bp, Artificial sequence
  SiRNA target sequence
ggaatacttactgttgtaggg

SEQ ID NO: 35771 - DNA, 21 bp, Artificial sequence
  SiRNA target sequence
gaatacttactgttgtagggt

SEQ ID NO: 35772 - DNA, 21 bp, Artificial sequence
  SiRNA target sequence
aatacttactgttgtagggtt

SEQ ID NO: 35773 - DNA, 21 bp, Artificial sequence
  SiRNA target sequence
atacttactgttgtagggttt

SEQ ID NO: 35774 - DNA, 21 bp, Artificial sequence
  SiRNA target sequence
tacttactgttgtagggtttt

SEQ ID NO: 35775 - DNA, 21 bp, Artificial sequence
  SiRNA target sequence
acttactgttgtagggttttg

SEQ ID NO: 35776 - DNA, 21 bp, Artificial sequence
  SiRNA target sequence
cttactgttgtagggttttgg

SEQ ID NO: 35777 - DNA, 21 bp, Artificial sequence
  SiRNA target sequence
ttactgttgtagggttttgga

SEQ ID NO: 35778 - DNA, 21 bp, Artificial sequence
  SiRNA target sequence
tactgttgtagggttttggaa

SEQ ID NO: 35779 - DNA, 21 bp, Artificial sequence
  SiRNA target sequence
actgttgtagggttttggaaa

SEQ ID NO: 35780 - DNA, 21 bp, Artificial sequence
  SiRNA target sequence
ctgttgtagggttttggaaat

SEQ ID NO: 35781 - DNA, 21 bp, Artificial sequence
  SiRNA target sequence
tgttgtagggttttggaaatg

SEQ ID NO: 35782 - DNA, 21 bp, Artificial sequence
  SiRNA target sequence
gttgtagggttttggaaatgg

SEQ ID NO: 35783 - DNA, 21 bp, Artificial sequence
  SiRNA target sequence
ttgtagggttttggaaatggt

SEQ ID NO: 35784 - DNA, 21 bp, Artificial sequence
  SiRNA target sequence
tgtagggttttggaaatggtt

SEQ ID NO: 35785 - DNA, 21 bp, Artificial sequence
  SiRNA target sequence
gtagggttttggaaatggtta

SEQ ID NO: 35786 - DNA, 21 bp, Artificial sequence
  SiRNA target sequence
tagggttttggaaatggttat

SEQ ID NO: 35787 - DNA, 21 bp, Artificial sequence
  SiRNA target sequence
agggttttggaaatggttatg

SEQ ID NO: 35788 - DNA, 21 bp, Artificial sequence
  SiRNA target sequence
gggttttggaaatggttatgt

SEQ ID NO: 35789 - DNA, 21 bp, Artificial sequence
  SiRNA target sequence
ggttttggaaatggttatgta

SEQ ID NO: 35790 - DNA, 21 bp, Artificial sequence
  SiRNA target sequence
gttttggaaatggttatgtag

SEQ ID NO: 35791 - DNA, 21 bp, Artificial sequence
  SiRNA target sequence
ttttggaaatggttatgtagt

SEQ ID NO: 35792 - DNA, 21 bp, Artificial sequence
  SiRNA target sequence
tttggaaatggttatgtagtg

SEQ ID NO: 35793 - DNA, 21 bp, Artificial sequence
  SiRNA target sequence
ttggaaatggttatgtagtgg

SEQ ID NO: 35794 - DNA, 21 bp, Artificial sequence
  SiRNA target sequence
tggaaatggttatgtagtggc

SEQ ID NO: 35795 - DNA, 21 bp, Artificial sequence
  SiRNA target sequence
ggaaatggttatgtagtggcg

SEQ ID NO: 35796 - DNA, 21 bp, Artificial sequence
  SiRNA target sequence
gaaatggttatgtagtggcga

SEQ ID NO: 35797 - DNA, 21 bp, Artificial sequence
  SiRNA target sequence
aaatggttatgtagtggcgat

SEQ ID NO: 35798 - DNA, 21 bp, Artificial sequence
  SiRNA target sequence
aatggttatgtagtggcgata

SEQ ID NO: 35799 - DNA, 21 bp, Artificial sequence
  SiRNA target sequence
atggttatgtagtggcgataa

SEQ ID NO: 35800 - DNA, 21 bp, Artificial sequence
  SiRNA target sequence
tggttatgtagtggcgataaa

SEQ ID NO: 35801 - DNA, 21 bp, Artificial sequence
  SiRNA target sequence
ggttatgtagtggcgataaaa

SEQ ID NO: 35802 - DNA, 21 bp, Artificial sequence
  SiRNA target sequence
gttatgtagtggcgataaaaa

SEQ ID NO: 35803 - DNA, 21 bp, Artificial sequence
  SiRNA target sequence
ttatgtagtggcgataaaaag

SEQ ID NO: 35804 - DNA, 21 bp, Artificial sequence
  SiRNA target sequence
tatgtagtggcgataaaaaga

SEQ ID NO: 35805 - DNA, 21 bp, Artificial sequence
  SiRNA target sequence
atgtagtggcgataaaaagaa

SEQ ID NO: 35806 - DNA, 21 bp, Artificial sequence
  SiRNA target sequence
tgtagtggcgataaaaagaag

SEQ ID NO: 35807 - DNA, 21 bp, Artificial sequence
  SiRNA target sequence
gtagtggcgataaaaagaaga

SEQ ID NO: 35808 - DNA, 21 bp, Artificial sequence
  SiRNA target sequence
tagtggcgataaaaagaagaa

SEQ ID NO: 35809 - DNA, 21 bp, Artificial sequence
  SiRNA target sequence
agtggcgataaaaagaagaat

SEQ ID NO: 35810 - DNA, 21 bp, Artificial sequence
  SiRNA target sequence
gtggcgataaaaagaagaatc

SEQ ID NO: 35811 - DNA, 21 bp, Artificial sequence
  SiRNA target sequence
tggcgataaaaagaagaatcc

SEQ ID NO: 35812 - DNA, 21 bp, Artificial sequence
  SiRNA target sequence
ggcgataaaaagaagaatccg

SEQ ID NO: 35813 - DNA, 21 bp, Artificial sequence
  SiRNA target sequence
gcgataaaaagaagaatccga

SEQ ID NO: 35814 - DNA, 21 bp, Artificial sequence
  SiRNA target sequence
cgataaaaagaagaatccgat

SEQ ID NO: 35815 - DNA, 21 bp, Artificial sequence
  SiRNA target sequence
gataaaaagaagaatccgata

SEQ ID NO: 35816 - DNA, 21 bp, Artificial sequence
  SiRNA target sequence
ataaaaagaagaatccgataa

SEQ ID NO: 35817 - DNA, 21 bp, Artificial sequence
  SiRNA target sequence
taaaaagaagaatccgataaa

SEQ ID NO: 35818 - DNA, 21 bp, Artificial sequence
  SiRNA target sequence
aaaaagaagaatccgataaaa

SEQ ID NO: 35819 - DNA, 21 bp, Artificial sequence
  SiRNA target sequence
aaaagaagaatccgataaaaa

SEQ ID NO: 35820 - DNA, 21 bp, Artificial sequence
  SiRNA target sequence
aaagaagaatccgataaaaag

SEQ ID NO: 35821 - DNA, 21 bp, Artificial sequence
  SiRNA target sequence
aagaagaatccgataaaaaga

SEQ ID NO: 35822 - DNA, 21 bp, Artificial sequence
  SiRNA target sequence
agaagaatccgataaaaagac

SEQ ID NO: 35823 - DNA, 21 bp, Artificial sequence
  SiRNA target sequence
gaagaatccgataaaaagaca

SEQ ID NO: 35824 - DNA, 21 bp, Artificial sequence
  SiRNA target sequence
aagaatccgataaaaagacat

SEQ ID NO: 35825 - DNA, 21 bp, Artificial sequence
  SiRNA target sequence
agaatccgataaaaagacatt

SEQ ID NO: 35826 - DNA, 21 bp, Artificial sequence
  SiRNA target sequence
gaatccgataaaaagacattt

SEQ ID NO: 35827 - DNA, 21 bp, Artificial sequence
  SiRNA target sequence
aatccgataaaaagacatttt

SEQ ID NO: 35828 - DNA, 21 bp, Artificial sequence
  SiRNA target sequence
atccgataaaaagacatttta

SEQ ID NO: 35829 - DNA, 21 bp, Artificial sequence
  SiRNA target sequence
tccgataaaaagacattttat

SEQ ID NO: 35830 - DNA, 21 bp, Artificial sequence
  SiRNA target sequence
ccgataaaaagacattttatt

SEQ ID NO: 35831 - DNA, 21 bp, Artificial sequence
  SiRNA target sequence
cgataaaaagacattttatta

SEQ ID NO: 35832 - DNA, 21 bp, Artificial sequence
  SiRNA target sequence
gataaaaagacattttattaa

SEQ ID NO: 35833 - DNA, 21 bp, Artificial sequence
  SiRNA target sequence
ataaaaagacattttattaat

SEQ ID NO: 35834 - DNA, 21 bp, Artificial sequence
  SiRNA target sequence
taaaaagacattttattaata

SEQ ID NO: 35835 - DNA, 21 bp, Artificial sequence
  SiRNA target sequence
aaaaagacattttattaatac

SEQ ID NO: 35836 - DNA, 21 bp, Artificial sequence
  SiRNA target sequence
aaaagacattttattaataca

SEQ ID NO: 35837 - DNA, 21 bp, Artificial sequence
  SiRNA target sequence
aaagacattttattaatacag

SEQ ID NO: 35838 - DNA, 21 bp, Artificial sequence
  SiRNA target sequence
aagacattttattaatacagg

SEQ ID NO: 35839 - DNA, 21 bp, Artificial sequence
  SiRNA target sequence
agacattttattaatacaggc

SEQ ID NO: 35840 - DNA, 21 bp, Artificial sequence
  SiRNA target sequence
gacattttattaatacaggca

SEQ ID NO: 35841 - DNA, 21 bp, Artificial sequence
  SiRNA target sequence
acattttattaatacaggcaa

SEQ ID NO: 35842 - DNA, 21 bp, Artificial sequence
  SiRNA target sequence
cattttattaatacaggcaat

SEQ ID NO: 35843 - DNA, 21 bp, Artificial sequence
  SiRNA target sequence
attttattaatacaggcaatg

SEQ ID NO: 35844 - DNA, 21 bp, Artificial sequence
  SiRNA target sequence
ttttattaatacaggcaatgt

SEQ ID NO: 35845 - DNA, 21 bp, Artificial sequence
  SiRNA target sequence
tttattaatacaggcaatgtt

SEQ ID NO: 35846 - DNA, 21 bp, Artificial sequence
  SiRNA target sequence
ttattaatacaggcaatgttc

SEQ ID NO: 35847 - DNA, 21 bp, Artificial sequence
  SiRNA target sequence
tattaatacaggcaatgttct

SEQ ID NO: 35848 - DNA, 21 bp, Artificial sequence
  SiRNA target sequence
attaatacaggcaatgttcta

SEQ ID NO: 35849 - DNA, 21 bp, Artificial sequence
  SiRNA target sequence
ttaatacaggcaatgttctaa

SEQ ID NO: 35850 - DNA, 21 bp, Artificial sequence
  SiRNA target sequence
taatacaggcaatgttctaat

SEQ ID NO: 35851 - DNA, 21 bp, Artificial sequence
  SiRNA target sequence
aatacaggcaatgttctaatc

SEQ ID NO: 35852 - DNA, 21 bp, Artificial sequence
  SiRNA target sequence
atacaggcaatgttctaatct

SEQ ID NO: 35853 - DNA, 21 bp, Artificial sequence
  SiRNA target sequence
tacaggcaatgttctaatctt

SEQ ID NO: 35854 - DNA, 21 bp, Artificial sequence
  SiRNA target sequence
acaggcaatgttctaatctta

SEQ ID NO: 35855 - DNA, 21 bp, Artificial sequence
  SiRNA target sequence
caggcaatgttctaatcttac

SEQ ID NO: 35856 - DNA, 21 bp, Artificial sequence
  SiRNA target sequence
aggcaatgttctaatcttacc

SEQ ID NO: 35857 - DNA, 21 bp, Artificial sequence
  SiRNA target sequence
ggcaatgttctaatcttaccc

SEQ ID NO: 35858 - DNA, 21 bp, Artificial sequence
  SiRNA target sequence
gcaatgttctaatcttacccg

SEQ ID NO: 35859 - DNA, 21 bp, Artificial sequence
  SiRNA target sequence
caatgttctaatcttacccga

SEQ ID NO: 35860 - DNA, 21 bp, Artificial sequence
  SiRNA target sequence
aatgttctaatcttacccgat

SEQ ID NO: 35861 - DNA, 21 bp, Artificial sequence
  SiRNA target sequence
atgttctaatcttacccgata

SEQ ID NO: 35862 - DNA, 21 bp, Artificial sequence
  SiRNA target sequence
tgttctaatcttacccgatag

SEQ ID NO: 35863 - DNA, 21 bp, Artificial sequence
  SiRNA target sequence
gttctaatcttacccgataga

SEQ ID NO: 35864 - DNA, 21 bp, Artificial sequence
  SiRNA target sequence
ttctaatcttacccgatagag

SEQ ID NO: 35865 - DNA, 21 bp, Artificial sequence
  SiRNA target sequence
tctaatcttacccgatagaga

SEQ ID NO: 35866 - DNA, 21 bp, Artificial sequence
  SiRNA target sequence
ctaatcttacccgatagagaa

SEQ ID NO: 35867 - DNA, 21 bp, Artificial sequence
  SiRNA target sequence
taatcttacccgatagagaat

SEQ ID NO: 35868 - DNA, 21 bp, Artificial sequence
  SiRNA target sequence
aatcttacccgatagagaatt

SEQ ID NO: 35869 - DNA, 21 bp, Artificial sequence
  SiRNA target sequence
atcttacccgatagagaatta

SEQ ID NO: 35870 - DNA, 21 bp, Artificial sequence
  SiRNA target sequence
tcttacccgatagagaattaa

SEQ ID NO: 35871 - DNA, 21 bp, Artificial sequence
  SiRNA target sequence
cttacccgatagagaattaaa

SEQ ID NO: 35872 - DNA, 21 bp, Artificial sequence
  SiRNA target sequence
ttacccgatagagaattaaac

SEQ ID NO: 35873 - DNA, 21 bp, Artificial sequence
  SiRNA target sequence
tacccgatagagaattaaaca

SEQ ID NO: 35874 - DNA, 21 bp, Artificial sequence
  SiRNA target sequence
acccgatagagaattaaacac

SEQ ID NO: 35875 - DNA, 21 bp, Artificial sequence
  SiRNA target sequence
cccgatagagaattaaacacc

SEQ ID NO: 35876 - DNA, 21 bp, Artificial sequence
  SiRNA target sequence
ccgatagagaattaaacacct

SEQ ID NO: 35877 - DNA, 21 bp, Artificial sequence
  SiRNA target sequence
cgatagagaattaaacacctt

SEQ ID NO: 35878 - DNA, 21 bp, Artificial sequence
  SiRNA target sequence
gatagagaattaaacaccttt

SEQ ID NO: 35879 - DNA, 21 bp, Artificial sequence
  SiRNA target sequence
atagagaattaaacacctttt

SEQ ID NO: 35880 - DNA, 21 bp, Artificial sequence
  SiRNA target sequence
tagagaattaaacaccttttg

SEQ ID NO: 35881 - DNA, 21 bp, Artificial sequence
  SiRNA target sequence
agagaattaaacaccttttgg

SEQ ID NO: 35882 - DNA, 21 bp, Artificial sequence
  SiRNA target sequence
gagaattaaacaccttttgga

SEQ ID NO: 35883 - DNA, 21 bp, Artificial sequence
  SiRNA target sequence
agaattaaacaccttttggaa

SEQ ID NO: 35884 - DNA, 21 bp, Artificial sequence
  SiRNA target sequence
gaattaaacaccttttggaaa

SEQ ID NO: 35885 - DNA, 21 bp, Artificial sequence
  SiRNA target sequence
aattaaacaccttttggaaaa

SEQ ID NO: 35886 - DNA, 21 bp, Artificial sequence
  SiRNA target sequence
attaaacaccttttggaaaaa

SEQ ID NO: 35887 - DNA, 21 bp, Artificial sequence
  SiRNA target sequence
ttaaacaccttttggaaaaat

SEQ ID NO: 35888 - DNA, 21 bp, Artificial sequence
  SiRNA target sequence
taaacaccttttggaaaaatc

SEQ ID NO: 35889 - DNA, 21 bp, Artificial sequence
  SiRNA target sequence
aaacaccttttggaaaaatca

SEQ ID NO: 35890 - DNA, 21 bp, Artificial sequence
  SiRNA target sequence
aacaccttttggaaaaatcaa

SEQ ID NO: 35891 - DNA, 21 bp, Artificial sequence
  SiRNA target sequence
acaccttttggaaaaatcaag

SEQ ID NO: 35892 - DNA, 21 bp, Artificial sequence
  SiRNA target sequence
caccttttggaaaaatcaaga

SEQ ID NO: 35893 - DNA, 21 bp, Artificial sequence
  SiRNA target sequence
accttttggaaaaatcaagaa

SEQ ID NO: 35894 - DNA, 21 bp, Artificial sequence
  SiRNA target sequence
ccttttggaaaaatcaagaat

SEQ ID NO: 35895 - DNA, 21 bp, Artificial sequence
  SiRNA target sequence
cttttggaaaaatcaagaatc

SEQ ID NO: 35896 - DNA, 21 bp, Artificial sequence
  SiRNA target sequence
ttttggaaaaatcaagaatca

SEQ ID NO: 35897 - DNA, 21 bp, Artificial sequence
  SiRNA target sequence
tttggaaaaatcaagaatcat

SEQ ID NO: 35898 - DNA, 21 bp, Artificial sequence
  SiRNA target sequence
ttggaaaaatcaagaatcatt

SEQ ID NO: 35899 - DNA, 21 bp, Artificial sequence
  SiRNA target sequence
tggaaaaatcaagaatcattg

SEQ ID NO: 35900 - DNA, 21 bp, Artificial sequence
  SiRNA target sequence
ggaaaaatcaagaatcattgg

SEQ ID NO: 35901 - DNA, 21 bp, Artificial sequence
  SiRNA target sequence
gaaaaatcaagaatcattgga

SEQ ID NO: 35902 - DNA, 21 bp, Artificial sequence
  SiRNA target sequence
aaaaatcaagaatcattggac

SEQ ID NO: 35903 - DNA, 21 bp, Artificial sequence
  SiRNA target sequence
aaaatcaagaatcattggact

SEQ ID NO: 35904 - DNA, 21 bp, Artificial sequence
  SiRNA target sequence
aaatcaagaatcattggactt

SEQ ID NO: 35905 - DNA, 21 bp, Artificial sequence
  SiRNA target sequence
aatcaagaatcattggactta

SEQ ID NO: 35906 - DNA, 21 bp, Artificial sequence
  SiRNA target sequence
atcaagaatcattggacttaa

SEQ ID NO: 35907 - DNA, 21 bp, Artificial sequence
  SiRNA target sequence
tcaagaatcattggacttaag

SEQ ID NO: 35908 - DNA, 21 bp, Artificial sequence
  SiRNA target sequence
caagaatcattggacttaagg

SEQ ID NO: 35909 - DNA, 21 bp, Artificial sequence
  SiRNA target sequence
aagaatcattggacttaaggg

SEQ ID NO: 35910 - DNA, 21 bp, Artificial sequence
  SiRNA target sequence
agaatcattggacttaaggga

SEQ ID NO: 35911 - DNA, 21 bp, Artificial sequence
  SiRNA target sequence
gaatcattggacttaagggat

SEQ ID NO: 35912 - DNA, 21 bp, Artificial sequence
  SiRNA target sequence
aatcattggacttaagggata

SEQ ID NO: 35913 - DNA, 21 bp, Artificial sequence
  SiRNA target sequence
atcattggacttaagggatat

SEQ ID NO: 35914 - DNA, 21 bp, Artificial sequence
  SiRNA target sequence
tcattggacttaagggatatg

SEQ ID NO: 35915 - DNA, 21 bp, Artificial sequence
  SiRNA target sequence
cattggacttaagggatatgt

SEQ ID NO: 35916 - DNA, 21 bp, Artificial sequence
  SiRNA target sequence
attggacttaagggatatgta

SEQ ID NO: 35917 - DNA, 21 bp, Artificial sequence
  SiRNA target sequence
ttggacttaagggatatgtat

SEQ ID NO: 35918 - DNA, 21 bp, Artificial sequence
  SiRNA target sequence
tggacttaagggatatgtata

SEQ ID NO: 35919 - DNA, 21 bp, Artificial sequence
  SiRNA target sequence
ggacttaagggatatgtatat

SEQ ID NO: 35920 - DNA, 21 bp, Artificial sequence
  SiRNA target sequence
gacttaagggatatgtatatt

SEQ ID NO: 35921 - DNA, 21 bp, Artificial sequence
  SiRNA target sequence
acttaagggatatgtatatta

SEQ ID NO: 35922 - DNA, 21 bp, Artificial sequence
  SiRNA target sequence
cttaagggatatgtatattaa

SEQ ID NO: 35923 - DNA, 21 bp, Artificial sequence
  SiRNA target sequence
ttaagggatatgtatattaat

SEQ ID NO: 35924 - DNA, 21 bp, Artificial sequence
  SiRNA target sequence
taagggatatgtatattaatc

SEQ ID NO: 35925 - DNA, 21 bp, Artificial sequence
  SiRNA target sequence
aagggatatgtatattaatcg

SEQ ID NO: 35926 - DNA, 21 bp, Artificial sequence
  SiRNA target sequence
agggatatgtatattaatcga

SEQ ID NO: 35927 - DNA, 21 bp, Artificial sequence
  SiRNA target sequence
gggatatgtatattaatcgag

SEQ ID NO: 35928 - DNA, 21 bp, Artificial sequence
  SiRNA target sequence
ggatatgtatattaatcgagt

SEQ ID NO: 35929 - DNA, 21 bp, Artificial sequence
  SiRNA target sequence
gatatgtatattaatcgagtt

SEQ ID NO: 35930 - DNA, 21 bp, Artificial sequence
  SiRNA target sequence
atatgtatattaatcgagttg

SEQ ID NO: 35931 - DNA, 21 bp, Artificial sequence
  SiRNA target sequence
tatgtatattaatcgagttga

SEQ ID NO: 35932 - DNA, 21 bp, Artificial sequence
  SiRNA target sequence
atgtatattaatcgagttgaa

SEQ ID NO: 35933 - DNA, 21 bp, Artificial sequence
  SiRNA target sequence
tgtatattaatcgagttgaag

SEQ ID NO: 35934 - DNA, 21 bp, Artificial sequence
  SiRNA target sequence
gtatattaatcgagttgaaga

SEQ ID NO: 35935 - DNA, 21 bp, Artificial sequence
  SiRNA target sequence
tatattaatcgagttgaagaa

SEQ ID NO: 35936 - DNA, 21 bp, Artificial sequence
  SiRNA target sequence
atattaatcgagttgaagaac

SEQ ID NO: 35937 - DNA, 21 bp, Artificial sequence
  SiRNA target sequence
tattaatcgagttgaagaaca

SEQ ID NO: 35938 - DNA, 21 bp, Artificial sequence
  SiRNA target sequence
attaatcgagttgaagaacac

SEQ ID NO: 35939 - DNA, 21 bp, Artificial sequence
  SiRNA target sequence
ttaatcgagttgaagaacaca

SEQ ID NO: 35940 - DNA, 21 bp, Artificial sequence
  SiRNA target sequence
taatcgagttgaagaacacat

SEQ ID NO: 35941 - DNA, 21 bp, Artificial sequence
  SiRNA target sequence
aatcgagttgaagaacacata

SEQ ID NO: 35942 - DNA, 21 bp, Artificial sequence
  SiRNA target sequence
atcgagttgaagaacacataa

SEQ ID NO: 35943 - DNA, 21 bp, Artificial sequence
  SiRNA target sequence
tcgagttgaagaacacataat

SEQ ID NO: 35944 - DNA, 21 bp, Artificial sequence
  SiRNA target sequence
cgagttgaagaacacataatt

SEQ ID NO: 35945 - DNA, 21 bp, Artificial sequence
  SiRNA target sequence
gagttgaagaacacataatta

SEQ ID NO: 35946 - DNA, 21 bp, Artificial sequence
  SiRNA target sequence
agttgaagaacacataattag

SEQ ID NO: 35947 - DNA, 21 bp, Artificial sequence
  SiRNA target sequence
gttgaagaacacataattagc

SEQ ID NO: 35948 - DNA, 21 bp, Artificial sequence
  SiRNA target sequence
ttgaagaacacataattagcc

SEQ ID NO: 35949 - DNA, 21 bp, Artificial sequence
  SiRNA target sequence
tgaagaacacataattagcct

SEQ ID NO: 35950 - DNA, 21 bp, Artificial sequence
  SiRNA target sequence
gaagaacacataattagccta

SEQ ID NO: 35951 - DNA, 21 bp, Artificial sequence
  SiRNA target sequence
aagaacacataattagcctat

SEQ ID NO: 35952 - DNA, 21 bp, Artificial sequence
  SiRNA target sequence
agaacacataattagcctatt

SEQ ID NO: 35953 - DNA, 21 bp, Artificial sequence
  SiRNA target sequence
gaacacataattagcctattg

SEQ ID NO: 35954 - DNA, 21 bp, Artificial sequence
  SiRNA target sequence
aacacataattagcctattga

SEQ ID NO: 35955 - DNA, 21 bp, Artificial sequence
  SiRNA target sequence
acacataattagcctattgaa

SEQ ID NO: 35956 - DNA, 21 bp, Artificial sequence
  SiRNA target sequence
cacataattagcctattgaaa

SEQ ID NO: 35957 - DNA, 21 bp, Artificial sequence
  SiRNA target sequence
acataattagcctattgaaat

SEQ ID NO: 35958 - DNA, 21 bp, Artificial sequence
  SiRNA target sequence
cataattagcctattgaaatt

SEQ ID NO: 35959 - DNA, 21 bp, Artificial sequence
  SiRNA target sequence
ataattagcctattgaaattg

SEQ ID NO: 35960 - DNA, 21 bp, Artificial sequence
  SiRNA target sequence
taattagcctattgaaattgc

SEQ ID NO: 35961 - DNA, 21 bp, Artificial sequence
  SiRNA target sequence
aattagcctattgaaattgca

SEQ ID NO: 35962 - DNA, 21 bp, Artificial sequence
  SiRNA target sequence
attagcctattgaaattgcaa

SEQ ID NO: 35963 - DNA, 21 bp, Artificial sequence
  SiRNA target sequence
ttagcctattgaaattgcaac

SEQ ID NO: 35964 - DNA, 21 bp, Artificial sequence
  SiRNA target sequence
tagcctattgaaattgcaaca

SEQ ID NO: 35965 - DNA, 21 bp, Artificial sequence
  SiRNA target sequence
agcctattgaaattgcaacat

SEQ ID NO: 35966 - DNA, 21 bp, Artificial sequence
  SiRNA target sequence
gcctattgaaattgcaacata

SEQ ID NO: 35967 - DNA, 21 bp, Artificial sequence
  SiRNA target sequence
cctattgaaattgcaacataa

SEQ ID NO: 35968 - DNA, 21 bp, Artificial sequence
  SiRNA target sequence
ctattgaaattgcaacataaa

SEQ ID NO: 35969 - DNA, 21 bp, Artificial sequence
  SiRNA target sequence
tattgaaattgcaacataaag

SEQ ID NO: 35970 - DNA, 21 bp, Artificial sequence
  SiRNA target sequence
attgaaattgcaacataaagt

SEQ ID NO: 35971 - DNA, 21 bp, Artificial sequence
  SiRNA target sequence
ttgaaattgcaacataaagta

SEQ ID NO: 35972 - DNA, 21 bp, Artificial sequence
  SiRNA target sequence
tgaaattgcaacataaagtag

SEQ ID NO: 35973 - DNA, 21 bp, Artificial sequence
  SiRNA target sequence
gaaattgcaacataaagtagt

SEQ ID NO: 35974 - DNA, 21 bp, Artificial sequence
  SiRNA target sequence
aaattgcaacataaagtagtc

SEQ ID NO: 35975 - DNA, 21 bp, Artificial sequence
  SiRNA target sequence
aattgcaacataaagtagtct

SEQ ID NO: 35976 - DNA, 21 bp, Artificial sequence
  SiRNA target sequence
attgcaacataaagtagtctt

SEQ ID NO: 35977 - DNA, 21 bp, Artificial sequence
  SiRNA target sequence
ttgcaacataaagtagtctta

SEQ ID NO: 35978 - DNA, 21 bp, Artificial sequence
  SiRNA target sequence
tgcaacataaagtagtcttag

SEQ ID NO: 35979 - DNA, 21 bp, Artificial sequence
  SiRNA target sequence
gcaacataaagtagtcttagt

SEQ ID NO: 35980 - DNA, 21 bp, Artificial sequence
  SiRNA target sequence
caacataaagtagtcttagtt

SEQ ID NO: 35981 - DNA, 21 bp, Artificial sequence
  SiRNA target sequence
aacataaagtagtcttagttc

SEQ ID NO: 35982 - DNA, 21 bp, Artificial sequence
  SiRNA target sequence
acataaagtagtcttagttcc

SEQ ID NO: 35983 - DNA, 21 bp, Artificial sequence
  SiRNA target sequence
cataaagtagtcttagttcca

SEQ ID NO: 35984 - DNA, 21 bp, Artificial sequence
  SiRNA target sequence
ataaagtagtcttagttccaa

SEQ ID NO: 35985 - DNA, 21 bp, Artificial sequence
  SiRNA target sequence
taaagtagtcttagttccaaa

SEQ ID NO: 35986 - DNA, 21 bp, Artificial sequence
  SiRNA target sequence
aaagtagtcttagttccaaaa

SEQ ID NO: 35987 - DNA, 21 bp, Artificial sequence
  SiRNA target sequence
aagtagtcttagttccaaaag

SEQ ID NO: 35988 - DNA, 21 bp, Artificial sequence
  SiRNA target sequence
agtagtcttagttccaaaagt

SEQ ID NO: 35989 - DNA, 21 bp, Artificial sequence
  SiRNA target sequence
gtagtcttagttccaaaagtt

SEQ ID NO: 35990 - DNA, 21 bp, Artificial sequence
  SiRNA target sequence
tagtcttagttccaaaagtta

SEQ ID NO: 35991 - DNA, 21 bp, Artificial sequence
  SiRNA target sequence
agtcttagttccaaaagttac

SEQ ID NO: 35992 - DNA, 21 bp, Artificial sequence
  SiRNA target sequence
gtcttagttccaaaagttact

SEQ ID NO: 35993 - DNA, 21 bp, Artificial sequence
  SiRNA target sequence
tcttagttccaaaagttacta

SEQ ID NO: 35994 - DNA, 21 bp, Artificial sequence
  SiRNA target sequence
cttagttccaaaagttactaa

SEQ ID NO: 35995 - DNA, 21 bp, Artificial sequence
  SiRNA target sequence
ttagttccaaaagttactaag

SEQ ID NO: 35996 - DNA, 21 bp, Artificial sequence
  SiRNA target sequence
tagttccaaaagttactaagt

SEQ ID NO: 35997 - DNA, 21 bp, Artificial sequence
  SiRNA target sequence
agttccaaaagttactaagta

SEQ ID NO: 35998 - DNA, 21 bp, Artificial sequence
  SiRNA target sequence
gttccaaaagttactaagtat

SEQ ID NO: 35999 - DNA, 21 bp, Artificial sequence
  SiRNA target sequence
ttccaaaagttactaagtata

SEQ ID NO: 36000 - DNA, 21 bp, Artificial sequence
  SiRNA target sequence
tccaaaagttactaagtatat

SEQ ID NO: 36001 - DNA, 21 bp, Artificial sequence
  SiRNA target sequence
ccaaaagttactaagtatatt

SEQ ID NO: 36002 - DNA, 21 bp, Artificial sequence
  SiRNA target sequence
caaaagttactaagtatattc

SEQ ID NO: 36003 - DNA, 21 bp, Artificial sequence
  SiRNA target sequence
aaaagttactaagtatattct

SEQ ID NO: 36004 - DNA, 21 bp, Artificial sequence
  SiRNA target sequence
aaagttactaagtatattctt

SEQ ID NO: 36005 - DNA, 21 bp, Artificial sequence
  SiRNA target sequence
aagttactaagtatattctta

SEQ ID NO: 36006 - DNA, 21 bp, Artificial sequence
  SiRNA target sequence
agttactaagtatattcttac

SEQ ID NO: 36007 - DNA, 21 bp, Artificial sequence
  SiRNA target sequence
gttactaagtatattcttaca

SEQ ID NO: 36008 - DNA, 21 bp, Artificial sequence
  SiRNA target sequence
ttactaagtatattcttacaa

SEQ ID NO: 36009 - DNA, 21 bp, Artificial sequence
  SiRNA target sequence
tactaagtatattcttacaac

SEQ ID NO: 36010 - DNA, 21 bp, Artificial sequence
  SiRNA target sequence
actaagtatattcttacaact

SEQ ID NO: 36011 - DNA, 21 bp, Artificial sequence
  SiRNA target sequence
ctaagtatattcttacaactg

SEQ ID NO: 36012 - DNA, 21 bp, Artificial sequence
  SiRNA target sequence
taagtatattcttacaactgt

SEQ ID NO: 36013 - DNA, 21 bp, Artificial sequence
  SiRNA target sequence
aagtatattcttacaactgtt

SEQ ID NO: 36014 - DNA, 21 bp, Artificial sequence
  SiRNA target sequence
agtatattcttacaactgttg

SEQ ID NO: 36015 - DNA, 21 bp, Artificial sequence
  SiRNA target sequence
gtatattcttacaactgttga

SEQ ID NO: 36016 - DNA, 21 bp, Artificial sequence
  SiRNA target sequence
tatattcttacaactgttgag

SEQ ID NO: 36017 - DNA, 21 bp, Artificial sequence
  SiRNA target sequence
atattcttacaactgttgaga

SEQ ID NO: 36018 - DNA, 21 bp, Artificial sequence
  SiRNA target sequence
tattcttacaactgttgagaa

SEQ ID NO: 36019 - DNA, 21 bp, Artificial sequence
  SiRNA target sequence
attcttacaactgttgagaac

SEQ ID NO: 36020 - DNA, 21 bp, Artificial sequence
  SiRNA target sequence
ttcttacaactgttgagaacc

SEQ ID NO: 36021 - DNA, 21 bp, Artificial sequence
  SiRNA target sequence
tcttacaactgttgagaacca

SEQ ID NO: 36022 - DNA, 21 bp, Artificial sequence
  SiRNA target sequence
cttacaactgttgagaaccat

SEQ ID NO: 36023 - DNA, 21 bp, Artificial sequence
  SiRNA target sequence
ttacaactgttgagaaccatg

SEQ ID NO: 36024 - DNA, 21 bp, Artificial sequence
  SiRNA target sequence
tacaactgttgagaaccatgc

SEQ ID NO: 36025 - DNA, 21 bp, Artificial sequence
  SiRNA target sequence
acaactgttgagaaccatgct

SEQ ID NO: 36026 - DNA, 21 bp, Artificial sequence
  SiRNA target sequence
caactgttgagaaccatgcta

SEQ ID NO: 36027 - DNA, 21 bp, Artificial sequence
  SiRNA target sequence
aactgttgagaaccatgctaa

SEQ ID NO: 36028 - DNA, 21 bp, Artificial sequence
  SiRNA target sequence
actgttgagaaccatgctaaa

SEQ ID NO: 36029 - DNA, 21 bp, Artificial sequence
  SiRNA target sequence
ctgttgagaaccatgctaaaa

SEQ ID NO: 36030 - DNA, 21 bp, Artificial sequence
  SiRNA target sequence
tgttgagaaccatgctaaaat

SEQ ID NO: 36031 - DNA, 21 bp, Artificial sequence
  SiRNA target sequence
gttgagaaccatgctaaaata

SEQ ID NO: 36032 - DNA, 21 bp, Artificial sequence
  SiRNA target sequence
ttgagaaccatgctaaaatat

SEQ ID NO: 36033 - DNA, 21 bp, Artificial sequence
  SiRNA target sequence
tgagaaccatgctaaaatatc

SEQ ID NO: 36034 - DNA, 21 bp, Artificial sequence
  SiRNA target sequence
gagaaccatgctaaaatatca

SEQ ID NO: 36035 - DNA, 21 bp, Artificial sequence
  SiRNA target sequence
agaaccatgctaaaatatcag

SEQ ID NO: 36036 - DNA, 21 bp, Artificial sequence
  SiRNA target sequence
gaaccatgctaaaatatcaga

SEQ ID NO: 36037 - DNA, 21 bp, Artificial sequence
  SiRNA target sequence
aaccatgctaaaatatcagat

SEQ ID NO: 36038 - DNA, 21 bp, Artificial sequence
  SiRNA target sequence
accatgctaaaatatcagata

SEQ ID NO: 36039 - DNA, 21 bp, Artificial sequence
  SiRNA target sequence
ccatgctaaaatatcagataa

SEQ ID NO: 36040 - DNA, 21 bp, Artificial sequence
  SiRNA target sequence
catgctaaaatatcagataaa

SEQ ID NO: 36041 - DNA, 21 bp, Artificial sequence
  SiRNA target sequence
atgctaaaatatcagataaaa

SEQ ID NO: 36042 - DNA, 21 bp, Artificial sequence
  SiRNA target sequence
tgctaaaatatcagataaaat

SEQ ID NO: 36043 - DNA, 21 bp, Artificial sequence
  SiRNA target sequence
gctaaaatatcagataaaatc

SEQ ID NO: 36044 - DNA, 21 bp, Artificial sequence
  SiRNA target sequence
ctaaaatatcagataaaatca

SEQ ID NO: 36045 - DNA, 21 bp, Artificial sequence
  SiRNA target sequence
taaaatatcagataaaatcat

SEQ ID NO: 36046 - DNA, 21 bp, Artificial sequence
  SiRNA target sequence
aaaatatcagataaaatcatt

SEQ ID NO: 36047 - DNA, 21 bp, Artificial sequence
  SiRNA target sequence
aaatatcagataaaatcattt

SEQ ID NO: 36048 - DNA, 21 bp, Artificial sequence
  SiRNA target sequence
aatatcagataaaatcatttt

SEQ ID NO: 36049 - DNA, 21 bp, Artificial sequence
  SiRNA target sequence
atatcagataaaatcattttg

SEQ ID NO: 36050 - DNA, 21 bp, Artificial sequence
  SiRNA target sequence
tatcagataaaatcattttga

SEQ ID NO: 36051 - DNA, 21 bp, Artificial sequence
  SiRNA target sequence
atcagataaaatcattttgat

SEQ ID NO: 36052 - DNA, 21 bp, Artificial sequence
  SiRNA target sequence
tcagataaaatcattttgatt

SEQ ID NO: 36053 - DNA, 21 bp, Artificial sequence
  SiRNA target sequence
cagataaaatcattttgatta

SEQ ID NO: 36054 - DNA, 21 bp, Artificial sequence
  SiRNA target sequence
agataaaatcattttgattac

SEQ ID NO: 36055 - DNA, 21 bp, Artificial sequence
  SiRNA target sequence
gataaaatcattttgattaca

SEQ ID NO: 36056 - DNA, 21 bp, Artificial sequence
  SiRNA target sequence
ataaaatcattttgattacaa

SEQ ID NO: 36057 - DNA, 21 bp, Artificial sequence
  SiRNA target sequence
taaaatcattttgattacaag

SEQ ID NO: 36058 - DNA, 21 bp, Artificial sequence
  SiRNA target sequence
aaaatcattttgattacaaga

SEQ ID NO: 36059 - DNA, 21 bp, Artificial sequence
  SiRNA target sequence
aaatcattttgattacaagaa

SEQ ID NO: 36060 - DNA, 21 bp, Artificial sequence
  SiRNA target sequence
aatcattttgattacaagaaa

SEQ ID NO: 36061 - DNA, 21 bp, Artificial sequence
  SiRNA target sequence
atcattttgattacaagaaat

SEQ ID NO: 36062 - DNA, 21 bp, Artificial sequence
  SiRNA target sequence
tcattttgattacaagaaata

SEQ ID NO: 36063 - DNA, 21 bp, Artificial sequence
  SiRNA target sequence
cattttgattacaagaaatag

SEQ ID NO: 36064 - DNA, 21 bp, Artificial sequence
  SiRNA target sequence
attttgattacaagaaataga

SEQ ID NO: 36065 - DNA, 21 bp, Artificial sequence
  SiRNA target sequence
ttttgattacaagaaatagat

SEQ ID NO: 36066 - DNA, 21 bp, Artificial sequence
  SiRNA target sequence
tttgattacaagaaatagata

SEQ ID NO: 36067 - DNA, 21 bp, Artificial sequence
  SiRNA target sequence
ttgattacaagaaatagatat

SEQ ID NO: 36068 - DNA, 21 bp, Artificial sequence
  SiRNA target sequence
tgattacaagaaatagatatt

SEQ ID NO: 36069 - DNA, 21 bp, Artificial sequence
  SiRNA target sequence
gattacaagaaatagatattt

SEQ ID NO: 36070 - DNA, 21 bp, Artificial sequence
  SiRNA target sequence
attacaagaaatagatatttg

SEQ ID NO: 36071 - DNA, 21 bp, Artificial sequence
  SiRNA target sequence
ttacaagaaatagatatttga

SEQ ID NO: 36072 - DNA, 21 bp, Artificial sequence
  SiRNA target sequence
tacaagaaatagatatttgaa

SEQ ID NO: 36073 - DNA, 21 bp, Artificial sequence
  SiRNA target sequence
acaagaaatagatatttgaat

SEQ ID NO: 36074 - DNA, 21 bp, Artificial sequence
  SiRNA target sequence
caagaaatagatatttgaatt

SEQ ID NO: 36075 - DNA, 21 bp, Artificial sequence
  SiRNA target sequence
aagaaatagatatttgaatta

SEQ ID NO: 36076 - DNA, 21 bp, Artificial sequence
  SiRNA target sequence
agaaatagatatttgaattac

SEQ ID NO: 36077 - DNA, 21 bp, Artificial sequence
  SiRNA target sequence
gaaatagatatttgaattacc

SEQ ID NO: 36078 - DNA, 21 bp, Artificial sequence
  SiRNA target sequence
aaatagatatttgaattacca

SEQ ID NO: 36079 - DNA, 21 bp, Artificial sequence
  SiRNA target sequence
aatagatatttgaattaccag

SEQ ID NO: 36080 - DNA, 21 bp, Artificial sequence
  SiRNA target sequence
atagatatttgaattaccagg

SEQ ID NO: 36081 - DNA, 21 bp, Artificial sequence
  SiRNA target sequence
tagatatttgaattaccaggg

SEQ ID NO: 36082 - DNA, 21 bp, Artificial sequence
  SiRNA target sequence
agatatttgaattaccagggc

SEQ ID NO: 36083 - DNA, 21 bp, Artificial sequence
  SiRNA target sequence
gatatttgaattaccagggca

SEQ ID NO: 36084 - DNA, 21 bp, Artificial sequence
  SiRNA target sequence
atatttgaattaccagggcaa

SEQ ID NO: 36085 - DNA, 21 bp, Artificial sequence
  SiRNA target sequence
tatttgaattaccagggcaag

SEQ ID NO: 36086 - DNA, 21 bp, Artificial sequence
  SiRNA target sequence
atttgaattaccagggcaagt

SEQ ID NO: 36087 - DNA, 21 bp, Artificial sequence
  SiRNA target sequence
tttgaattaccagggcaagtt

SEQ ID NO: 36088 - DNA, 21 bp, Artificial sequence
  SiRNA target sequence
ttgaattaccagggcaagttt

SEQ ID NO: 36089 - DNA, 21 bp, Artificial sequence
  SiRNA target sequence
tgaattaccagggcaagtttg

SEQ ID NO: 36090 - DNA, 21 bp, Artificial sequence
  SiRNA target sequence
gaattaccagggcaagtttgt

SEQ ID NO: 36091 - DNA, 21 bp, Artificial sequence
  SiRNA target sequence
aattaccagggcaagtttgtt

SEQ ID NO: 36092 - DNA, 21 bp, Artificial sequence
  SiRNA target sequence
attaccagggcaagtttgttg

SEQ ID NO: 36093 - DNA, 21 bp, Artificial sequence
  SiRNA target sequence
ttaccagggcaagtttgttga

SEQ ID NO: 36094 - DNA, 21 bp, Artificial sequence
  SiRNA target sequence
taccagggcaagtttgttgaa

SEQ ID NO: 36095 - DNA, 21 bp, Artificial sequence
  SiRNA target sequence
accagggcaagtttgttgaat

SEQ ID NO: 36096 - DNA, 21 bp, Artificial sequence
  SiRNA target sequence
ccagggcaagtttgttgaatt

SEQ ID NO: 36097 - DNA, 21 bp, Artificial sequence
  SiRNA target sequence
cagggcaagtttgttgaattg

SEQ ID NO: 36098 - DNA, 21 bp, Artificial sequence
  SiRNA target sequence
agggcaagtttgttgaattga

SEQ ID NO: 36099 - DNA, 21 bp, Artificial sequence
  SiRNA target sequence
gggcaagtttgttgaattgat

SEQ ID NO: 36100 - DNA, 21 bp, Artificial sequence
  SiRNA target sequence
ggcaagtttgttgaattgatt

SEQ ID NO: 36101 - DNA, 21 bp, Artificial sequence
  SiRNA target sequence
gcaagtttgttgaattgattt

SEQ ID NO: 36102 - DNA, 21 bp, Artificial sequence
  SiRNA target sequence
caagtttgttgaattgatttg

SEQ ID NO: 36103 - DNA, 21 bp, Artificial sequence
  SiRNA target sequence
aagtttgttgaattgatttgt

SEQ ID NO: 36104 - DNA, 21 bp, Artificial sequence
  SiRNA target sequence
agtttgttgaattgatttgtg

SEQ ID NO: 36105 - DNA, 21 bp, Artificial sequence
  SiRNA target sequence
gtttgttgaattgatttgtgg

SEQ ID NO: 36106 - DNA, 21 bp, Artificial sequence
  SiRNA target sequence
tttgttgaattgatttgtgga

SEQ ID NO: 36107 - DNA, 21 bp, Artificial sequence
  SiRNA target sequence
ttgttgaattgatttgtggag

SEQ ID NO: 36108 - DNA, 21 bp, Artificial sequence
  SiRNA target sequence
tgttgaattgatttgtggaga

SEQ ID NO: 36109 - DNA, 21 bp, Artificial sequence
  SiRNA target sequence
gttgaattgatttgtggagaa

SEQ ID NO: 36110 - DNA, 21 bp, Artificial sequence
  SiRNA target sequence
ttgaattgatttgtggagaaa

SEQ ID NO: 36111 - DNA, 21 bp, Artificial sequence
  SiRNA target sequence
tgaattgatttgtggagaaat

SEQ ID NO: 36112 - DNA, 21 bp, Artificial sequence
  SiRNA target sequence
gaattgatttgtggagaaatt

SEQ ID NO: 36113 - DNA, 21 bp, Artificial sequence
  SiRNA target sequence
aattgatttgtggagaaatta

SEQ ID NO: 36114 - DNA, 21 bp, Artificial sequence
  SiRNA target sequence
attgatttgtggagaaattaa

SEQ ID NO: 36115 - DNA, 21 bp, Artificial sequence
  SiRNA target sequence
ttgatttgtggagaaattaat

SEQ ID NO: 36116 - DNA, 21 bp, Artificial sequence
  SiRNA target sequence
tgatttgtggagaaattaatc

SEQ ID NO: 36117 - DNA, 21 bp, Artificial sequence
  SiRNA target sequence
gatttgtggagaaattaatca

SEQ ID NO: 36118 - DNA, 21 bp, Artificial sequence
  SiRNA target sequence
atttgtggagaaattaatcaa

SEQ ID NO: 36119 - DNA, 21 bp, Artificial sequence
  SiRNA target sequence
tttgtggagaaattaatcaat

SEQ ID NO: 36120 - DNA, 21 bp, Artificial sequence
  SiRNA target sequence
ttgtggagaaattaatcaatt

SEQ ID NO: 36121 - DNA, 21 bp, Artificial sequence
  SiRNA target sequence
tgtggagaaattaatcaattc

SEQ ID NO: 36122 - DNA, 21 bp, Artificial sequence
  SiRNA target sequence
gtggagaaattaatcaattct

SEQ ID NO: 36123 - DNA, 21 bp, Artificial sequence
  SiRNA target sequence
tggagaaattaatcaattctt

SEQ ID NO: 36124 - DNA, 21 bp, Artificial sequence
  SiRNA target sequence
ggagaaattaatcaattcttc

SEQ ID NO: 36125 - DNA, 21 bp, Artificial sequence
  SiRNA target sequence
gagaaattaatcaattcttca

SEQ ID NO: 36126 - DNA, 21 bp, Artificial sequence
  SiRNA target sequence
agaaattaatcaattcttcat

SEQ ID NO: 36127 - DNA, 21 bp, Artificial sequence
  SiRNA target sequence
gaaattaatcaattcttcatt

SEQ ID NO: 36128 - DNA, 21 bp, Artificial sequence
  SiRNA target sequence
aaattaatcaattcttcattg

SEQ ID NO: 36129 - DNA, 21 bp, Artificial sequence
  SiRNA target sequence
aattaatcaattcttcattga

SEQ ID NO: 36130 - DNA, 21 bp, Artificial sequence
  SiRNA target sequence
attaatcaattcttcattgac

SEQ ID NO: 36131 - DNA, 21 bp, Artificial sequence
  SiRNA target sequence
ttaatcaattcttcattgacc

SEQ ID NO: 36132 - DNA, 21 bp, Artificial sequence
  SiRNA target sequence
taatcaattcttcattgaccc

SEQ ID NO: 36133 - DNA, 21 bp, Artificial sequence
  SiRNA target sequence
aatcaattcttcattgacccg

SEQ ID NO: 36134 - DNA, 21 bp, Artificial sequence
  SiRNA target sequence
atcaattcttcattgacccgg

SEQ ID NO: 36135 - DNA, 21 bp, Artificial sequence
  SiRNA target sequence
tcaattcttcattgacccgga

SEQ ID NO: 36136 - DNA, 21 bp, Artificial sequence
  SiRNA target sequence
caattcttcattgacccggaa

SEQ ID NO: 36137 - DNA, 21 bp, Artificial sequence
  SiRNA target sequence
aattcttcattgacccggaaa

SEQ ID NO: 36138 - DNA, 21 bp, Artificial sequence
  SiRNA target sequence
attcttcattgacccggaaac

SEQ ID NO: 36139 - DNA, 21 bp, Artificial sequence
  SiRNA target sequence
ttcttcattgacccggaaaca

SEQ ID NO: 36140 - DNA, 21 bp, Artificial sequence
  SiRNA target sequence
tcttcattgacccggaaacat

SEQ ID NO: 36141 - DNA, 21 bp, Artificial sequence
  SiRNA target sequence
cttcattgacccggaaacatt

SEQ ID NO: 36142 - DNA, 21 bp, Artificial sequence
  SiRNA target sequence
ttcattgacccggaaacatta

SEQ ID NO: 36143 - DNA, 21 bp, Artificial sequence
  SiRNA target sequence
tcattgacccggaaacattag

SEQ ID NO: 36144 - DNA, 21 bp, Artificial sequence
  SiRNA target sequence
cattgacccggaaacattaga

SEQ ID NO: 36145 - DNA, 21 bp, Artificial sequence
  SiRNA target sequence
attgacccggaaacattagat

SEQ ID NO: 36146 - DNA, 21 bp, Artificial sequence
  SiRNA target sequence
ttgacccggaaacattagata

SEQ ID NO: 36147 - DNA, 21 bp, Artificial sequence
  SiRNA target sequence
tgacccggaaacattagatac

SEQ ID NO: 36148 - DNA, 21 bp, Artificial sequence
  SiRNA target sequence
gacccggaaacattagatacc

SEQ ID NO: 36149 - DNA, 21 bp, Artificial sequence
  SiRNA target sequence
acccggaaacattagatacca

SEQ ID NO: 36150 - DNA, 21 bp, Artificial sequence
  SiRNA target sequence
cccggaaacattagataccaa

SEQ ID NO: 36151 - DNA, 21 bp, Artificial sequence
  SiRNA target sequence
ccggaaacattagataccaac

SEQ ID NO: 36152 - DNA, 21 bp, Artificial sequence
  SiRNA target sequence
cggaaacattagataccaacg

SEQ ID NO: 36153 - DNA, 21 bp, Artificial sequence
  SiRNA target sequence
ggaaacattagataccaacgt

SEQ ID NO: 36154 - DNA, 21 bp, Artificial sequence
  SiRNA target sequence
gaaacattagataccaacgtg

SEQ ID NO: 36155 - DNA, 21 bp, Artificial sequence
  SiRNA target sequence
aaacattagataccaacgtgg

SEQ ID NO: 36156 - DNA, 21 bp, Artificial sequence
  SiRNA target sequence
aacattagataccaacgtgga

SEQ ID NO: 36157 - DNA, 21 bp, Artificial sequence
  SiRNA target sequence
acattagataccaacgtggaa

SEQ ID NO: 36158 - DNA, 21 bp, Artificial sequence
  SiRNA target sequence
cattagataccaacgtggaag

SEQ ID NO: 36159 - DNA, 21 bp, Artificial sequence
  SiRNA target sequence
attagataccaacgtggaagc

SEQ ID NO: 36160 - DNA, 21 bp, Artificial sequence
  SiRNA target sequence
ttagataccaacgtggaagct

SEQ ID NO: 36161 - DNA, 21 bp, Artificial sequence
  SiRNA target sequence
tagataccaacgtggaagctt

SEQ ID NO: 36162 - DNA, 21 bp, Artificial sequence
  SiRNA target sequence
agataccaacgtggaagcttt

SEQ ID NO: 36163 - DNA, 21 bp, Artificial sequence
  SiRNA target sequence
gataccaacgtggaagctttt

SEQ ID NO: 36164 - DNA, 21 bp, Artificial sequence
  SiRNA target sequence
ataccaacgtggaagcttttg

SEQ ID NO: 36165 - DNA, 21 bp, Artificial sequence
  SiRNA target sequence
taccaacgtggaagcttttgc

SEQ ID NO: 36166 - DNA, 21 bp, Artificial sequence
  SiRNA target sequence
accaacgtggaagcttttgct

SEQ ID NO: 36167 - DNA, 21 bp, Artificial sequence
  SiRNA target sequence
ccaacgtggaagcttttgctt

SEQ ID NO: 36168 - DNA, 21 bp, Artificial sequence
  SiRNA target sequence
caacgtggaagcttttgcttc

SEQ ID NO: 36169 - DNA, 21 bp, Artificial sequence
  SiRNA target sequence
aacgtggaagcttttgcttca

SEQ ID NO: 36170 - DNA, 21 bp, Artificial sequence
  SiRNA target sequence
acgtggaagcttttgcttcag

SEQ ID NO: 36171 - DNA, 21 bp, Artificial sequence
  SiRNA target sequence
cgtggaagcttttgcttcagc

SEQ ID NO: 36172 - DNA, 21 bp, Artificial sequence
  SiRNA target sequence
gtggaagcttttgcttcagct

SEQ ID NO: 36173 - DNA, 21 bp, Artificial sequence
  SiRNA target sequence
tggaagcttttgcttcagctg

SEQ ID NO: 36174 - DNA, 21 bp, Artificial sequence
  SiRNA target sequence
ggaagcttttgcttcagctga

SEQ ID NO: 36175 - DNA, 21 bp, Artificial sequence
  SiRNA target sequence
gaagcttttgcttcagctgat

SEQ ID NO: 36176 - DNA, 21 bp, Artificial sequence
  SiRNA target sequence
aagcttttgcttcagctgatc

SEQ ID NO: 36177 - DNA, 21 bp, Artificial sequence
  SiRNA target sequence
agcttttgcttcagctgatct

SEQ ID NO: 36178 - DNA, 21 bp, Artificial sequence
  SiRNA target sequence
gcttttgcttcagctgatctt

SEQ ID NO: 36179 - DNA, 21 bp, Artificial sequence
  SiRNA target sequence
cttttgcttcagctgatctta

SEQ ID NO: 36180 - DNA, 21 bp, Artificial sequence
  SiRNA target sequence
ttttgcttcagctgatcttaa

SEQ ID NO: 36181 - DNA, 21 bp, Artificial sequence
  SiRNA target sequence
tttgcttcagctgatcttaag

SEQ ID NO: 36182 - DNA, 21 bp, Artificial sequence
  SiRNA target sequence
ttgcttcagctgatcttaaga

SEQ ID NO: 36183 - DNA, 21 bp, Artificial sequence
  SiRNA target sequence
tgcttcagctgatcttaagac

SEQ ID NO: 36184 - DNA, 21 bp, Artificial sequence
  SiRNA target sequence
gcttcagctgatcttaagaca

SEQ ID NO: 36185 - DNA, 21 bp, Artificial sequence
  SiRNA target sequence
cttcagctgatcttaagacat

SEQ ID NO: 36186 - DNA, 21 bp, Artificial sequence
  SiRNA target sequence
ttcagctgatcttaagacatt

SEQ ID NO: 36187 - DNA, 21 bp, Artificial sequence
  SiRNA target sequence
tcagctgatcttaagacattt

SEQ ID NO: 36188 - DNA, 21 bp, Artificial sequence
  SiRNA target sequence
cagctgatcttaagacatttg

SEQ ID NO: 36189 - DNA, 21 bp, Artificial sequence
  SiRNA target sequence
agctgatcttaagacatttgt

SEQ ID NO: 36190 - DNA, 21 bp, Artificial sequence
  SiRNA target sequence
gctgatcttaagacatttgta

SEQ ID NO: 36191 - DNA, 21 bp, Artificial sequence
  SiRNA target sequence
ctgatcttaagacatttgtac

SEQ ID NO: 36192 - DNA, 21 bp, Artificial sequence
  SiRNA target sequence
tgatcttaagacatttgtaca

SEQ ID NO: 36193 - DNA, 21 bp, Artificial sequence
  SiRNA target sequence
gatcttaagacatttgtacaa

SEQ ID NO: 36194 - DNA, 21 bp, Artificial sequence
  SiRNA target sequence
atcttaagacatttgtacaaa

SEQ ID NO: 36195 - DNA, 21 bp, Artificial sequence
  SiRNA target sequence
tcttaagacatttgtacaaag

SEQ ID NO: 36196 - DNA, 21 bp, Artificial sequence
  SiRNA target sequence
cttaagacatttgtacaaagg

SEQ ID NO: 36197 - DNA, 21 bp, Artificial sequence
  SiRNA target sequence
ttaagacatttgtacaaagga

SEQ ID NO: 36198 - DNA, 21 bp, Artificial sequence
  SiRNA target sequence
taagacatttgtacaaaggaa

SEQ ID NO: 36199 - DNA, 21 bp, Artificial sequence
  SiRNA target sequence
aagacatttgtacaaaggaaa

SEQ ID NO: 36200 - DNA, 21 bp, Artificial sequence
  SiRNA target sequence
agacatttgtacaaaggaaac

SEQ ID NO: 36201 - DNA, 21 bp, Artificial sequence
  SiRNA target sequence
gacatttgtacaaaggaaacc

SEQ ID NO: 36202 - DNA, 21 bp, Artificial sequence
  SiRNA target sequence
acatttgtacaaaggaaacct

SEQ ID NO: 36203 - DNA, 21 bp, Artificial sequence
  SiRNA target sequence
catttgtacaaaggaaaccta

SEQ ID NO: 36204 - DNA, 21 bp, Artificial sequence
  SiRNA target sequence
atttgtacaaaggaaacctat

SEQ ID NO: 36205 - DNA, 21 bp, Artificial sequence
  SiRNA target sequence
tttgtacaaaggaaacctatt

SEQ ID NO: 36206 - DNA, 21 bp, Artificial sequence
  SiRNA target sequence
ttgtacaaaggaaacctattg

SEQ ID NO: 36207 - DNA, 21 bp, Artificial sequence
  SiRNA target sequence
tgtacaaaggaaacctattgt

SEQ ID NO: 36208 - DNA, 21 bp, Artificial sequence
  SiRNA target sequence
gtacaaaggaaacctattgtc

SEQ ID NO: 36209 - DNA, 21 bp, Artificial sequence
  SiRNA target sequence
tacaaaggaaacctattgtca

SEQ ID NO: 36210 - DNA, 21 bp, Artificial sequence
  SiRNA target sequence
acaaaggaaacctattgtcat

SEQ ID NO: 36211 - DNA, 21 bp, Artificial sequence
  SiRNA target sequence
caaaggaaacctattgtcatt

SEQ ID NO: 36212 - DNA, 21 bp, Artificial sequence
  SiRNA target sequence
aaaggaaacctattgtcattg

SEQ ID NO: 36213 - DNA, 21 bp, Artificial sequence
  SiRNA target sequence
aaggaaacctattgtcattga

SEQ ID NO: 36214 - DNA, 21 bp, Artificial sequence
  SiRNA target sequence
aggaaacctattgtcattgaa

SEQ ID NO: 36215 - DNA, 21 bp, Artificial sequence
  SiRNA target sequence
ggaaacctattgtcattgaag

SEQ ID NO: 36216 - DNA, 21 bp, Artificial sequence
  SiRNA target sequence
gaaacctattgtcattgaagg

SEQ ID NO: 36217 - DNA, 21 bp, Artificial sequence
  SiRNA target sequence
aaacctattgtcattgaagga

SEQ ID NO: 36218 - DNA, 21 bp, Artificial sequence
  SiRNA target sequence
aacctattgtcattgaaggac

SEQ ID NO: 36219 - DNA, 21 bp, Artificial sequence
  SiRNA target sequence
acctattgtcattgaaggacc

SEQ ID NO: 36220 - DNA, 21 bp, Artificial sequence
  SiRNA target sequence
cctattgtcattgaaggacct

SEQ ID NO: 36221 - DNA, 21 bp, Artificial sequence
  SiRNA target sequence
ctattgtcattgaaggacctg

SEQ ID NO: 36222 - DNA, 21 bp, Artificial sequence
  SiRNA target sequence
tattgtcattgaaggacctga

SEQ ID NO: 36223 - DNA, 21 bp, Artificial sequence
  SiRNA target sequence
attgtcattgaaggacctgaa

SEQ ID NO: 36224 - DNA, 21 bp, Artificial sequence
  SiRNA target sequence
ttgtcattgaaggacctgaat

SEQ ID NO: 36225 - DNA, 21 bp, Artificial sequence
  SiRNA target sequence
tgtcattgaaggacctgaatt

SEQ ID NO: 36226 - DNA, 21 bp, Artificial sequence
  SiRNA target sequence
gtcattgaaggacctgaattt

SEQ ID NO: 36227 - DNA, 21 bp, Artificial sequence
  SiRNA target sequence
tcattgaaggacctgaatttg

SEQ ID NO: 36228 - DNA, 21 bp, Artificial sequence
  SiRNA target sequence
cattgaaggacctgaatttgt

SEQ ID NO: 36229 - DNA, 21 bp, Artificial sequence
  SiRNA target sequence
attgaaggacctgaatttgta

SEQ ID NO: 36230 - DNA, 21 bp, Artificial sequence
  SiRNA target sequence
ttgaaggacctgaatttgtag

SEQ ID NO: 36231 - DNA, 21 bp, Artificial sequence
  SiRNA target sequence
tgaaggacctgaatttgtaga

SEQ ID NO: 36232 - DNA, 21 bp, Artificial sequence
  SiRNA target sequence
gaaggacctgaatttgtagag

SEQ ID NO: 36233 - DNA, 21 bp, Artificial sequence
  SiRNA target sequence
aaggacctgaatttgtagagg

SEQ ID NO: 36234 - DNA, 21 bp, Artificial sequence
  SiRNA target sequence
aggacctgaatttgtagaggc

SEQ ID NO: 36235 - DNA, 21 bp, Artificial sequence
  SiRNA target sequence
ggacctgaatttgtagaggca

SEQ ID NO: 36236 - DNA, 21 bp, Artificial sequence
  SiRNA target sequence
gacctgaatttgtagaggcac

SEQ ID NO: 36237 - DNA, 21 bp, Artificial sequence
  SiRNA target sequence
acctgaatttgtagaggcaca

SEQ ID NO: 36238 - DNA, 21 bp, Artificial sequence
  SiRNA target sequence
cctgaatttgtagaggcacaa

SEQ ID NO: 36239 - DNA, 21 bp, Artificial sequence
  SiRNA target sequence
ctgaatttgtagaggcacaaa

SEQ ID NO: 36240 - DNA, 21 bp, Artificial sequence
  SiRNA target sequence
tgaatttgtagaggcacaaac

SEQ ID NO: 36241 - DNA, 21 bp, Artificial sequence
  SiRNA target sequence
gaatttgtagaggcacaaaca

SEQ ID NO: 36242 - DNA, 21 bp, Artificial sequence
  SiRNA target sequence
aatttgtagaggcacaaacat

SEQ ID NO: 36243 - DNA, 21 bp, Artificial sequence
  SiRNA target sequence
atttgtagaggcacaaacatc

SEQ ID NO: 36244 - DNA, 21 bp, Artificial sequence
  SiRNA target sequence
tttgtagaggcacaaacatca

SEQ ID NO: 36245 - DNA, 21 bp, Artificial sequence
  SiRNA target sequence
ttgtagaggcacaaacatcag

SEQ ID NO: 36246 - DNA, 21 bp, Artificial sequence
  SiRNA target sequence
tgtagaggcacaaacatcagg

SEQ ID NO: 36247 - DNA, 21 bp, Artificial sequence
  SiRNA target sequence
gtagaggcacaaacatcagga

SEQ ID NO: 36248 - DNA, 21 bp, Artificial sequence
  SiRNA target sequence
tagaggcacaaacatcaggag

SEQ ID NO: 36249 - DNA, 21 bp, Artificial sequence
  SiRNA target sequence
agaggcacaaacatcaggaga

SEQ ID NO: 36250 - DNA, 21 bp, Artificial sequence
  SiRNA target sequence
gaggcacaaacatcaggagat

SEQ ID NO: 36251 - DNA, 21 bp, Artificial sequence
  SiRNA target sequence
aggcacaaacatcaggagatc

SEQ ID NO: 36252 - DNA, 21 bp, Artificial sequence
  SiRNA target sequence
ggcacaaacatcaggagatca

SEQ ID NO: 36253 - DNA, 21 bp, Artificial sequence
  SiRNA target sequence
gcacaaacatcaggagatcag

SEQ ID NO: 36254 - DNA, 21 bp, Artificial sequence
  SiRNA target sequence
cacaaacatcaggagatcaga

SEQ ID NO: 36255 - DNA, 21 bp, Artificial sequence
  SiRNA target sequence
acaaacatcaggagatcagat

SEQ ID NO: 36256 - DNA, 21 bp, Artificial sequence
  SiRNA target sequence
caaacatcaggagatcagatt

SEQ ID NO: 36257 - DNA, 21 bp, Artificial sequence
  SiRNA target sequence
aaacatcaggagatcagatta

SEQ ID NO: 36258 - DNA, 21 bp, Artificial sequence
  SiRNA target sequence
aacatcaggagatcagattac

SEQ ID NO: 36259 - DNA, 21 bp, Artificial sequence
  SiRNA target sequence
acatcaggagatcagattaca

SEQ ID NO: 36260 - DNA, 21 bp, Artificial sequence
  SiRNA target sequence
catcaggagatcagattacat

SEQ ID NO: 36261 - DNA, 21 bp, Artificial sequence
  SiRNA target sequence
atcaggagatcagattacatt

SEQ ID NO: 36262 - DNA, 21 bp, Artificial sequence
  SiRNA target sequence
tcaggagatcagattacatta

SEQ ID NO: 36263 - DNA, 21 bp, Artificial sequence
  SiRNA target sequence
caggagatcagattacattaa

SEQ ID NO: 36264 - DNA, 21 bp, Artificial sequence
  SiRNA target sequence
aggagatcagattacattaag

SEQ ID NO: 36265 - DNA, 21 bp, Artificial sequence
  SiRNA target sequence
ggagatcagattacattaagg

SEQ ID NO: 36266 - DNA, 21 bp, Artificial sequence
  SiRNA target sequence
gagatcagattacattaagga

SEQ ID NO: 36267 - DNA, 21 bp, Artificial sequence
  SiRNA target sequence
agatcagattacattaaggaa

SEQ ID NO: 36268 - DNA, 21 bp, Artificial sequence
  SiRNA target sequence
gatcagattacattaaggaaa

SEQ ID NO: 36269 - DNA, 21 bp, Artificial sequence
  SiRNA target sequence
atcagattacattaaggaaac

SEQ ID NO: 36270 - DNA, 21 bp, Artificial sequence
  SiRNA target sequence
tcagattacattaaggaaaca

SEQ ID NO: 36271 - DNA, 21 bp, Artificial sequence
  SiRNA target sequence
cagattacattaaggaaacaa

SEQ ID NO: 36272 - DNA, 21 bp, Artificial sequence
  SiRNA target sequence
agattacattaaggaaacaaa

SEQ ID NO: 36273 - DNA, 21 bp, Artificial sequence
  SiRNA target sequence
gattacattaaggaaacaaac

SEQ ID NO: 36274 - DNA, 21 bp, Artificial sequence
  SiRNA target sequence
attacattaaggaaacaaaca

SEQ ID NO: 36275 - DNA, 21 bp, Artificial sequence
  SiRNA target sequence
ttacattaaggaaacaaacac

SEQ ID NO: 36276 - DNA, 21 bp, Artificial sequence
  SiRNA target sequence
tacattaaggaaacaaacaca

SEQ ID NO: 36277 - DNA, 21 bp, Artificial sequence
  SiRNA target sequence
acattaaggaaacaaacacaa

SEQ ID NO: 36278 - DNA, 21 bp, Artificial sequence
  SiRNA target sequence
cattaaggaaacaaacacaaa

SEQ ID NO: 36279 - DNA, 21 bp, Artificial sequence
  SiRNA target sequence
attaaggaaacaaacacaaaa

SEQ ID NO: 36280 - DNA, 21 bp, Artificial sequence
  SiRNA target sequence
ttaaggaaacaaacacaaaaa

SEQ ID NO: 36281 - DNA, 21 bp, Artificial sequence
  SiRNA target sequence
taaggaaacaaacacaaaaag

SEQ ID NO: 36282 - DNA, 21 bp, Artificial sequence
  SiRNA target sequence
aaggaaacaaacacaaaaagt

SEQ ID NO: 36283 - DNA, 21 bp, Artificial sequence
  SiRNA target sequence
aggaaacaaacacaaaaagtc

SEQ ID NO: 36284 - DNA, 21 bp, Artificial sequence
  SiRNA target sequence
ggaaacaaacacaaaaagtca

SEQ ID NO: 36285 - DNA, 21 bp, Artificial sequence
  SiRNA target sequence
gaaacaaacacaaaaagtcat

SEQ ID NO: 36286 - DNA, 21 bp, Artificial sequence
  SiRNA target sequence
aaacaaacacaaaaagtcata

SEQ ID NO: 36287 - DNA, 21 bp, Artificial sequence
  SiRNA target sequence
aacaaacacaaaaagtcatag

SEQ ID NO: 36288 - DNA, 21 bp, Artificial sequence
  SiRNA target sequence
acaaacacaaaaagtcataga

SEQ ID NO: 36289 - DNA, 21 bp, Artificial sequence
  SiRNA target sequence
caaacacaaaaagtcatagag

SEQ ID NO: 36290 - DNA, 21 bp, Artificial sequence
  SiRNA target sequence
aaacacaaaaagtcatagagg

SEQ ID NO: 36291 - DNA, 21 bp, Artificial sequence
  SiRNA target sequence
aacacaaaaagtcatagaggc

SEQ ID NO: 36292 - DNA, 21 bp, Artificial sequence
  SiRNA target sequence
acacaaaaagtcatagaggca

SEQ ID NO: 36293 - DNA, 21 bp, Artificial sequence
  SiRNA target sequence
cacaaaaagtcatagaggcat

SEQ ID NO: 36294 - DNA, 21 bp, Artificial sequence
  SiRNA target sequence
acaaaaagtcatagaggcatt

SEQ ID NO: 36295 - DNA, 21 bp, Artificial sequence
  SiRNA target sequence
caaaaagtcatagaggcattc

SEQ ID NO: 36296 - DNA, 21 bp, Artificial sequence
  SiRNA target sequence
aaaaagtcatagaggcattcg

SEQ ID NO: 36297 - DNA, 21 bp, Artificial sequence
  SiRNA target sequence
aaaagtcatagaggcattcgc

SEQ ID NO: 36298 - DNA, 21 bp, Artificial sequence
  SiRNA target sequence
aaagtcatagaggcattcgct

SEQ ID NO: 36299 - DNA, 21 bp, Artificial sequence
  SiRNA target sequence
aagtcatagaggcattcgcta

SEQ ID NO: 36300 - DNA, 21 bp, Artificial sequence
  SiRNA target sequence
agtcatagaggcattcgctag

SEQ ID NO: 36301 - DNA, 21 bp, Artificial sequence
  SiRNA target sequence
gtcatagaggcattcgctagt

SEQ ID NO: 36302 - DNA, 21 bp, Artificial sequence
  SiRNA target sequence
tcatagaggcattcgctagtt

SEQ ID NO: 36303 - DNA, 21 bp, Artificial sequence
  SiRNA target sequence
catagaggcattcgctagttc

SEQ ID NO: 36304 - DNA, 21 bp, Artificial sequence
  SiRNA target sequence
atagaggcattcgctagttca

SEQ ID NO: 36305 - DNA, 21 bp, Artificial sequence
  SiRNA target sequence
tagaggcattcgctagttcag

SEQ ID NO: 36306 - DNA, 21 bp, Artificial sequence
  SiRNA target sequence
agaggcattcgctagttcaga

SEQ ID NO: 36307 - DNA, 21 bp, Artificial sequence
  SiRNA target sequence
gaggcattcgctagttcagat

SEQ ID NO: 36308 - DNA, 21 bp, Artificial sequence
  SiRNA target sequence
aggcattcgctagttcagatg

SEQ ID NO: 36309 - DNA, 21 bp, Artificial sequence
  SiRNA target sequence
ggcattcgctagttcagatgc

SEQ ID NO: 36310 - DNA, 21 bp, Artificial sequence
  SiRNA target sequence
gcattcgctagttcagatgca

SEQ ID NO: 36311 - DNA, 21 bp, Artificial sequence
  SiRNA target sequence
cattcgctagttcagatgcaa

SEQ ID NO: 36312 - DNA, 21 bp, Artificial sequence
  SiRNA target sequence
attcgctagttcagatgcaat

SEQ ID NO: 36313 - DNA, 21 bp, Artificial sequence
  SiRNA target sequence
ttcgctagttcagatgcaatc

SEQ ID NO: 36314 - DNA, 21 bp, Artificial sequence
  SiRNA target sequence
tcgctagttcagatgcaatca

SEQ ID NO: 36315 - DNA, 21 bp, Artificial sequence
  SiRNA target sequence
cgctagttcagatgcaatcac

SEQ ID NO: 36316 - DNA, 21 bp, Artificial sequence
  SiRNA target sequence
gctagttcagatgcaatcaca

SEQ ID NO: 36317 - DNA, 21 bp, Artificial sequence
  SiRNA target sequence
ctagttcagatgcaatcacaa

SEQ ID NO: 36318 - DNA, 21 bp, Artificial sequence
  SiRNA target sequence
tagttcagatgcaatcacaat

SEQ ID NO: 36319 - DNA, 21 bp, Artificial sequence
  SiRNA target sequence
agttcagatgcaatcacaatg

SEQ ID NO: 36320 - DNA, 21 bp, Artificial sequence
  SiRNA target sequence
gttcagatgcaatcacaatgg

SEQ ID NO: 36321 - DNA, 21 bp, Artificial sequence
  SiRNA target sequence
ttcagatgcaatcacaatggc

SEQ ID NO: 36322 - DNA, 21 bp, Artificial sequence
  SiRNA target sequence
tcagatgcaatcacaatggct

SEQ ID NO: 36323 - DNA, 21 bp, Artificial sequence
  SiRNA target sequence
cagatgcaatcacaatggctc

SEQ ID NO: 36324 - DNA, 21 bp, Artificial sequence
  SiRNA target sequence
agatgcaatcacaatggctcg

SEQ ID NO: 36325 - DNA, 21 bp, Artificial sequence
  SiRNA target sequence
gatgcaatcacaatggctcgc

SEQ ID NO: 36326 - DNA, 21 bp, Artificial sequence
  SiRNA target sequence
atgcaatcacaatggctcgca

SEQ ID NO: 36327 - DNA, 21 bp, Artificial sequence
  SiRNA target sequence
tgcaatcacaatggctcgcaa

SEQ ID NO: 36328 - DNA, 21 bp, Artificial sequence
  SiRNA target sequence
gcaatcacaatggctcgcaaa

SEQ ID NO: 36329 - DNA, 21 bp, Artificial sequence
  SiRNA target sequence
caatcacaatggctcgcaaaa

SEQ ID NO: 36330 - DNA, 21 bp, Artificial sequence
  SiRNA target sequence
aatcacaatggctcgcaaaac

SEQ ID NO: 36331 - DNA, 21 bp, Artificial sequence
  SiRNA target sequence
atcacaatggctcgcaaaaca

SEQ ID NO: 36332 - DNA, 21 bp, Artificial sequence
  SiRNA target sequence
tcacaatggctcgcaaaacac

SEQ ID NO: 36333 - DNA, 21 bp, Artificial sequence
  SiRNA target sequence
cacaatggctcgcaaaacacc

SEQ ID NO: 36334 - DNA, 21 bp, Artificial sequence
  SiRNA target sequence
acaatggctcgcaaaacacca

SEQ ID NO: 36335 - DNA, 21 bp, Artificial sequence
  SiRNA target sequence
caatggctcgcaaaacaccaa

SEQ ID NO: 36336 - DNA, 21 bp, Artificial sequence
  SiRNA target sequence
aatggctcgcaaaacaccaaa

SEQ ID NO: 36337 - DNA, 21 bp, Artificial sequence
  SiRNA target sequence
atggctcgcaaaacaccaaag

SEQ ID NO: 36338 - DNA, 21 bp, Artificial sequence
  SiRNA target sequence
tggctcgcaaaacaccaaagt

SEQ ID NO: 36339 - DNA, 21 bp, Artificial sequence
  SiRNA target sequence
ggctcgcaaaacaccaaagtt

SEQ ID NO: 36340 - DNA, 21 bp, Artificial sequence
  SiRNA target sequence
gctcgcaaaacaccaaagttt

SEQ ID NO: 36341 - DNA, 21 bp, Artificial sequence
  SiRNA target sequence
ctcgcaaaacaccaaagtttg

SEQ ID NO: 36342 - DNA, 21 bp, Artificial sequence
  SiRNA target sequence
tcgcaaaacaccaaagtttgt

SEQ ID NO: 36343 - DNA, 21 bp, Artificial sequence
  SiRNA target sequence
cgcaaaacaccaaagtttgtt

SEQ ID NO: 36344 - DNA, 21 bp, Artificial sequence
  SiRNA target sequence
gcaaaacaccaaagtttgttg

SEQ ID NO: 36345 - DNA, 21 bp, Artificial sequence
  SiRNA target sequence
caaaacaccaaagtttgttga

SEQ ID NO: 36346 - DNA, 21 bp, Artificial sequence
  SiRNA target sequence
aaaacaccaaagtttgttgag

SEQ ID NO: 36347 - DNA, 21 bp, Artificial sequence
  SiRNA target sequence
aaacaccaaagtttgttgaga

SEQ ID NO: 36348 - DNA, 21 bp, Artificial sequence
  SiRNA target sequence
aacaccaaagtttgttgagag

SEQ ID NO: 36349 - DNA, 21 bp, Artificial sequence
  SiRNA target sequence
acaccaaagtttgttgagagt

SEQ ID NO: 36350 - DNA, 21 bp, Artificial sequence
  SiRNA target sequence
caccaaagtttgttgagagtg

SEQ ID NO: 36351 - DNA, 21 bp, Artificial sequence
  SiRNA target sequence
accaaagtttgttgagagtga

SEQ ID NO: 36352 - DNA, 21 bp, Artificial sequence
  SiRNA target sequence
ccaaagtttgttgagagtgat

SEQ ID NO: 36353 - DNA, 21 bp, Artificial sequence
  SiRNA target sequence
caaagtttgttgagagtgatg

SEQ ID NO: 36354 - DNA, 21 bp, Artificial sequence
  SiRNA target sequence
aaagtttgttgagagtgatga

SEQ ID NO: 36355 - DNA, 21 bp, Artificial sequence
  SiRNA target sequence
aagtttgttgagagtgatgat

SEQ ID NO: 36356 - DNA, 21 bp, Artificial sequence
  SiRNA target sequence
agtttgttgagagtgatgatg

SEQ ID NO: 36357 - DNA, 21 bp, Artificial sequence
  SiRNA target sequence
gtttgttgagagtgatgatgt

SEQ ID NO: 36358 - DNA, 21 bp, Artificial sequence
  SiRNA target sequence
tttgttgagagtgatgatgtg

SEQ ID NO: 36359 - DNA, 21 bp, Artificial sequence
  SiRNA target sequence
ttgttgagagtgatgatgtgg

SEQ ID NO: 36360 - DNA, 21 bp, Artificial sequence
  SiRNA target sequence
tgttgagagtgatgatgtggt

SEQ ID NO: 36361 - DNA, 21 bp, Artificial sequence
  SiRNA target sequence
gttgagagtgatgatgtggtc

SEQ ID NO: 36362 - DNA, 21 bp, Artificial sequence
  SiRNA target sequence
ttgagagtgatgatgtggtcg

SEQ ID NO: 36363 - DNA, 21 bp, Artificial sequence
  SiRNA target sequence
tgagagtgatgatgtggtcga

SEQ ID NO: 36364 - DNA, 21 bp, Artificial sequence
  SiRNA target sequence
gagagtgatgatgtggtcgaa

SEQ ID NO: 36365 - DNA, 21 bp, Artificial sequence
  SiRNA target sequence
agagtgatgatgtggtcgaag

SEQ ID NO: 36366 - DNA, 21 bp, Artificial sequence
  SiRNA target sequence
gagtgatgatgtggtcgaagt

SEQ ID NO: 36367 - DNA, 21 bp, Artificial sequence
  SiRNA target sequence
agtgatgatgtggtcgaagtt

SEQ ID NO: 36368 - DNA, 21 bp, Artificial sequence
  SiRNA target sequence
gtgatgatgtggtcgaagttt

SEQ ID NO: 36369 - DNA, 21 bp, Artificial sequence
  SiRNA target sequence
tgatgatgtggtcgaagtttc

SEQ ID NO: 36370 - DNA, 21 bp, Artificial sequence
  SiRNA target sequence
gatgatgtggtcgaagtttca

SEQ ID NO: 36371 - DNA, 21 bp, Artificial sequence
  SiRNA target sequence
atgatgtggtcgaagtttcaa

SEQ ID NO: 36372 - DNA, 21 bp, Artificial sequence
  SiRNA target sequence
tgatgtggtcgaagtttcaat

SEQ ID NO: 36373 - DNA, 21 bp, Artificial sequence
  SiRNA target sequence
gatgtggtcgaagtttcaatg

SEQ ID NO: 36374 - DNA, 21 bp, Artificial sequence
  SiRNA target sequence
atgtggtcgaagtttcaatgc

SEQ ID NO: 36375 - DNA, 21 bp, Artificial sequence
  SiRNA target sequence
tgtggtcgaagtttcaatgca

SEQ ID NO: 36376 - DNA, 21 bp, Artificial sequence
  SiRNA target sequence
gtggtcgaagtttcaatgcaa

SEQ ID NO: 36377 - DNA, 21 bp, Artificial sequence
  SiRNA target sequence
tggtcgaagtttcaatgcaaa

SEQ ID NO: 36378 - DNA, 21 bp, Artificial sequence
  SiRNA target sequence
ggtcgaagtttcaatgcaaat

SEQ ID NO: 36379 - DNA, 21 bp, Artificial sequence
  SiRNA target sequence
gtcgaagtttcaatgcaaatg

SEQ ID NO: 36380 - DNA, 21 bp, Artificial sequence
  SiRNA target sequence
tcgaagtttcaatgcaaatgt

SEQ ID NO: 36381 - DNA, 21 bp, Artificial sequence
  SiRNA target sequence
cgaagtttcaatgcaaatgtg

SEQ ID NO: 36382 - DNA, 21 bp, Artificial sequence
  SiRNA target sequence
gaagtttcaatgcaaatgtgg

SEQ ID NO: 36383 - DNA, 21 bp, Artificial sequence
  SiRNA target sequence
aagtttcaatgcaaatgtgga

SEQ ID NO: 36384 - DNA, 21 bp, Artificial sequence
  SiRNA target sequence
agtttcaatgcaaatgtggaa

SEQ ID NO: 36385 - DNA, 21 bp, Artificial sequence
  SiRNA target sequence
gtttcaatgcaaatgtggaaa

SEQ ID NO: 36386 - DNA, 21 bp, Artificial sequence
  SiRNA target sequence
tttcaatgcaaatgtggaaag

SEQ ID NO: 36387 - DNA, 21 bp, Artificial sequence
  SiRNA target sequence
ttcaatgcaaatgtggaaaga

SEQ ID NO: 36388 - DNA, 21 bp, Artificial sequence
  SiRNA target sequence
tcaatgcaaatgtggaaagat

SEQ ID NO: 36389 - DNA, 21 bp, Artificial sequence
  SiRNA target sequence
caatgcaaatgtggaaagatc

SEQ ID NO: 36390 - DNA, 21 bp, Artificial sequence
  SiRNA target sequence
aatgcaaatgtggaaagatca

SEQ ID NO: 36391 - DNA, 21 bp, Artificial sequence
  SiRNA target sequence
atgcaaatgtggaaagatcaa

SEQ ID NO: 36392 - DNA, 21 bp, Artificial sequence
  SiRNA target sequence
tgcaaatgtggaaagatcaag

SEQ ID NO: 36393 - DNA, 21 bp, Artificial sequence
  SiRNA target sequence
gcaaatgtggaaagatcaagt

SEQ ID NO: 36394 - DNA, 21 bp, Artificial sequence
  SiRNA target sequence
caaatgtggaaagatcaagtt

SEQ ID NO: 36395 - DNA, 21 bp, Artificial sequence
  SiRNA target sequence
aaatgtggaaagatcaagttg

SEQ ID NO: 36396 - DNA, 21 bp, Artificial sequence
  SiRNA target sequence
aatgtggaaagatcaagttgc

SEQ ID NO: 36397 - DNA, 21 bp, Artificial sequence
  SiRNA target sequence
atgtggaaagatcaagttgcg

SEQ ID NO: 36398 - DNA, 21 bp, Artificial sequence
  SiRNA target sequence
tgtggaaagatcaagttgcgc

SEQ ID NO: 36399 - DNA, 21 bp, Artificial sequence
  SiRNA target sequence
gtggaaagatcaagttgcgca

SEQ ID NO: 36400 - DNA, 21 bp, Artificial sequence
  SiRNA target sequence
tggaaagatcaagttgcgcaa

SEQ ID NO: 36401 - DNA, 21 bp, Artificial sequence
  SiRNA target sequence
ggaaagatcaagttgcgcaaa

SEQ ID NO: 36402 - DNA, 21 bp, Artificial sequence
  SiRNA target sequence
gaaagatcaagttgcgcaaaa

SEQ ID NO: 36403 - DNA, 21 bp, Artificial sequence
  SiRNA target sequence
aaagatcaagttgcgcaaaag

SEQ ID NO: 36404 - DNA, 21 bp, Artificial sequence
  SiRNA target sequence
aagatcaagttgcgcaaaagt

SEQ ID NO: 36405 - DNA, 21 bp, Artificial sequence
  SiRNA target sequence
agatcaagttgcgcaaaagtt

SEQ ID NO: 36406 - DNA, 21 bp, Artificial sequence
  SiRNA target sequence
gatcaagttgcgcaaaagttg

SEQ ID NO: 36407 - DNA, 21 bp, Artificial sequence
  SiRNA target sequence
atcaagttgcgcaaaagttga

SEQ ID NO: 36408 - DNA, 21 bp, Artificial sequence
  SiRNA target sequence
tcaagttgcgcaaaagttgat

SEQ ID NO: 36409 - DNA, 21 bp, Artificial sequence
  SiRNA target sequence
caagttgcgcaaaagttgata

SEQ ID NO: 36410 - DNA, 21 bp, Artificial sequence
  SiRNA target sequence
aagttgcgcaaaagttgataa

SEQ ID NO: 36411 - DNA, 21 bp, Artificial sequence
  SiRNA target sequence
agttgcgcaaaagttgataac

SEQ ID NO: 36412 - DNA, 21 bp, Artificial sequence
  SiRNA target sequence
gttgcgcaaaagttgataact

SEQ ID NO: 36413 - DNA, 21 bp, Artificial sequence
  SiRNA target sequence
ttgcgcaaaagttgataacta

SEQ ID NO: 36414 - DNA, 21 bp, Artificial sequence
  SiRNA target sequence
tgcgcaaaagttgataactaa

SEQ ID NO: 36415 - DNA, 21 bp, Artificial sequence
  SiRNA target sequence
gcgcaaaagttgataactaac

SEQ ID NO: 36416 - DNA, 21 bp, Artificial sequence
  SiRNA target sequence
cgcaaaagttgataactaacc

SEQ ID NO: 36417 - DNA, 21 bp, Artificial sequence
  SiRNA target sequence
gcaaaagttgataactaaccg

SEQ ID NO: 36418 - DNA, 21 bp, Artificial sequence
  SiRNA target sequence
caaaagttgataactaaccga

SEQ ID NO: 36419 - DNA, 21 bp, Artificial sequence
  SiRNA target sequence
aaaagttgataactaaccgag

SEQ ID NO: 36420 - DNA, 21 bp, Artificial sequence
  SiRNA target sequence
aaagttgataactaaccgagt

SEQ ID NO: 36421 - DNA, 21 bp, Artificial sequence
  SiRNA target sequence
aagttgataactaaccgagtt

SEQ ID NO: 36422 - DNA, 21 bp, Artificial sequence
  SiRNA target sequence
agttgataactaaccgagttt

SEQ ID NO: 36423 - DNA, 21 bp, Artificial sequence
  SiRNA target sequence
gttgataactaaccgagtttt

SEQ ID NO: 36424 - DNA, 21 bp, Artificial sequence
  SiRNA target sequence
ttgataactaaccgagtttta

SEQ ID NO: 36425 - DNA, 21 bp, Artificial sequence
  SiRNA target sequence
tgataactaaccgagttttaa

SEQ ID NO: 36426 - DNA, 21 bp, Artificial sequence
  SiRNA target sequence
gataactaaccgagttttaac

SEQ ID NO: 36427 - DNA, 21 bp, Artificial sequence
  SiRNA target sequence
ataactaaccgagttttaaca

SEQ ID NO: 36428 - DNA, 21 bp, Artificial sequence
  SiRNA target sequence
taactaaccgagttttaacaa

SEQ ID NO: 36429 - DNA, 21 bp, Artificial sequence
  SiRNA target sequence
aactaaccgagttttaacaaa

SEQ ID NO: 36430 - DNA, 21 bp, Artificial sequence
  SiRNA target sequence
actaaccgagttttaacaaac

SEQ ID NO: 36431 - DNA, 21 bp, Artificial sequence
  SiRNA target sequence
ctaaccgagttttaacaaacc

SEQ ID NO: 36432 - DNA, 21 bp, Artificial sequence
  SiRNA target sequence
taaccgagttttaacaaacct

SEQ ID NO: 36433 - DNA, 21 bp, Artificial sequence
  SiRNA target sequence
aaccgagttttaacaaacctg

SEQ ID NO: 36434 - DNA, 21 bp, Artificial sequence
  SiRNA target sequence
accgagttttaacaaacctgt

SEQ ID NO: 36435 - DNA, 21 bp, Artificial sequence
  SiRNA target sequence
ccgagttttaacaaacctgta

SEQ ID NO: 36436 - DNA, 21 bp, Artificial sequence
  SiRNA target sequence
cgagttttaacaaacctgtat

SEQ ID NO: 36437 - DNA, 21 bp, Artificial sequence
  SiRNA target sequence
gagttttaacaaacctgtata

SEQ ID NO: 36438 - DNA, 21 bp, Artificial sequence
  SiRNA target sequence
agttttaacaaacctgtataa

SEQ ID NO: 36439 - DNA, 21 bp, Artificial sequence
  SiRNA target sequence
gttttaacaaacctgtataaa

SEQ ID NO: 36440 - DNA, 21 bp, Artificial sequence
  SiRNA target sequence
ttttaacaaacctgtataaaa

SEQ ID NO: 36441 - DNA, 21 bp, Artificial sequence
  SiRNA target sequence
tttaacaaacctgtataaaat

SEQ ID NO: 36442 - DNA, 21 bp, Artificial sequence
  SiRNA target sequence
ttaacaaacctgtataaaatt

SEQ ID NO: 36443 - DNA, 21 bp, Artificial sequence
  SiRNA target sequence
taacaaacctgtataaaattt

SEQ ID NO: 36444 - DNA, 21 bp, Artificial sequence
  SiRNA target sequence
aacaaacctgtataaaatttg

SEQ ID NO: 36445 - DNA, 21 bp, Artificial sequence
  SiRNA target sequence
acaaacctgtataaaatttgt

SEQ ID NO: 36446 - DNA, 21 bp, Artificial sequence
  SiRNA target sequence
caaacctgtataaaatttgtt

SEQ ID NO: 36447 - DNA, 21 bp, Artificial sequence
  SiRNA target sequence
aaacctgtataaaatttgttt

SEQ ID NO: 36448 - DNA, 21 bp, Artificial sequence
  SiRNA target sequence
aacctgtataaaatttgttta

SEQ ID NO: 36449 - DNA, 21 bp, Artificial sequence
  SiRNA target sequence
acctgtataaaatttgtttag

SEQ ID NO: 36450 - DNA, 21 bp, Artificial sequence
  SiRNA target sequence
cctgtataaaatttgtttagt

SEQ ID NO: 36451 - DNA, 21 bp, Artificial sequence
  SiRNA target sequence
ctgtataaaatttgtttagtt

SEQ ID NO: 36452 - DNA, 21 bp, Artificial sequence
  SiRNA target sequence
tgtataaaatttgtttagtta

SEQ ID NO: 36453 - DNA, 21 bp, Artificial sequence
  SiRNA target sequence
gtataaaatttgtttagttaa

SEQ ID NO: 36454 - DNA, 21 bp, Artificial sequence
  SiRNA target sequence
tataaaatttgtttagttaag

SEQ ID NO: 36455 - DNA, 21 bp, Artificial sequence
  SiRNA target sequence
ataaaatttgtttagttaagg

SEQ ID NO: 36456 - DNA, 21 bp, Artificial sequence
  SiRNA target sequence
taaaatttgtttagttaagga

SEQ ID NO: 36457 - DNA, 21 bp, Artificial sequence
  SiRNA target sequence
aaaatttgtttagttaaggag

SEQ ID NO: 36458 - DNA, 21 bp, Artificial sequence
  SiRNA target sequence
aaatttgtttagttaaggaga

SEQ ID NO: 36459 - DNA, 21 bp, Artificial sequence
  SiRNA target sequence
aatttgtttagttaaggagaa

SEQ ID NO: 36460 - DNA, 21 bp, Artificial sequence
  SiRNA target sequence
atttgtttagttaaggagaat

SEQ ID NO: 36461 - DNA, 21 bp, Artificial sequence
  SiRNA target sequence
tttgtttagttaaggagaatg

SEQ ID NO: 36462 - DNA, 21 bp, Artificial sequence
  SiRNA target sequence
ttgtttagttaaggagaatgg

SEQ ID NO: 36463 - DNA, 21 bp, Artificial sequence
  SiRNA target sequence
tgtttagttaaggagaatggt

SEQ ID NO: 36464 - DNA, 21 bp, Artificial sequence
  SiRNA target sequence
gtttagttaaggagaatggtg

SEQ ID NO: 36465 - DNA, 21 bp, Artificial sequence
  SiRNA target sequence
tttagttaaggagaatggtga

SEQ ID NO: 36466 - DNA, 21 bp, Artificial sequence
  SiRNA target sequence
ttagttaaggagaatggtgat

SEQ ID NO: 36467 - DNA, 21 bp, Artificial sequence
  SiRNA target sequence
tagttaaggagaatggtgata

SEQ ID NO: 36468 - DNA, 21 bp, Artificial sequence
  SiRNA target sequence
agttaaggagaatggtgatat

SEQ ID NO: 36469 - DNA, 21 bp, Artificial sequence
  SiRNA target sequence
gttaaggagaatggtgatatg

SEQ ID NO: 36470 - DNA, 21 bp, Artificial sequence
  SiRNA target sequence
ttaaggagaatggtgatatgg

SEQ ID NO: 36471 - DNA, 21 bp, Artificial sequence
  SiRNA target sequence
taaggagaatggtgatatggt

SEQ ID NO: 36472 - DNA, 21 bp, Artificial sequence
  SiRNA target sequence
aaggagaatggtgatatggta

SEQ ID NO: 36473 - DNA, 21 bp, Artificial sequence
  SiRNA target sequence
aggagaatggtgatatggtac

SEQ ID NO: 36474 - DNA, 21 bp, Artificial sequence
  SiRNA target sequence
ggagaatggtgatatggtacc

SEQ ID NO: 36475 - DNA, 21 bp, Artificial sequence
  SiRNA target sequence
gagaatggtgatatggtaccg

SEQ ID NO: 36476 - DNA, 21 bp, Artificial sequence
  SiRNA target sequence
agaatggtgatatggtaccgc

SEQ ID NO: 36477 - DNA, 21 bp, Artificial sequence
  SiRNA target sequence
gaatggtgatatggtaccgct

SEQ ID NO: 36478 - DNA, 21 bp, Artificial sequence
  SiRNA target sequence
aatggtgatatggtaccgctg

SEQ ID NO: 36479 - DNA, 21 bp, Artificial sequence
  SiRNA target sequence
atggtgatatggtaccgctgc

SEQ ID NO: 36480 - DNA, 21 bp, Artificial sequence
  SiRNA target sequence
tggtgatatggtaccgctgct

SEQ ID NO: 36481 - DNA, 21 bp, Artificial sequence
  SiRNA target sequence
ggtgatatggtaccgctgcta

SEQ ID NO: 36482 - DNA, 21 bp, Artificial sequence
  SiRNA target sequence
gtgatatggtaccgctgctaa

SEQ ID NO: 36483 - DNA, 21 bp, Artificial sequence
  SiRNA target sequence
tgatatggtaccgctgctaaa

SEQ ID NO: 36484 - DNA, 21 bp, Artificial sequence
  SiRNA target sequence
gatatggtaccgctgctaaat

SEQ ID NO: 36485 - DNA, 21 bp, Artificial sequence
  SiRNA target sequence
atatggtaccgctgctaaatg

SEQ ID NO: 36486 - DNA, 21 bp, Artificial sequence
  SiRNA target sequence
tatggtaccgctgctaaatgg

SEQ ID NO: 36487 - DNA, 21 bp, Artificial sequence
  SiRNA target sequence
atggtaccgctgctaaatggt

SEQ ID NO: 36488 - DNA, 21 bp, Artificial sequence
  SiRNA target sequence
tggtaccgctgctaaatggtt

SEQ ID NO: 36489 - DNA, 21 bp, Artificial sequence
  SiRNA target sequence
ggtaccgctgctaaatggttt

SEQ ID NO: 36490 - DNA, 21 bp, Artificial sequence
  SiRNA target sequence
gtaccgctgctaaatggtttg

SEQ ID NO: 36491 - DNA, 21 bp, Artificial sequence
  SiRNA target sequence
taccgctgctaaatggtttgt

SEQ ID NO: 36492 - DNA, 21 bp, Artificial sequence
  SiRNA target sequence
accgctgctaaatggtttgtt

SEQ ID NO: 36493 - DNA, 21 bp, Artificial sequence
  SiRNA target sequence
ccgctgctaaatggtttgttt

SEQ ID NO: 36494 - DNA, 21 bp, Artificial sequence
  SiRNA target sequence
cgctgctaaatggtttgtttg

SEQ ID NO: 36495 - DNA, 21 bp, Artificial sequence
  SiRNA target sequence
gctgctaaatggtttgtttgt

SEQ ID NO: 36496 - DNA, 21 bp, Artificial sequence
  SiRNA target sequence
ctgctaaatggtttgtttgtt

SEQ ID NO: 36497 - DNA, 21 bp, Artificial sequence
  SiRNA target sequence
tgctaaatggtttgtttgttc

SEQ ID NO: 36498 - DNA, 21 bp, Artificial sequence
  SiRNA target sequence
gctaaatggtttgtttgttcg

SEQ ID NO: 36499 - DNA, 21 bp, Artificial sequence
  SiRNA target sequence
ctaaatggtttgtttgttcgt

SEQ ID NO: 36500 - DNA, 21 bp, Artificial sequence
  SiRNA target sequence
taaatggtttgtttgttcgtt

SEQ ID NO: 36501 - DNA, 21 bp, Artificial sequence
  SiRNA target sequence
aaatggtttgtttgttcgttc

SEQ ID NO: 36502 - DNA, 21 bp, Artificial sequence
  SiRNA target sequence
aatggtttgtttgttcgttca

SEQ ID NO: 36503 - DNA, 21 bp, Artificial sequence
  SiRNA target sequence
atggtttgtttgttcgttcaa

SEQ ID NO: 36504 - DNA, 21 bp, Artificial sequence
  SiRNA target sequence
tggtttgtttgttcgttcaaa

SEQ ID NO: 36505 - DNA, 21 bp, Artificial sequence
  SiRNA target sequence
ggtttgtttgttcgttcaaac

SEQ ID NO: 36506 - DNA, 21 bp, Artificial sequence
  SiRNA target sequence
gtttgtttgttcgttcaaaca

SEQ ID NO: 36507 - DNA, 21 bp, Artificial sequence
  SiRNA target sequence
tttgtttgttcgttcaaacat

SEQ ID NO: 36508 - DNA, 21 bp, Artificial sequence
  SiRNA target sequence
ttgtttgttcgttcaaacata

SEQ ID NO: 36509 - DNA, 21 bp, Artificial sequence
  SiRNA target sequence
tgtttgttcgttcaaacataa

SEQ ID NO: 36510 - DNA, 21 bp, Artificial sequence
  SiRNA target sequence
gtttgttcgttcaaacataat

SEQ ID NO: 36511 - DNA, 21 bp, Artificial sequence
  SiRNA target sequence
tttgttcgttcaaacataatg

SEQ ID NO: 36512 - DNA, 21 bp, Artificial sequence
  SiRNA target sequence
ttgttcgttcaaacataatgt

SEQ ID NO: 36513 - DNA, 21 bp, Artificial sequence
  SiRNA target sequence
tgttcgttcaaacataatgtt

SEQ ID NO: 36514 - DNA, 21 bp, Artificial sequence
  SiRNA target sequence
gttcgttcaaacataatgtta

SEQ ID NO: 36515 - DNA, 21 bp, Artificial sequence
  SiRNA target sequence
ttcgttcaaacataatgttag

SEQ ID NO: 36516 - DNA, 21 bp, Artificial sequence
  SiRNA target sequence
tcgttcaaacataatgttagc

SEQ ID NO: 36517 - DNA, 21 bp, Artificial sequence
  SiRNA target sequence
cgttcaaacataatgttagcc

SEQ ID NO: 36518 - DNA, 21 bp, Artificial sequence
  SiRNA target sequence
gttcaaacataatgttagccc

SEQ ID NO: 36519 - DNA, 21 bp, Artificial sequence
  SiRNA target sequence
ttcaaacataatgttagcccc

SEQ ID NO: 36520 - DNA, 21 bp, Artificial sequence
  SiRNA target sequence
tcaaacataatgttagcccct

SEQ ID NO: 36521 - DNA, 21 bp, Artificial sequence
  SiRNA target sequence
caaacataatgttagcccctg

SEQ ID NO: 36522 - DNA, 21 bp, Artificial sequence
  SiRNA target sequence
aaacataatgttagcccctgg

SEQ ID NO: 36523 - DNA, 21 bp, Artificial sequence
  SiRNA target sequence
aacataatgttagcccctgga

SEQ ID NO: 36524 - DNA, 21 bp, Artificial sequence
  SiRNA target sequence
acataatgttagcccctggac

SEQ ID NO: 36525 - DNA, 21 bp, Artificial sequence
  SiRNA target sequence
cataatgttagcccctggaca

SEQ ID NO: 36526 - DNA, 21 bp, Artificial sequence
  SiRNA target sequence
ataatgttagcccctggacac

SEQ ID NO: 36527 - DNA, 21 bp, Artificial sequence
  SiRNA target sequence
taatgttagcccctggacact

SEQ ID NO: 36528 - DNA, 21 bp, Artificial sequence
  SiRNA target sequence
aatgttagcccctggacactt

SEQ ID NO: 36529 - DNA, 21 bp, Artificial sequence
  SiRNA target sequence
atgttagcccctggacactta

SEQ ID NO: 36530 - DNA, 21 bp, Artificial sequence
  SiRNA target sequence
tgttagcccctggacacttag

SEQ ID NO: 36531 - DNA, 21 bp, Artificial sequence
  SiRNA target sequence
gttagcccctggacacttagt

SEQ ID NO: 36532 - DNA, 21 bp, Artificial sequence
  SiRNA target sequence
ttagcccctggacacttagtg

SEQ ID NO: 36533 - DNA, 21 bp, Artificial sequence
  SiRNA target sequence
tagcccctggacacttagtgg

SEQ ID NO: 36534 - DNA, 21 bp, Artificial sequence
  SiRNA target sequence
agcccctggacacttagtggg

SEQ ID NO: 36535 - DNA, 21 bp, Artificial sequence
  SiRNA target sequence
gcccctggacacttagtgggt

SEQ ID NO: 36536 - DNA, 21 bp, Artificial sequence
  SiRNA target sequence
cccctggacacttagtgggtt

SEQ ID NO: 36537 - DNA, 21 bp, Artificial sequence
  SiRNA target sequence
ccctggacacttagtgggttt

SEQ ID NO: 36538 - DNA, 21 bp, Artificial sequence
  SiRNA target sequence
cctggacacttagtgggtttc

SEQ ID NO: 36539 - DNA, 21 bp, Artificial sequence
  SiRNA target sequence
ctggacacttagtgggtttct

SEQ ID NO: 36540 - DNA, 21 bp, Artificial sequence
  SiRNA target sequence
tggacacttagtgggtttctt

SEQ ID NO: 36541 - DNA, 21 bp, Artificial sequence
  SiRNA target sequence
ggacacttagtgggtttctta

SEQ ID NO: 36542 - DNA, 21 bp, Artificial sequence
  SiRNA target sequence
gacacttagtgggtttcttat

SEQ ID NO: 36543 - DNA, 21 bp, Artificial sequence
  SiRNA target sequence
acacttagtgggtttcttatc

SEQ ID NO: 36544 - DNA, 21 bp, Artificial sequence
  SiRNA target sequence
cacttagtgggtttcttatca

SEQ ID NO: 36545 - DNA, 21 bp, Artificial sequence
  SiRNA target sequence
acttagtgggtttcttatcag

SEQ ID NO: 36546 - DNA, 21 bp, Artificial sequence
  SiRNA target sequence
cttagtgggtttcttatcaga

SEQ ID NO: 36547 - DNA, 21 bp, Artificial sequence
  SiRNA target sequence
ttagtgggtttcttatcagat

SEQ ID NO: 36548 - DNA, 21 bp, Artificial sequence
  SiRNA target sequence
tagtgggtttcttatcagata

SEQ ID NO: 36549 - DNA, 21 bp, Artificial sequence
  SiRNA target sequence
agtgggtttcttatcagatag

SEQ ID NO: 36550 - DNA, 21 bp, Artificial sequence
  SiRNA target sequence
gtgggtttcttatcagatagt

SEQ ID NO: 36551 - DNA, 21 bp, Artificial sequence
  SiRNA target sequence
tgggtttcttatcagatagtg

SEQ ID NO: 36552 - DNA, 21 bp, Artificial sequence
  SiRNA target sequence
gggtttcttatcagatagtga

SEQ ID NO: 36553 - DNA, 21 bp, Artificial sequence
  SiRNA target sequence
ggtttcttatcagatagtgat

SEQ ID NO: 36554 - DNA, 21 bp, Artificial sequence
  SiRNA target sequence
gtttcttatcagatagtgata

SEQ ID NO: 36555 - DNA, 21 bp, Artificial sequence
  SiRNA target sequence
tttcttatcagatagtgatac

SEQ ID NO: 36556 - DNA, 21 bp, Artificial sequence
  SiRNA target sequence
ttcttatcagatagtgataca

SEQ ID NO: 36557 - DNA, 21 bp, Artificial sequence
  SiRNA target sequence
tcttatcagatagtgatacaa

SEQ ID NO: 36558 - DNA, 21 bp, Artificial sequence
  SiRNA target sequence
cttatcagatagtgatacaat

SEQ ID NO: 36559 - DNA, 21 bp, Artificial sequence
  SiRNA target sequence
ttatcagatagtgatacaatt

SEQ ID NO: 36560 - DNA, 21 bp, Artificial sequence
  SiRNA target sequence
tatcagatagtgatacaattg

SEQ ID NO: 36561 - DNA, 21 bp, Artificial sequence
  SiRNA target sequence
atcagatagtgatacaattga

SEQ ID NO: 36562 - DNA, 21 bp, Artificial sequence
  SiRNA target sequence
tcagatagtgatacaattgaa

SEQ ID NO: 36563 - DNA, 21 bp, Artificial sequence
  SiRNA target sequence
cagatagtgatacaattgaaa

SEQ ID NO: 36564 - DNA, 21 bp, Artificial sequence
  SiRNA target sequence
agatagtgatacaattgaaat

SEQ ID NO: 36565 - DNA, 21 bp, Artificial sequence
  SiRNA target sequence
gatagtgatacaattgaaata

SEQ ID NO: 36566 - DNA, 21 bp, Artificial sequence
  SiRNA target sequence
atagtgatacaattgaaataa

SEQ ID NO: 36567 - DNA, 21 bp, Artificial sequence
  SiRNA target sequence
tagtgatacaattgaaataag

SEQ ID NO: 36568 - DNA, 21 bp, Artificial sequence
  SiRNA target sequence
agtgatacaattgaaataaga

SEQ ID NO: 36569 - DNA, 21 bp, Artificial sequence
  SiRNA target sequence
gtgatacaattgaaataagaa

SEQ ID NO: 36570 - DNA, 21 bp, Artificial sequence
  SiRNA target sequence
tgatacaattgaaataagaaa

SEQ ID NO: 36571 - DNA, 21 bp, Artificial sequence
  SiRNA target sequence
gatacaattgaaataagaaat

SEQ ID NO: 36572 - DNA, 21 bp, Artificial sequence
  SiRNA target sequence
atacaattgaaataagaaatc

SEQ ID NO: 36573 - DNA, 21 bp, Artificial sequence
  SiRNA target sequence
tacaattgaaataagaaatct

SEQ ID NO: 36574 - DNA, 21 bp, Artificial sequence
  SiRNA target sequence
acaattgaaataagaaatcta

SEQ ID NO: 36575 - DNA, 21 bp, Artificial sequence
  SiRNA target sequence
caattgaaataagaaatctat

SEQ ID NO: 36576 - DNA, 21 bp, Artificial sequence
  SiRNA target sequence
aattgaaataagaaatctatt

SEQ ID NO: 36577 - DNA, 21 bp, Artificial sequence
  SiRNA target sequence
attgaaataagaaatctattt

SEQ ID NO: 36578 - DNA, 21 bp, Artificial sequence
  SiRNA target sequence
ttgaaataagaaatctatttg

SEQ ID NO: 36579 - DNA, 21 bp, Artificial sequence
  SiRNA target sequence
tgaaataagaaatctatttga

SEQ ID NO: 36580 - DNA, 21 bp, Artificial sequence
  SiRNA target sequence
gaaataagaaatctatttgat

SEQ ID NO: 36581 - DNA, 21 bp, Artificial sequence
  SiRNA target sequence
aaataagaaatctatttgatg

SEQ ID NO: 36582 - DNA, 21 bp, Artificial sequence
  SiRNA target sequence
aataagaaatctatttgatgt

SEQ ID NO: 36583 - DNA, 21 bp, Artificial sequence
  SiRNA target sequence
ataagaaatctatttgatgta

SEQ ID NO: 36584 - DNA, 21 bp, Artificial sequence
  SiRNA target sequence
taagaaatctatttgatgtag

SEQ ID NO: 36585 - DNA, 21 bp, Artificial sequence
  SiRNA target sequence
aagaaatctatttgatgtagt

SEQ ID NO: 36586 - DNA, 21 bp, Artificial sequence
  SiRNA target sequence
agaaatctatttgatgtagtt

SEQ ID NO: 36587 - DNA, 21 bp, Artificial sequence
  SiRNA target sequence
gaaatctatttgatgtagttt

SEQ ID NO: 36588 - DNA, 21 bp, Artificial sequence
  SiRNA target sequence
aaatctatttgatgtagtttt

SEQ ID NO: 36589 - DNA, 21 bp, Artificial sequence
  SiRNA target sequence
aatctatttgatgtagttttc

SEQ ID NO: 36590 - DNA, 21 bp, Artificial sequence
  SiRNA target sequence
atctatttgatgtagttttca

SEQ ID NO: 36591 - DNA, 21 bp, Artificial sequence
  SiRNA target sequence
tctatttgatgtagttttcag

SEQ ID NO: 36592 - DNA, 21 bp, Artificial sequence
  SiRNA target sequence
ctatttgatgtagttttcaga

SEQ ID NO: 36593 - DNA, 21 bp, Artificial sequence
  SiRNA target sequence
tatttgatgtagttttcagag

SEQ ID NO: 36594 - DNA, 21 bp, Artificial sequence
  SiRNA target sequence
atttgatgtagttttcagagt

SEQ ID NO: 36595 - DNA, 21 bp, Artificial sequence
  SiRNA target sequence
tttgatgtagttttcagagta

SEQ ID NO: 36596 - DNA, 21 bp, Artificial sequence
  SiRNA target sequence
ttgatgtagttttcagagtac

SEQ ID NO: 36597 - DNA, 21 bp, Artificial sequence
  SiRNA target sequence
tgatgtagttttcagagtacc

SEQ ID NO: 36598 - DNA, 21 bp, Artificial sequence
  SiRNA target sequence
gatgtagttttcagagtacca

SEQ ID NO: 36599 - DNA, 21 bp, Artificial sequence
  SiRNA target sequence
atgtagttttcagagtaccat

SEQ ID NO: 36600 - DNA, 21 bp, Artificial sequence
  SiRNA target sequence
tgtagttttcagagtaccatg

SEQ ID NO: 36601 - DNA, 21 bp, Artificial sequence
  SiRNA target sequence
gtagttttcagagtaccatgg

SEQ ID NO: 36602 - DNA, 21 bp, Artificial sequence
  SiRNA target sequence
tagttttcagagtaccatgga

SEQ ID NO: 36603 - DNA, 21 bp, Artificial sequence
  SiRNA target sequence
agttttcagagtaccatggaa

SEQ ID NO: 36604 - DNA, 21 bp, Artificial sequence
  SiRNA target sequence
gttttcagagtaccatggaaa

SEQ ID NO: 36605 - DNA, 21 bp, Artificial sequence
  SiRNA target sequence
ttttcagagtaccatggaaag

SEQ ID NO: 36606 - DNA, 21 bp, Artificial sequence
  SiRNA target sequence
tttcagagtaccatggaaaga

SEQ ID NO: 36607 - DNA, 21 bp, Artificial sequence
  SiRNA target sequence
ttcagagtaccatggaaagac

SEQ ID NO: 36608 - DNA, 21 bp, Artificial sequence
  SiRNA target sequence
tcagagtaccatggaaagacg

SEQ ID NO: 36609 - DNA, 21 bp, Artificial sequence
  SiRNA target sequence
cagagtaccatggaaagacgt

SEQ ID NO: 36610 - DNA, 21 bp, Artificial sequence
  SiRNA target sequence
agagtaccatggaaagacgtg

SEQ ID NO: 36611 - DNA, 21 bp, Artificial sequence
  SiRNA target sequence
gagtaccatggaaagacgtga

SEQ ID NO: 36612 - DNA, 21 bp, Artificial sequence
  SiRNA target sequence
agtaccatggaaagacgtgaa

SEQ ID NO: 36613 - DNA, 21 bp, Artificial sequence
  SiRNA target sequence
gtaccatggaaagacgtgaag

SEQ ID NO: 36614 - DNA, 21 bp, Artificial sequence
  SiRNA target sequence
taccatggaaagacgtgaaga

SEQ ID NO: 36615 - DNA, 21 bp, Artificial sequence
  SiRNA target sequence
accatggaaagacgtgaagaa

SEQ ID NO: 36616 - DNA, 21 bp, Artificial sequence
  SiRNA target sequence
ccatggaaagacgtgaagaaa

SEQ ID NO: 36617 - DNA, 21 bp, Artificial sequence
  SiRNA target sequence
catggaaagacgtgaagaaag

SEQ ID NO: 36618 - DNA, 21 bp, Artificial sequence
  SiRNA target sequence
atggaaagacgtgaagaaagt

SEQ ID NO: 36619 - DNA, 21 bp, Artificial sequence
  SiRNA target sequence
tggaaagacgtgaagaaagtt

SEQ ID NO: 36620 - DNA, 21 bp, Artificial sequence
  SiRNA target sequence
ggaaagacgtgaagaaagttg

SEQ ID NO: 36621 - DNA, 21 bp, Artificial sequence
  SiRNA target sequence
gaaagacgtgaagaaagttga

SEQ ID NO: 36622 - DNA, 21 bp, Artificial sequence
  SiRNA target sequence
aaagacgtgaagaaagttgac

SEQ ID NO: 36623 - DNA, 21 bp, Artificial sequence
  SiRNA target sequence
aagacgtgaagaaagttgacg

SEQ ID NO: 36624 - DNA, 21 bp, Artificial sequence
  SiRNA target sequence
agacgtgaagaaagttgacgt

SEQ ID NO: 36625 - DNA, 21 bp, Artificial sequence
  SiRNA target sequence
gacgtgaagaaagttgacgta

SEQ ID NO: 36626 - DNA, 21 bp, Artificial sequence
  SiRNA target sequence
acgtgaagaaagttgacgtag

SEQ ID NO: 36627 - DNA, 21 bp, Artificial sequence
  SiRNA target sequence
cgtgaagaaagttgacgtagt

SEQ ID NO: 36628 - DNA, 21 bp, Artificial sequence
  SiRNA target sequence
gtgaagaaagttgacgtagta

SEQ ID NO: 36629 - DNA, 21 bp, Artificial sequence
  SiRNA target sequence
tgaagaaagttgacgtagtaa

SEQ ID NO: 36630 - DNA, 21 bp, Artificial sequence
  SiRNA target sequence
gaagaaagttgacgtagtaaa

SEQ ID NO: 36631 - DNA, 21 bp, Artificial sequence
  SiRNA target sequence
aagaaagttgacgtagtaaac

SEQ ID NO: 36632 - DNA, 21 bp, Artificial sequence
  SiRNA target sequence
agaaagttgacgtagtaaacg

SEQ ID NO: 36633 - DNA, 21 bp, Artificial sequence
  SiRNA target sequence
gaaagttgacgtagtaaacgc

SEQ ID NO: 36634 - DNA, 21 bp, Artificial sequence
  SiRNA target sequence
aaagttgacgtagtaaacgcc

SEQ ID NO: 36635 - DNA, 21 bp, Artificial sequence
  SiRNA target sequence
aagttgacgtagtaaacgcct

SEQ ID NO: 36636 - DNA, 21 bp, Artificial sequence
  SiRNA target sequence
agttgacgtagtaaacgcctt

SEQ ID NO: 36637 - DNA, 21 bp, Artificial sequence
  SiRNA target sequence
gttgacgtagtaaacgccttc

SEQ ID NO: 36638 - DNA, 21 bp, Artificial sequence
  SiRNA target sequence
ttgacgtagtaaacgccttcg

SEQ ID NO: 36639 - DNA, 21 bp, Artificial sequence
  SiRNA target sequence
tgacgtagtaaacgccttcgg

SEQ ID NO: 36640 - DNA, 21 bp, Artificial sequence
  SiRNA target sequence
gacgtagtaaacgccttcggt

SEQ ID NO: 36641 - DNA, 21 bp, Artificial sequence
  SiRNA target sequence
acgtagtaaacgccttcggtg

SEQ ID NO: 36642 - DNA, 21 bp, Artificial sequence
  SiRNA target sequence
cgtagtaaacgccttcggtga

SEQ ID NO: 36643 - DNA, 21 bp, Artificial sequence
  SiRNA target sequence
gtagtaaacgccttcggtgag

SEQ ID NO: 36644 - DNA, 21 bp, Artificial sequence
  SiRNA target sequence
tagtaaacgccttcggtgaga

SEQ ID NO: 36645 - DNA, 21 bp, Artificial sequence
  SiRNA target sequence
agtaaacgccttcggtgagag

SEQ ID NO: 36646 - DNA, 21 bp, Artificial sequence
  SiRNA target sequence
gtaaacgccttcggtgagagc

SEQ ID NO: 36647 - DNA, 21 bp, Artificial sequence
  SiRNA target sequence
taaacgccttcggtgagagca

SEQ ID NO: 36648 - DNA, 21 bp, Artificial sequence
  SiRNA target sequence
aaacgccttcggtgagagcaa

SEQ ID NO: 36649 - DNA, 21 bp, Artificial sequence
  SiRNA target sequence
aacgccttcggtgagagcaaa

SEQ ID NO: 36650 - DNA, 21 bp, Artificial sequence
  SiRNA target sequence
acgccttcggtgagagcaaag

SEQ ID NO: 36651 - DNA, 21 bp, Artificial sequence
  SiRNA target sequence
cgccttcggtgagagcaaaga

SEQ ID NO: 36652 - DNA, 21 bp, Artificial sequence
  SiRNA target sequence
gccttcggtgagagcaaagaa

SEQ ID NO: 36653 - DNA, 21 bp, Artificial sequence
  SiRNA target sequence
ccttcggtgagagcaaagaag

SEQ ID NO: 36654 - DNA, 21 bp, Artificial sequence
  SiRNA target sequence
cttcggtgagagcaaagaagc

SEQ ID NO: 36655 - DNA, 21 bp, Artificial sequence
  SiRNA target sequence
ttcggtgagagcaaagaagcg

SEQ ID NO: 36656 - DNA, 21 bp, Artificial sequence
  SiRNA target sequence
tcggtgagagcaaagaagcgg

SEQ ID NO: 36657 - DNA, 21 bp, Artificial sequence
  SiRNA target sequence
cggtgagagcaaagaagcggt

SEQ ID NO: 36658 - DNA, 21 bp, Artificial sequence
  SiRNA target sequence
ggtgagagcaaagaagcggtt

SEQ ID NO: 36659 - DNA, 21 bp, Artificial sequence
  SiRNA target sequence
gtgagagcaaagaagcggttt

SEQ ID NO: 36660 - DNA, 21 bp, Artificial sequence
  SiRNA target sequence
tgagagcaaagaagcggtttt

SEQ ID NO: 36661 - DNA, 21 bp, Artificial sequence
  SiRNA target sequence
gagagcaaagaagcggttttg

SEQ ID NO: 36662 - DNA, 21 bp, Artificial sequence
  SiRNA target sequence
agagcaaagaagcggttttgt

SEQ ID NO: 36663 - DNA, 21 bp, Artificial sequence
  SiRNA target sequence
gagcaaagaagcggttttgtt

SEQ ID NO: 36664 - DNA, 21 bp, Artificial sequence
  SiRNA target sequence
agcaaagaagcggttttgtta

SEQ ID NO: 36665 - DNA, 21 bp, Artificial sequence
  SiRNA target sequence
gcaaagaagcggttttgttat

SEQ ID NO: 36666 - DNA, 21 bp, Artificial sequence
  SiRNA target sequence
caaagaagcggttttgttatg

SEQ ID NO: 36667 - DNA, 21 bp, Artificial sequence
  SiRNA target sequence
aaagaagcggttttgttatgt

SEQ ID NO: 36668 - DNA, 21 bp, Artificial sequence
  SiRNA target sequence
aagaagcggttttgttatgtt

SEQ ID NO: 36669 - DNA, 21 bp, Artificial sequence
  SiRNA target sequence
agaagcggttttgttatgttt

SEQ ID NO: 36670 - DNA, 21 bp, Artificial sequence
  SiRNA target sequence
gaagcggttttgttatgtttt

SEQ ID NO: 36671 - DNA, 21 bp, Artificial sequence
  SiRNA target sequence
aagcggttttgttatgttttc

SEQ ID NO: 36672 - DNA, 21 bp, Artificial sequence
  SiRNA target sequence
agcggttttgttatgttttcc

SEQ ID NO: 36673 - DNA, 21 bp, Artificial sequence
  SiRNA target sequence
gcggttttgttatgttttccg

SEQ ID NO: 36674 - DNA, 21 bp, Artificial sequence
  SiRNA target sequence
cggttttgttatgttttccga

SEQ ID NO: 36675 - DNA, 21 bp, Artificial sequence
  SiRNA target sequence
ggttttgttatgttttccgaa

SEQ ID NO: 36676 - DNA, 21 bp, Artificial sequence
  SiRNA target sequence
gttttgttatgttttccgaaa

SEQ ID NO: 36677 - DNA, 21 bp, Artificial sequence
  SiRNA target sequence
ttttgttatgttttccgaaat

SEQ ID NO: 36678 - DNA, 21 bp, Artificial sequence
  SiRNA target sequence
tttgttatgttttccgaaatt

SEQ ID NO: 36679 - DNA, 21 bp, Artificial sequence
  SiRNA target sequence
ttgttatgttttccgaaattt

SEQ ID NO: 36680 - DNA, 21 bp, Artificial sequence
  SiRNA target sequence
tgttatgttttccgaaatttg

SEQ ID NO: 36681 - DNA, 21 bp, Artificial sequence
  SiRNA target sequence
gttatgttttccgaaatttgt

SEQ ID NO: 36682 - DNA, 21 bp, Artificial sequence
  SiRNA target sequence
ttatgttttccgaaatttgta

SEQ ID NO: 36683 - DNA, 21 bp, Artificial sequence
  SiRNA target sequence
tatgttttccgaaatttgtat

SEQ ID NO: 36684 - DNA, 21 bp, Artificial sequence
  SiRNA target sequence
atgttttccgaaatttgtatg

SEQ ID NO: 36685 - DNA, 21 bp, Artificial sequence
  SiRNA target sequence
tgttttccgaaatttgtatgt

SEQ ID NO: 36686 - DNA, 21 bp, Artificial sequence
  SiRNA target sequence
gttttccgaaatttgtatgtc

SEQ ID NO: 36687 - DNA, 21 bp, Artificial sequence
  SiRNA target sequence
ttttccgaaatttgtatgtca

SEQ ID NO: 36688 - DNA, 21 bp, Artificial sequence
  SiRNA target sequence
tttccgaaatttgtatgtcaa

SEQ ID NO: 36689 - DNA, 21 bp, Artificial sequence
  SiRNA target sequence
ttccgaaatttgtatgtcaac

SEQ ID NO: 36690 - DNA, 21 bp, Artificial sequence
  SiRNA target sequence
tccgaaatttgtatgtcaaca

SEQ ID NO: 36691 - DNA, 21 bp, Artificial sequence
  SiRNA target sequence
ccgaaatttgtatgtcaacac

SEQ ID NO: 36692 - DNA, 21 bp, Artificial sequence
  SiRNA target sequence
cgaaatttgtatgtcaacaca

SEQ ID NO: 36693 - DNA, 21 bp, Artificial sequence
  SiRNA target sequence
gaaatttgtatgtcaacacac

SEQ ID NO: 36694 - DNA, 21 bp, Artificial sequence
  SiRNA target sequence
aaatttgtatgtcaacacacg

SEQ ID NO: 36695 - DNA, 21 bp, Artificial sequence
  SiRNA target sequence
aatttgtatgtcaacacacgg

SEQ ID NO: 36696 - DNA, 21 bp, Artificial sequence
  SiRNA target sequence
atttgtatgtcaacacacgga

SEQ ID NO: 36697 - DNA, 21 bp, Artificial sequence
  SiRNA target sequence
tttgtatgtcaacacacggat

SEQ ID NO: 36698 - DNA, 21 bp, Artificial sequence
  SiRNA target sequence
ttgtatgtcaacacacggatt

SEQ ID NO: 36699 - DNA, 21 bp, Artificial sequence
  SiRNA target sequence
tgtatgtcaacacacggattt

SEQ ID NO: 36700 - DNA, 21 bp, Artificial sequence
  SiRNA target sequence
gtatgtcaacacacggatttg

SEQ ID NO: 36701 - DNA, 21 bp, Artificial sequence
  SiRNA target sequence
tatgtcaacacacggatttgg

SEQ ID NO: 36702 - DNA, 21 bp, Artificial sequence
  SiRNA target sequence
atgtcaacacacggatttggt

SEQ ID NO: 36703 - DNA, 21 bp, Artificial sequence
  SiRNA target sequence
tgtcaacacacggatttggtg

SEQ ID NO: 36704 - DNA, 21 bp, Artificial sequence
  SiRNA target sequence
gtcaacacacggatttggtga

SEQ ID NO: 36705 - DNA, 21 bp, Artificial sequence
  SiRNA target sequence
tcaacacacggatttggtgaa

SEQ ID NO: 36706 - DNA, 21 bp, Artificial sequence
  SiRNA target sequence
caacacacggatttggtgaag

SEQ ID NO: 36707 - DNA, 21 bp, Artificial sequence
  SiRNA target sequence
aacacacggatttggtgaagc

SEQ ID NO: 36708 - DNA, 21 bp, Artificial sequence
  SiRNA target sequence
acacacggatttggtgaagca

SEQ ID NO: 36709 - DNA, 21 bp, Artificial sequence
  SiRNA target sequence
cacacggatttggtgaagcat

SEQ ID NO: 36710 - DNA, 21 bp, Artificial sequence
  SiRNA target sequence
acacggatttggtgaagcatt

SEQ ID NO: 36711 - DNA, 21 bp, Artificial sequence
  SiRNA target sequence
cacggatttggtgaagcattt

SEQ ID NO: 36712 - DNA, 21 bp, Artificial sequence
  SiRNA target sequence
acggatttggtgaagcatttt

SEQ ID NO: 36713 - DNA, 21 bp, Artificial sequence
  SiRNA target sequence
cggatttggtgaagcattttc

SEQ ID NO: 36714 - DNA, 21 bp, Artificial sequence
  SiRNA target sequence
ggatttggtgaagcattttca

SEQ ID NO: 36715 - DNA, 21 bp, Artificial sequence
  SiRNA target sequence
gatttggtgaagcattttcaa

SEQ ID NO: 36716 - DNA, 21 bp, Artificial sequence
  SiRNA target sequence
atttggtgaagcattttcaag

SEQ ID NO: 36717 - DNA, 21 bp, Artificial sequence
  SiRNA target sequence
tttggtgaagcattttcaaga

SEQ ID NO: 36718 - DNA, 21 bp, Artificial sequence
  SiRNA target sequence
ttggtgaagcattttcaagat

SEQ ID NO: 36719 - DNA, 21 bp, Artificial sequence
  SiRNA target sequence
tggtgaagcattttcaagatt

SEQ ID NO: 36720 - DNA, 21 bp, Artificial sequence
  SiRNA target sequence
ggtgaagcattttcaagattc

SEQ ID NO: 36721 - DNA, 21 bp, Artificial sequence
  SiRNA target sequence
gtgaagcattttcaagattca

SEQ ID NO: 36722 - DNA, 21 bp, Artificial sequence
  SiRNA target sequence
tgaagcattttcaagattcag

SEQ ID NO: 36723 - DNA, 21 bp, Artificial sequence
  SiRNA target sequence
gaagcattttcaagattcaga

SEQ ID NO: 36724 - DNA, 21 bp, Artificial sequence
  SiRNA target sequence
aagcattttcaagattcagaa

SEQ ID NO: 36725 - DNA, 21 bp, Artificial sequence
  SiRNA target sequence
agcattttcaagattcagaat

SEQ ID NO: 36726 - DNA, 21 bp, Artificial sequence
  SiRNA target sequence
gcattttcaagattcagaatc

SEQ ID NO: 36727 - DNA, 21 bp, Artificial sequence
  SiRNA target sequence
cattttcaagattcagaatct

SEQ ID NO: 36728 - DNA, 21 bp, Artificial sequence
  SiRNA target sequence
attttcaagattcagaatcta

SEQ ID NO: 36729 - DNA, 21 bp, Artificial sequence
  SiRNA target sequence
ttttcaagattcagaatctat

SEQ ID NO: 36730 - DNA, 21 bp, Artificial sequence
  SiRNA target sequence
tttcaagattcagaatctatg

SEQ ID NO: 36731 - DNA, 21 bp, Artificial sequence
  SiRNA target sequence
ttcaagattcagaatctatgt

SEQ ID NO: 36732 - DNA, 21 bp, Artificial sequence
  SiRNA target sequence
tcaagattcagaatctatgtc

SEQ ID NO: 36733 - DNA, 21 bp, Artificial sequence
  SiRNA target sequence
caagattcagaatctatgtca

SEQ ID NO: 36734 - DNA, 21 bp, Artificial sequence
  SiRNA target sequence
aagattcagaatctatgtcaa

SEQ ID NO: 36735 - DNA, 21 bp, Artificial sequence
  SiRNA target sequence
agattcagaatctatgtcaaa

SEQ ID NO: 36736 - DNA, 21 bp, Artificial sequence
  SiRNA target sequence
gattcagaatctatgtcaaaa

SEQ ID NO: 36737 - DNA, 21 bp, Artificial sequence
  SiRNA target sequence
attcagaatctatgtcaaaat

SEQ ID NO: 36738 - DNA, 21 bp, Artificial sequence
  SiRNA target sequence
ttcagaatctatgtcaaaatt

SEQ ID NO: 36739 - DNA, 21 bp, Artificial sequence
  SiRNA target sequence
tcagaatctatgtcaaaattc

SEQ ID NO: 36740 - DNA, 21 bp, Artificial sequence
  SiRNA target sequence
cagaatctatgtcaaaattca

SEQ ID NO: 36741 - DNA, 21 bp, Artificial sequence
  SiRNA target sequence
agaatctatgtcaaaattcaa

SEQ ID NO: 36742 - DNA, 21 bp, Artificial sequence
  SiRNA target sequence
gaatctatgtcaaaattcaaa

SEQ ID NO: 36743 - DNA, 21 bp, Artificial sequence
  SiRNA target sequence
aatctatgtcaaaattcaaaa

SEQ ID NO: 36744 - DNA, 21 bp, Artificial sequence
  SiRNA target sequence
atctatgtcaaaattcaaaag

SEQ ID NO: 36745 - DNA, 21 bp, Artificial sequence
  SiRNA target sequence
tctatgtcaaaattcaaaaga

SEQ ID NO: 36746 - DNA, 21 bp, Artificial sequence
  SiRNA target sequence
ctatgtcaaaattcaaaagat

SEQ ID NO: 36747 - DNA, 21 bp, Artificial sequence
  SiRNA target sequence
tatgtcaaaattcaaaagatg

SEQ ID NO: 36748 - DNA, 21 bp, Artificial sequence
  SiRNA target sequence
atgtcaaaattcaaaagatgt

SEQ ID NO: 36749 - DNA, 21 bp, Artificial sequence
  SiRNA target sequence
tgtcaaaattcaaaagatgtg

SEQ ID NO: 36750 - DNA, 21 bp, Artificial sequence
  SiRNA target sequence
gtcaaaattcaaaagatgtga

SEQ ID NO: 36751 - DNA, 21 bp, Artificial sequence
  SiRNA target sequence
tcaaaattcaaaagatgtgag

SEQ ID NO: 36752 - DNA, 21 bp, Artificial sequence
  SiRNA target sequence
caaaattcaaaagatgtgagg

SEQ ID NO: 36753 - DNA, 21 bp, Artificial sequence
  SiRNA target sequence
aaaattcaaaagatgtgaggt

SEQ ID NO: 36754 - DNA, 21 bp, Artificial sequence
  SiRNA target sequence
aaattcaaaagatgtgaggtc

SEQ ID NO: 36755 - DNA, 21 bp, Artificial sequence
  SiRNA target sequence
aattcaaaagatgtgaggtca

SEQ ID NO: 36756 - DNA, 21 bp, Artificial sequence
  SiRNA target sequence
attcaaaagatgtgaggtcac

SEQ ID NO: 36757 - DNA, 21 bp, Artificial sequence
  SiRNA target sequence
ttcaaaagatgtgaggtcact

SEQ ID NO: 36758 - DNA, 21 bp, Artificial sequence
  SiRNA target sequence
tcaaaagatgtgaggtcactc

SEQ ID NO: 36759 - DNA, 21 bp, Artificial sequence
  SiRNA target sequence
caaaagatgtgaggtcactct

SEQ ID NO: 36760 - DNA, 21 bp, Artificial sequence
  SiRNA target sequence
aaaagatgtgaggtcactctt

SEQ ID NO: 36761 - DNA, 21 bp, Artificial sequence
  SiRNA target sequence
aaagatgtgaggtcactcttc

SEQ ID NO: 36762 - DNA, 21 bp, Artificial sequence
  SiRNA target sequence
aagatgtgaggtcactcttcc

SEQ ID NO: 36763 - DNA, 21 bp, Artificial sequence
  SiRNA target sequence
agatgtgaggtcactcttcca

SEQ ID NO: 36764 - DNA, 21 bp, Artificial sequence
  SiRNA target sequence
gatgtgaggtcactcttccag

SEQ ID NO: 36765 - DNA, 21 bp, Artificial sequence
  SiRNA target sequence
atgtgaggtcactcttccagt

SEQ ID NO: 36766 - DNA, 21 bp, Artificial sequence
  SiRNA target sequence
tgtgaggtcactcttccagtg

SEQ ID NO: 36767 - DNA, 21 bp, Artificial sequence
  SiRNA target sequence
gtgaggtcactcttccagtgt

SEQ ID NO: 36768 - DNA, 21 bp, Artificial sequence
  SiRNA target sequence
tgaggtcactcttccagtgtt

SEQ ID NO: 36769 - DNA, 21 bp, Artificial sequence
  SiRNA target sequence
gaggtcactcttccagtgttg

SEQ ID NO: 36770 - DNA, 21 bp, Artificial sequence
  SiRNA target sequence
aggtcactcttccagtgttga

SEQ ID NO: 36771 - DNA, 21 bp, Artificial sequence
  SiRNA target sequence
ggtcactcttccagtgttgag

SEQ ID NO: 36772 - DNA, 21 bp, Artificial sequence
  SiRNA target sequence
gtcactcttccagtgttgaga

SEQ ID NO: 36773 - DNA, 21 bp, Artificial sequence
  SiRNA target sequence
tcactcttccagtgttgagat

SEQ ID NO: 36774 - DNA, 21 bp, Artificial sequence
  SiRNA target sequence
cactcttccagtgttgagata

SEQ ID NO: 36775 - DNA, 21 bp, Artificial sequence
  SiRNA target sequence
actcttccagtgttgagatat

SEQ ID NO: 36776 - DNA, 21 bp, Artificial sequence
  SiRNA target sequence
ctcttccagtgttgagatatt

SEQ ID NO: 36777 - DNA, 21 bp, Artificial sequence
  SiRNA target sequence
tcttccagtgttgagatattc

SEQ ID NO: 36778 - DNA, 21 bp, Artificial sequence
  SiRNA target sequence
cttccagtgttgagatattca

SEQ ID NO: 36779 - DNA, 21 bp, Artificial sequence
  SiRNA target sequence
ttccagtgttgagatattcag

SEQ ID NO: 36780 - DNA, 21 bp, Artificial sequence
  SiRNA target sequence
tccagtgttgagatattcaga

SEQ ID NO: 36781 - DNA, 21 bp, Artificial sequence
  SiRNA target sequence
ccagtgttgagatattcagat

SEQ ID NO: 36782 - DNA, 21 bp, Artificial sequence
  SiRNA target sequence
cagtgttgagatattcagata

SEQ ID NO: 36783 - DNA, 21 bp, Artificial sequence
  SiRNA target sequence
agtgttgagatattcagataa

SEQ ID NO: 36784 - DNA, 21 bp, Artificial sequence
  SiRNA target sequence
gtgttgagatattcagataaa

SEQ ID NO: 36785 - DNA, 21 bp, Artificial sequence
  SiRNA target sequence
tgttgagatattcagataaaa

SEQ ID NO: 36786 - DNA, 21 bp, Artificial sequence
  SiRNA target sequence
gttgagatattcagataaaat

SEQ ID NO: 36787 - DNA, 21 bp, Artificial sequence
  SiRNA target sequence
ttgagatattcagataaaatg

SEQ ID NO: 36788 - DNA, 21 bp, Artificial sequence
  SiRNA target sequence
tgagatattcagataaaatga

SEQ ID NO: 36789 - DNA, 21 bp, Artificial sequence
  SiRNA target sequence
gagatattcagataaaatgaa

SEQ ID NO: 36790 - DNA, 21 bp, Artificial sequence
  SiRNA target sequence
agatattcagataaaatgaat

SEQ ID NO: 36791 - DNA, 21 bp, Artificial sequence
  SiRNA target sequence
gatattcagataaaatgaata

SEQ ID NO: 36792 - DNA, 21 bp, Artificial sequence
  SiRNA target sequence
atattcagataaaatgaatag

SEQ ID NO: 36793 - DNA, 21 bp, Artificial sequence
  SiRNA target sequence
tattcagataaaatgaataga

SEQ ID NO: 36794 - DNA, 21 bp, Artificial sequence
  SiRNA target sequence
attcagataaaatgaatagat

SEQ ID NO: 36795 - DNA, 21 bp, Artificial sequence
  SiRNA target sequence
ttcagataaaatgaatagatt

SEQ ID NO: 36796 - DNA, 21 bp, Artificial sequence
  SiRNA target sequence
tcagataaaatgaatagattt

SEQ ID NO: 36797 - DNA, 21 bp, Artificial sequence
  SiRNA target sequence
cagataaaatgaatagatttt

SEQ ID NO: 36798 - DNA, 21 bp, Artificial sequence
  SiRNA target sequence
agataaaatgaatagattttt

SEQ ID NO: 36799 - DNA, 21 bp, Artificial sequence
  SiRNA target sequence
gataaaatgaatagattttta

SEQ ID NO: 36800 - DNA, 21 bp, Artificial sequence
  SiRNA target sequence
ataaaatgaatagatttttag

SEQ ID NO: 36801 - DNA, 21 bp, Artificial sequence
  SiRNA target sequence
taaaatgaatagatttttagc

SEQ ID NO: 36802 - DNA, 21 bp, Artificial sequence
  SiRNA target sequence
aaaatgaatagatttttagca

SEQ ID NO: 36803 - DNA, 21 bp, Artificial sequence
  SiRNA target sequence
aaatgaatagatttttagcaa

SEQ ID NO: 36804 - DNA, 21 bp, Artificial sequence
  SiRNA target sequence
aatgaatagatttttagcaac

SEQ ID NO: 36805 - DNA, 21 bp, Artificial sequence
  SiRNA target sequence
atgaatagatttttagcaaca

SEQ ID NO: 36806 - DNA, 21 bp, Artificial sequence
  SiRNA target sequence
tgaatagatttttagcaacat

SEQ ID NO: 36807 - DNA, 21 bp, Artificial sequence
  SiRNA target sequence
gaatagatttttagcaacatt

SEQ ID NO: 36808 - DNA, 21 bp, Artificial sequence
  SiRNA target sequence
aatagatttttagcaacatta

SEQ ID NO: 36809 - DNA, 21 bp, Artificial sequence
  SiRNA target sequence
atagatttttagcaacattaa

SEQ ID NO: 36810 - DNA, 21 bp, Artificial sequence
  SiRNA target sequence
tagatttttagcaacattaat

SEQ ID NO: 36811 - DNA, 21 bp, Artificial sequence
  SiRNA target sequence
agatttttagcaacattaata

SEQ ID NO: 36812 - DNA, 21 bp, Artificial sequence
  SiRNA target sequence
gatttttagcaacattaatag

SEQ ID NO: 36813 - DNA, 21 bp, Artificial sequence
  SiRNA target sequence
atttttagcaacattaataga

SEQ ID NO: 36814 - DNA, 21 bp, Artificial sequence
  SiRNA target sequence
tttttagcaacattaatagaa

SEQ ID NO: 36815 - DNA, 21 bp, Artificial sequence
  SiRNA target sequence
ttttagcaacattaatagaat

SEQ ID NO: 36816 - DNA, 21 bp, Artificial sequence
  SiRNA target sequence
tttagcaacattaatagaatg

SEQ ID NO: 36817 - DNA, 21 bp, Artificial sequence
  SiRNA target sequence
ttagcaacattaatagaatgt

SEQ ID NO: 36818 - DNA, 21 bp, Artificial sequence
  SiRNA target sequence
tagcaacattaatagaatgtg

SEQ ID NO: 36819 - DNA, 21 bp, Artificial sequence
  SiRNA target sequence
agcaacattaatagaatgtga

SEQ ID NO: 36820 - DNA, 21 bp, Artificial sequence
  SiRNA target sequence
gcaacattaatagaatgtgac

SEQ ID NO: 36821 - DNA, 21 bp, Artificial sequence
  SiRNA target sequence
caacattaatagaatgtgaca

SEQ ID NO: 36822 - DNA, 21 bp, Artificial sequence
  SiRNA target sequence
aacattaatagaatgtgacaa

SEQ ID NO: 36823 - DNA, 21 bp, Artificial sequence
  SiRNA target sequence
acattaatagaatgtgacaaa

SEQ ID NO: 36824 - DNA, 21 bp, Artificial sequence
  SiRNA target sequence
cattaatagaatgtgacaaag

SEQ ID NO: 36825 - DNA, 21 bp, Artificial sequence
  SiRNA target sequence
attaatagaatgtgacaaagt

SEQ ID NO: 36826 - DNA, 21 bp, Artificial sequence
  SiRNA target sequence
ttaatagaatgtgacaaagtt

SEQ ID NO: 36827 - DNA, 21 bp, Artificial sequence
  SiRNA target sequence
taatagaatgtgacaaagttg

SEQ ID NO: 36828 - DNA, 21 bp, Artificial sequence
  SiRNA target sequence
aatagaatgtgacaaagttga

SEQ ID NO: 36829 - DNA, 21 bp, Artificial sequence
  SiRNA target sequence
atagaatgtgacaaagttgaa

SEQ ID NO: 36830 - DNA, 21 bp, Artificial sequence
  SiRNA target sequence
tagaatgtgacaaagttgaag

SEQ ID NO: 36831 - DNA, 21 bp, Artificial sequence
  SiRNA target sequence
agaatgtgacaaagttgaagc

SEQ ID NO: 36832 - DNA, 21 bp, Artificial sequence
  SiRNA target sequence
gaatgtgacaaagttgaagct

SEQ ID NO: 36833 - DNA, 21 bp, Artificial sequence
  SiRNA target sequence
aatgtgacaaagttgaagctt

SEQ ID NO: 36834 - DNA, 21 bp, Artificial sequence
  SiRNA target sequence
atgtgacaaagttgaagctta

SEQ ID NO: 36835 - DNA, 21 bp, Artificial sequence
  SiRNA target sequence
tgtgacaaagttgaagcttat

SEQ ID NO: 36836 - DNA, 21 bp, Artificial sequence
  SiRNA target sequence
gtgacaaagttgaagcttatg

SEQ ID NO: 36837 - DNA, 21 bp, Artificial sequence
  SiRNA target sequence
tgacaaagttgaagcttatga

SEQ ID NO: 36838 - DNA, 21 bp, Artificial sequence
  SiRNA target sequence
gacaaagttgaagcttatgat

SEQ ID NO: 36839 - DNA, 21 bp, Artificial sequence
  SiRNA target sequence
acaaagttgaagcttatgata

SEQ ID NO: 36840 - DNA, 21 bp, Artificial sequence
  SiRNA target sequence
caaagttgaagcttatgatag

SEQ ID NO: 36841 - DNA, 21 bp, Artificial sequence
  SiRNA target sequence
aaagttgaagcttatgataga

SEQ ID NO: 36842 - DNA, 21 bp, Artificial sequence
  SiRNA target sequence
aagttgaagcttatgatagac

SEQ ID NO: 36843 - DNA, 21 bp, Artificial sequence
  SiRNA target sequence
agttgaagcttatgatagacc

SEQ ID NO: 36844 - DNA, 21 bp, Artificial sequence
  SiRNA target sequence
gttgaagcttatgatagacca

SEQ ID NO: 36845 - DNA, 21 bp, Artificial sequence
  SiRNA target sequence
ttgaagcttatgatagaccat

SEQ ID NO: 36846 - DNA, 21 bp, Artificial sequence
  SiRNA target sequence
tgaagcttatgatagaccata

SEQ ID NO: 36847 - DNA, 21 bp, Artificial sequence
  SiRNA target sequence
gaagcttatgatagaccatac

SEQ ID NO: 36848 - DNA, 21 bp, Artificial sequence
  SiRNA target sequence
aagcttatgatagaccataca

SEQ ID NO: 36849 - DNA, 21 bp, Artificial sequence
  SiRNA target sequence
agcttatgatagaccatacac

SEQ ID NO: 36850 - DNA, 21 bp, Artificial sequence
  SiRNA target sequence
gcttatgatagaccatacact

SEQ ID NO: 36851 - DNA, 21 bp, Artificial sequence
  SiRNA target sequence
cttatgatagaccatacactt

SEQ ID NO: 36852 - DNA, 21 bp, Artificial sequence
  SiRNA target sequence
ttatgatagaccatacacttt

SEQ ID NO: 36853 - DNA, 21 bp, Artificial sequence
  SiRNA target sequence
tatgatagaccatacacttta

SEQ ID NO: 36854 - DNA, 21 bp, Artificial sequence
  SiRNA target sequence
atgatagaccatacactttaa

SEQ ID NO: 36855 - DNA, 21 bp, Artificial sequence
  SiRNA target sequence
tgatagaccatacactttaaa

SEQ ID NO: 36856 - DNA, 21 bp, Artificial sequence
  SiRNA target sequence
gatagaccatacactttaaat

SEQ ID NO: 36857 - DNA, 21 bp, Artificial sequence
  SiRNA target sequence
atagaccatacactttaaatg

SEQ ID NO: 36858 - DNA, 21 bp, Artificial sequence
  SiRNA target sequence
tagaccatacactttaaatga

SEQ ID NO: 36859 - DNA, 21 bp, Artificial sequence
  SiRNA target sequence
agaccatacactttaaatgac

SEQ ID NO: 36860 - DNA, 21 bp, Artificial sequence
  SiRNA target sequence
gaccatacactttaaatgact

SEQ ID NO: 36861 - DNA, 21 bp, Artificial sequence
  SiRNA target sequence
accatacactttaaatgactc

SEQ ID NO: 36862 - DNA, 21 bp, Artificial sequence
  SiRNA target sequence
ccatacactttaaatgactca

SEQ ID NO: 36863 - DNA, 21 bp, Artificial sequence
  SiRNA target sequence
catacactttaaatgactcat

SEQ ID NO: 36864 - DNA, 21 bp, Artificial sequence
  SiRNA target sequence
atacactttaaatgactcatc

SEQ ID NO: 36865 - DNA, 21 bp, Artificial sequence
  SiRNA target sequence
tacactttaaatgactcatca

SEQ ID NO: 36866 - DNA, 21 bp, Artificial sequence
  SiRNA target sequence
acactttaaatgactcatcaa

SEQ ID NO: 36867 - DNA, 21 bp, Artificial sequence
  SiRNA target sequence
cactttaaatgactcatcaaa

SEQ ID NO: 36868 - DNA, 21 bp, Artificial sequence
  SiRNA target sequence
actttaaatgactcatcaaaa

SEQ ID NO: 36869 - DNA, 21 bp, Artificial sequence
  SiRNA target sequence
ctttaaatgactcatcaaaag

SEQ ID NO: 36870 - DNA, 21 bp, Artificial sequence
  SiRNA target sequence
tttaaatgactcatcaaaagg

SEQ ID NO: 36871 - DNA, 21 bp, Artificial sequence
  SiRNA target sequence
ttaaatgactcatcaaaagga

SEQ ID NO: 36872 - DNA, 21 bp, Artificial sequence
  SiRNA target sequence
taaatgactcatcaaaaggac

SEQ ID NO: 36873 - DNA, 21 bp, Artificial sequence
  SiRNA target sequence
aaatgactcatcaaaaggaca

SEQ ID NO: 36874 - DNA, 21 bp, Artificial sequence
  SiRNA target sequence
aatgactcatcaaaaggacaa

SEQ ID NO: 36875 - DNA, 21 bp, Artificial sequence
  SiRNA target sequence
atgactcatcaaaaggacaat

SEQ ID NO: 36876 - DNA, 21 bp, Artificial sequence
  SiRNA target sequence
tgactcatcaaaaggacaata

SEQ ID NO: 36877 - DNA, 21 bp, Artificial sequence
  SiRNA target sequence
gactcatcaaaaggacaatat

SEQ ID NO: 36878 - DNA, 21 bp, Artificial sequence
  SiRNA target sequence
actcatcaaaaggacaatata

SEQ ID NO: 36879 - DNA, 21 bp, Artificial sequence
  SiRNA target sequence
ctcatcaaaaggacaatatat

SEQ ID NO: 36880 - DNA, 21 bp, Artificial sequence
  SiRNA target sequence
tcatcaaaaggacaatatata

SEQ ID NO: 36881 - DNA, 21 bp, Artificial sequence
  SiRNA target sequence
catcaaaaggacaatatatat

SEQ ID NO: 36882 - DNA, 21 bp, Artificial sequence
  SiRNA target sequence
atcaaaaggacaatatatatt

SEQ ID NO: 36883 - DNA, 21 bp, Artificial sequence
  SiRNA target sequence
tcaaaaggacaatatatatta

SEQ ID NO: 36884 - DNA, 21 bp, Artificial sequence
  SiRNA target sequence
caaaaggacaatatatattaa

SEQ ID NO: 36885 - DNA, 21 bp, Artificial sequence
  SiRNA target sequence
aaaaggacaatatatattaag

SEQ ID NO: 36886 - DNA, 21 bp, Artificial sequence
  SiRNA target sequence
aaaggacaatatatattaaga

SEQ ID NO: 36887 - DNA, 21 bp, Artificial sequence
  SiRNA target sequence
aaggacaatatatattaagac

SEQ ID NO: 36888 - DNA, 21 bp, Artificial sequence
  SiRNA target sequence
aggacaatatatattaagaca

SEQ ID NO: 36889 - DNA, 21 bp, Artificial sequence
  SiRNA target sequence
ggacaatatatattaagacaa

SEQ ID NO: 36890 - DNA, 21 bp, Artificial sequence
  SiRNA target sequence
gacaatatatattaagacaag

SEQ ID NO: 36891 - DNA, 21 bp, Artificial sequence
  SiRNA target sequence
acaatatatattaagacaagg

SEQ ID NO: 36892 - DNA, 21 bp, Artificial sequence
  SiRNA target sequence
caatatatattaagacaagga

SEQ ID NO: 36893 - DNA, 21 bp, Artificial sequence
  SiRNA target sequence
aatatatattaagacaaggat

SEQ ID NO: 36894 - DNA, 21 bp, Artificial sequence
  SiRNA target sequence
atatatattaagacaaggatt

SEQ ID NO: 36895 - DNA, 21 bp, Artificial sequence
  SiRNA target sequence
tatatattaagacaaggattg

SEQ ID NO: 36896 - DNA, 21 bp, Artificial sequence
  SiRNA target sequence
atatattaagacaaggattgg

SEQ ID NO: 36897 - DNA, 21 bp, Artificial sequence
  SiRNA target sequence
tatattaagacaaggattgga

SEQ ID NO: 36898 - DNA, 21 bp, Artificial sequence
  SiRNA target sequence
atattaagacaaggattggaa

SEQ ID NO: 36899 - DNA, 21 bp, Artificial sequence
  SiRNA target sequence
tattaagacaaggattggaat

SEQ ID NO: 36900 - DNA, 21 bp, Artificial sequence
  SiRNA target sequence
attaagacaaggattggaata

SEQ ID NO: 36901 - DNA, 21 bp, Artificial sequence
  SiRNA target sequence
ttaagacaaggattggaatac

SEQ ID NO: 36902 - DNA, 21 bp, Artificial sequence
  SiRNA target sequence
taagacaaggattggaataca

SEQ ID NO: 36903 - DNA, 21 bp, Artificial sequence
  SiRNA target sequence
aagacaaggattggaatacac

SEQ ID NO: 36904 - DNA, 21 bp, Artificial sequence
  SiRNA target sequence
agacaaggattggaatacacc

SEQ ID NO: 36905 - DNA, 21 bp, Artificial sequence
  SiRNA target sequence
gacaaggattggaatacacca

SEQ ID NO: 36906 - DNA, 21 bp, Artificial sequence
  SiRNA target sequence
acaaggattggaatacaccat

SEQ ID NO: 36907 - DNA, 21 bp, Artificial sequence
  SiRNA target sequence
caaggattggaatacaccatg

SEQ ID NO: 36908 - DNA, 21 bp, Artificial sequence
  SiRNA target sequence
aaggattggaatacaccatgc

SEQ ID NO: 36909 - DNA, 21 bp, Artificial sequence
  SiRNA target sequence
aggattggaatacaccatgcc

SEQ ID NO: 36910 - DNA, 21 bp, Artificial sequence
  SiRNA target sequence
ggattggaatacaccatgcca

SEQ ID NO: 36911 - DNA, 21 bp, Artificial sequence
  SiRNA target sequence
gattggaatacaccatgccaa

SEQ ID NO: 36912 - DNA, 21 bp, Artificial sequence
  SiRNA target sequence
attggaatacaccatgccaac

SEQ ID NO: 36913 - DNA, 21 bp, Artificial sequence
  SiRNA target sequence
ttggaatacaccatgccaaca

SEQ ID NO: 36914 - DNA, 21 bp, Artificial sequence
  SiRNA target sequence
tggaatacaccatgccaacaa

SEQ ID NO: 36915 - DNA, 21 bp, Artificial sequence
  SiRNA target sequence
ggaatacaccatgccaacaac

SEQ ID NO: 36916 - DNA, 21 bp, Artificial sequence
  SiRNA target sequence
gaatacaccatgccaacaaca

SEQ ID NO: 36917 - DNA, 21 bp, Artificial sequence
  SiRNA target sequence
aatacaccatgccaacaacaa

SEQ ID NO: 36918 - DNA, 21 bp, Artificial sequence
  SiRNA target sequence
atacaccatgccaacaacaaa

SEQ ID NO: 36919 - DNA, 21 bp, Artificial sequence
  SiRNA target sequence
tacaccatgccaacaacaaat

SEQ ID NO: 36920 - DNA, 21 bp, Artificial sequence
  SiRNA target sequence
acaccatgccaacaacaaatg

SEQ ID NO: 36921 - DNA, 21 bp, Artificial sequence
  SiRNA target sequence
caccatgccaacaacaaatgg

SEQ ID NO: 36922 - DNA, 21 bp, Artificial sequence
  SiRNA target sequence
accatgccaacaacaaatggg

SEQ ID NO: 36923 - DNA, 21 bp, Artificial sequence
  SiRNA target sequence
ccatgccaacaacaaatgggg

SEQ ID NO: 36924 - DNA, 21 bp, Artificial sequence
  SiRNA target sequence
catgccaacaacaaatgggga

SEQ ID NO: 36925 - DNA, 21 bp, Artificial sequence
  SiRNA target sequence
atgccaacaacaaatggggat

SEQ ID NO: 36926 - DNA, 21 bp, Artificial sequence
  SiRNA target sequence
tgccaacaacaaatggggatt

SEQ ID NO: 36927 - DNA, 21 bp, Artificial sequence
  SiRNA target sequence
gccaacaacaaatggggattg

SEQ ID NO: 36928 - DNA, 21 bp, Artificial sequence
  SiRNA target sequence
ccaacaacaaatggggattgt

SEQ ID NO: 36929 - DNA, 21 bp, Artificial sequence
  SiRNA target sequence
caacaacaaatggggattgtg

SEQ ID NO: 36930 - DNA, 21 bp, Artificial sequence
  SiRNA target sequence
aacaacaaatggggattgtgg

SEQ ID NO: 36931 - DNA, 21 bp, Artificial sequence
  SiRNA target sequence
acaacaaatggggattgtggt

SEQ ID NO: 36932 - DNA, 21 bp, Artificial sequence
  SiRNA target sequence
caacaaatggggattgtggtg

SEQ ID NO: 36933 - DNA, 21 bp, Artificial sequence
  SiRNA target sequence
aacaaatggggattgtggtgc

SEQ ID NO: 36934 - DNA, 21 bp, Artificial sequence
  SiRNA target sequence
acaaatggggattgtggtgca

SEQ ID NO: 36935 - DNA, 21 bp, Artificial sequence
  SiRNA target sequence
caaatggggattgtggtgcac

SEQ ID NO: 36936 - DNA, 21 bp, Artificial sequence
  SiRNA target sequence
aaatggggattgtggtgcacc

SEQ ID NO: 36937 - DNA, 21 bp, Artificial sequence
  SiRNA target sequence
aatggggattgtggtgcacca

SEQ ID NO: 36938 - DNA, 21 bp, Artificial sequence
  SiRNA target sequence
atggggattgtggtgcaccat

SEQ ID NO: 36939 - DNA, 21 bp, Artificial sequence
  SiRNA target sequence
tggggattgtggtgcaccatt

SEQ ID NO: 36940 - DNA, 21 bp, Artificial sequence
  SiRNA target sequence
ggggattgtggtgcaccatta

SEQ ID NO: 36941 - DNA, 21 bp, Artificial sequence
  SiRNA target sequence
gggattgtggtgcaccattag

SEQ ID NO: 36942 - DNA, 21 bp, Artificial sequence
  SiRNA target sequence
ggattgtggtgcaccattagt

SEQ ID NO: 36943 - DNA, 21 bp, Artificial sequence
  SiRNA target sequence
gattgtggtgcaccattagta

SEQ ID NO: 36944 - DNA, 21 bp, Artificial sequence
  SiRNA target sequence
attgtggtgcaccattagtaa

SEQ ID NO: 36945 - DNA, 21 bp, Artificial sequence
  SiRNA target sequence
ttgtggtgcaccattagtaat

SEQ ID NO: 36946 - DNA, 21 bp, Artificial sequence
  SiRNA target sequence
tgtggtgcaccattagtaatt

SEQ ID NO: 36947 - DNA, 21 bp, Artificial sequence
  SiRNA target sequence
gtggtgcaccattagtaatta

SEQ ID NO: 36948 - DNA, 21 bp, Artificial sequence
  SiRNA target sequence
tggtgcaccattagtaattaa

SEQ ID NO: 36949 - DNA, 21 bp, Artificial sequence
  SiRNA target sequence
ggtgcaccattagtaattaat

SEQ ID NO: 36950 - DNA, 21 bp, Artificial sequence
  SiRNA target sequence
gtgcaccattagtaattaatg

SEQ ID NO: 36951 - DNA, 21 bp, Artificial sequence
  SiRNA target sequence
tgcaccattagtaattaatga

SEQ ID NO: 36952 - DNA, 21 bp, Artificial sequence
  SiRNA target sequence
gcaccattagtaattaatgaa

SEQ ID NO: 36953 - DNA, 21 bp, Artificial sequence
  SiRNA target sequence
caccattagtaattaatgaaa

SEQ ID NO: 36954 - DNA, 21 bp, Artificial sequence
  SiRNA target sequence
accattagtaattaatgaaac

SEQ ID NO: 36955 - DNA, 21 bp, Artificial sequence
  SiRNA target sequence
ccattagtaattaatgaaacc

SEQ ID NO: 36956 - DNA, 21 bp, Artificial sequence
  SiRNA target sequence
cattagtaattaatgaaaccc

SEQ ID NO: 36957 - DNA, 21 bp, Artificial sequence
  SiRNA target sequence
attagtaattaatgaaaccca

SEQ ID NO: 36958 - DNA, 21 bp, Artificial sequence
  SiRNA target sequence
ttagtaattaatgaaacccaa

SEQ ID NO: 36959 - DNA, 21 bp, Artificial sequence
  SiRNA target sequence
tagtaattaatgaaacccaag

SEQ ID NO: 36960 - DNA, 21 bp, Artificial sequence
  SiRNA target sequence
agtaattaatgaaacccaagt

SEQ ID NO: 36961 - DNA, 21 bp, Artificial sequence
  SiRNA target sequence
gtaattaatgaaacccaagtt

SEQ ID NO: 36962 - DNA, 21 bp, Artificial sequence
  SiRNA target sequence
taattaatgaaacccaagtta

SEQ ID NO: 36963 - DNA, 21 bp, Artificial sequence
  SiRNA target sequence
aattaatgaaacccaagttat

SEQ ID NO: 36964 - DNA, 21 bp, Artificial sequence
  SiRNA target sequence
attaatgaaacccaagttata

SEQ ID NO: 36965 - DNA, 21 bp, Artificial sequence
  SiRNA target sequence
ttaatgaaacccaagttatac

SEQ ID NO: 36966 - DNA, 21 bp, Artificial sequence
  SiRNA target sequence
taatgaaacccaagttatacg

SEQ ID NO: 36967 - DNA, 21 bp, Artificial sequence
  SiRNA target sequence
aatgaaacccaagttatacgt

SEQ ID NO: 36968 - DNA, 21 bp, Artificial sequence
  SiRNA target sequence
atgaaacccaagttatacgta

SEQ ID NO: 36969 - DNA, 21 bp, Artificial sequence
  SiRNA target sequence
tgaaacccaagttatacgtaa

SEQ ID NO: 36970 - DNA, 21 bp, Artificial sequence
  SiRNA target sequence
gaaacccaagttatacgtaaa

SEQ ID NO: 36971 - DNA, 21 bp, Artificial sequence
  SiRNA target sequence
aaacccaagttatacgtaaaa

SEQ ID NO: 36972 - DNA, 21 bp, Artificial sequence
  SiRNA target sequence
aacccaagttatacgtaaaat

SEQ ID NO: 36973 - DNA, 21 bp, Artificial sequence
  SiRNA target sequence
acccaagttatacgtaaaata

SEQ ID NO: 36974 - DNA, 21 bp, Artificial sequence
  SiRNA target sequence
cccaagttatacgtaaaatag

SEQ ID NO: 36975 - DNA, 21 bp, Artificial sequence
  SiRNA target sequence
ccaagttatacgtaaaatagc

SEQ ID NO: 36976 - DNA, 21 bp, Artificial sequence
  SiRNA target sequence
caagttatacgtaaaatagct

SEQ ID NO: 36977 - DNA, 21 bp, Artificial sequence
  SiRNA target sequence
aagttatacgtaaaatagctg

SEQ ID NO: 36978 - DNA, 21 bp, Artificial sequence
  SiRNA target sequence
agttatacgtaaaatagctgg

SEQ ID NO: 36979 - DNA, 21 bp, Artificial sequence
  SiRNA target sequence
gttatacgtaaaatagctgga

SEQ ID NO: 36980 - DNA, 21 bp, Artificial sequence
  SiRNA target sequence
ttatacgtaaaatagctggaa

SEQ ID NO: 36981 - DNA, 21 bp, Artificial sequence
  SiRNA target sequence
tatacgtaaaatagctggaat

SEQ ID NO: 36982 - DNA, 21 bp, Artificial sequence
  SiRNA target sequence
atacgtaaaatagctggaatt

SEQ ID NO: 36983 - DNA, 21 bp, Artificial sequence
  SiRNA target sequence
tacgtaaaatagctggaattc

SEQ ID NO: 36984 - DNA, 21 bp, Artificial sequence
  SiRNA target sequence
acgtaaaatagctggaattca

SEQ ID NO: 36985 - DNA, 21 bp, Artificial sequence
  SiRNA target sequence
cgtaaaatagctggaattcat

SEQ ID NO: 36986 - DNA, 21 bp, Artificial sequence
  SiRNA target sequence
gtaaaatagctggaattcatg

SEQ ID NO: 36987 - DNA, 21 bp, Artificial sequence
  SiRNA target sequence
taaaatagctggaattcatgt

SEQ ID NO: 36988 - DNA, 21 bp, Artificial sequence
  SiRNA target sequence
aaaatagctggaattcatgtt

SEQ ID NO: 36989 - DNA, 21 bp, Artificial sequence
  SiRNA target sequence
aaatagctggaattcatgttg

SEQ ID NO: 36990 - DNA, 21 bp, Artificial sequence
  SiRNA target sequence
aatagctggaattcatgttgc

SEQ ID NO: 36991 - DNA, 21 bp, Artificial sequence
  SiRNA target sequence
atagctggaattcatgttgct

SEQ ID NO: 36992 - DNA, 21 bp, Artificial sequence
  SiRNA target sequence
tagctggaattcatgttgctg

SEQ ID NO: 36993 - DNA, 21 bp, Artificial sequence
  SiRNA target sequence
agctggaattcatgttgctgg

SEQ ID NO: 36994 - DNA, 21 bp, Artificial sequence
  SiRNA target sequence
gctggaattcatgttgctggt

SEQ ID NO: 36995 - DNA, 21 bp, Artificial sequence
  SiRNA target sequence
ctggaattcatgttgctggtg

SEQ ID NO: 36996 - DNA, 21 bp, Artificial sequence
  SiRNA target sequence
tggaattcatgttgctggtga

SEQ ID NO: 36997 - DNA, 21 bp, Artificial sequence
  SiRNA target sequence
ggaattcatgttgctggtgat

SEQ ID NO: 36998 - DNA, 21 bp, Artificial sequence
  SiRNA target sequence
gaattcatgttgctggtgatg

SEQ ID NO: 36999 - DNA, 21 bp, Artificial sequence
  SiRNA target sequence
aattcatgttgctggtgatgc

SEQ ID NO: 37000 - DNA, 21 bp, Artificial sequence
  SiRNA target sequence
attcatgttgctggtgatgcc

SEQ ID NO: 37001 - DNA, 21 bp, Artificial sequence
  SiRNA target sequence
ttcatgttgctggtgatgccc

SEQ ID NO: 37002 - DNA, 21 bp, Artificial sequence
  SiRNA target sequence
tcatgttgctggtgatgcccg

SEQ ID NO: 37003 - DNA, 21 bp, Artificial sequence
  SiRNA target sequence
catgttgctggtgatgcccga

SEQ ID NO: 37004 - DNA, 21 bp, Artificial sequence
  SiRNA target sequence
atgttgctggtgatgcccgag

SEQ ID NO: 37005 - DNA, 21 bp, Artificial sequence
  SiRNA target sequence
tgttgctggtgatgcccgagg

SEQ ID NO: 37006 - DNA, 21 bp, Artificial sequence
  SiRNA target sequence
gttgctggtgatgcccgagga

SEQ ID NO: 37007 - DNA, 21 bp, Artificial sequence
  SiRNA target sequence
ttgctggtgatgcccgaggaa

SEQ ID NO: 37008 - DNA, 21 bp, Artificial sequence
  SiRNA target sequence
tgctggtgatgcccgaggaaa

SEQ ID NO: 37009 - DNA, 21 bp, Artificial sequence
  SiRNA target sequence
gctggtgatgcccgaggaaaa

SEQ ID NO: 37010 - DNA, 21 bp, Artificial sequence
  SiRNA target sequence
ctggtgatgcccgaggaaaag

SEQ ID NO: 37011 - DNA, 21 bp, Artificial sequence
  SiRNA target sequence
tggtgatgcccgaggaaaagc

SEQ ID NO: 37012 - DNA, 21 bp, Artificial sequence
  SiRNA target sequence
ggtgatgcccgaggaaaagct

SEQ ID NO: 37013 - DNA, 21 bp, Artificial sequence
  SiRNA target sequence
gtgatgcccgaggaaaagctt

SEQ ID NO: 37014 - DNA, 21 bp, Artificial sequence
  SiRNA target sequence
tgatgcccgaggaaaagctta

SEQ ID NO: 37015 - DNA, 21 bp, Artificial sequence
  SiRNA target sequence
gatgcccgaggaaaagcttat

SEQ ID NO: 37016 - DNA, 21 bp, Artificial sequence
  SiRNA target sequence
atgcccgaggaaaagcttatg

SEQ ID NO: 37017 - DNA, 21 bp, Artificial sequence
  SiRNA target sequence
tgcccgaggaaaagcttatgc

SEQ ID NO: 37018 - DNA, 21 bp, Artificial sequence
  SiRNA target sequence
gcccgaggaaaagcttatgca

SEQ ID NO: 37019 - DNA, 21 bp, Artificial sequence
  SiRNA target sequence
cccgaggaaaagcttatgcag

SEQ ID NO: 37020 - DNA, 21 bp, Artificial sequence
  SiRNA target sequence
ccgaggaaaagcttatgcaga

SEQ ID NO: 37021 - DNA, 21 bp, Artificial sequence
  SiRNA target sequence
cgaggaaaagcttatgcagaa

SEQ ID NO: 37022 - DNA, 21 bp, Artificial sequence
  SiRNA target sequence
gaggaaaagcttatgcagaat

SEQ ID NO: 37023 - DNA, 21 bp, Artificial sequence
  SiRNA target sequence
aggaaaagcttatgcagaatc

SEQ ID NO: 37024 - DNA, 21 bp, Artificial sequence
  SiRNA target sequence
ggaaaagcttatgcagaatca

SEQ ID NO: 37025 - DNA, 21 bp, Artificial sequence
  SiRNA target sequence
gaaaagcttatgcagaatcaa

SEQ ID NO: 37026 - DNA, 21 bp, Artificial sequence
  SiRNA target sequence
aaaagcttatgcagaatcaat

SEQ ID NO: 37027 - DNA, 21 bp, Artificial sequence
  SiRNA target sequence
aaagcttatgcagaatcaata

SEQ ID NO: 37028 - DNA, 21 bp, Artificial sequence
  SiRNA target sequence
aagcttatgcagaatcaataa

SEQ ID NO: 37029 - DNA, 21 bp, Artificial sequence
  SiRNA target sequence
agcttatgcagaatcaataag

SEQ ID NO: 37030 - DNA, 21 bp, Artificial sequence
  SiRNA target sequence
gcttatgcagaatcaataagt

SEQ ID NO: 37031 - DNA, 21 bp, Artificial sequence
  SiRNA target sequence
cttatgcagaatcaataagtc

SEQ ID NO: 37032 - DNA, 21 bp, Artificial sequence
  SiRNA target sequence
ttatgcagaatcaataagtca

SEQ ID NO: 37033 - DNA, 21 bp, Artificial sequence
  SiRNA target sequence
tatgcagaatcaataagtcaa

SEQ ID NO: 37034 - DNA, 21 bp, Artificial sequence
  SiRNA target sequence
atgcagaatcaataagtcaaa

SEQ ID NO: 37035 - DNA, 21 bp, Artificial sequence
  SiRNA target sequence
tgcagaatcaataagtcaaaa

SEQ ID NO: 37036 - DNA, 21 bp, Artificial sequence
  SiRNA target sequence
gcagaatcaataagtcaaaaa

SEQ ID NO: 37037 - DNA, 21 bp, Artificial sequence
  SiRNA target sequence
cagaatcaataagtcaaaaag

SEQ ID NO: 37038 - DNA, 21 bp, Artificial sequence
  SiRNA target sequence
agaatcaataagtcaaaaaga

SEQ ID NO: 37039 - DNA, 21 bp, Artificial sequence
  SiRNA target sequence
gaatcaataagtcaaaaagat

SEQ ID NO: 37040 - DNA, 21 bp, Artificial sequence
  SiRNA target sequence
aatcaataagtcaaaaagatt

SEQ ID NO: 37041 - DNA, 21 bp, Artificial sequence
  SiRNA target sequence
atcaataagtcaaaaagattt

SEQ ID NO: 37042 - DNA, 21 bp, Artificial sequence
  SiRNA target sequence
tcaataagtcaaaaagattta

SEQ ID NO: 37043 - DNA, 21 bp, Artificial sequence
  SiRNA target sequence
caataagtcaaaaagatttaa

SEQ ID NO: 37044 - DNA, 21 bp, Artificial sequence
  SiRNA target sequence
aataagtcaaaaagatttaat

SEQ ID NO: 37045 - DNA, 21 bp, Artificial sequence
  SiRNA target sequence
ataagtcaaaaagatttaata

SEQ ID NO: 37046 - DNA, 21 bp, Artificial sequence
  SiRNA target sequence
taagtcaaaaagatttaataa

SEQ ID NO: 37047 - DNA, 21 bp, Artificial sequence
  SiRNA target sequence
aagtcaaaaagatttaataag

SEQ ID NO: 37048 - DNA, 21 bp, Artificial sequence
  SiRNA target sequence
agtcaaaaagatttaataaga

SEQ ID NO: 37049 - DNA, 21 bp, Artificial sequence
  SiRNA target sequence
gtcaaaaagatttaataagag

SEQ ID NO: 37050 - DNA, 21 bp, Artificial sequence
  SiRNA target sequence
tcaaaaagatttaataagagc

SEQ ID NO: 37051 - DNA, 21 bp, Artificial sequence
  SiRNA target sequence
caaaaagatttaataagagct

SEQ ID NO: 37052 - DNA, 21 bp, Artificial sequence
  SiRNA target sequence
aaaaagatttaataagagctt

SEQ ID NO: 37053 - DNA, 21 bp, Artificial sequence
  SiRNA target sequence
aaaagatttaataagagcttt

SEQ ID NO: 37054 - DNA, 21 bp, Artificial sequence
  SiRNA target sequence
aaagatttaataagagctttt

SEQ ID NO: 37055 - DNA, 21 bp, Artificial sequence
  SiRNA target sequence
aagatttaataagagcttttt

SEQ ID NO: 37056 - DNA, 21 bp, Artificial sequence
  SiRNA target sequence
agatttaataagagctttttc

SEQ ID NO: 37057 - DNA, 21 bp, Artificial sequence
  SiRNA target sequence
gatttaataagagctttttct

SEQ ID NO: 37058 - DNA, 21 bp, Artificial sequence
  SiRNA target sequence
atttaataagagctttttcta

SEQ ID NO: 37059 - DNA, 21 bp, Artificial sequence
  SiRNA target sequence
tttaataagagctttttctaa

SEQ ID NO: 37060 - DNA, 21 bp, Artificial sequence
  SiRNA target sequence
ttaataagagctttttctaaa

SEQ ID NO: 37061 - DNA, 21 bp, Artificial sequence
  SiRNA target sequence
taataagagctttttctaaaa

SEQ ID NO: 37062 - DNA, 21 bp, Artificial sequence
  SiRNA target sequence
aataagagctttttctaaaat

SEQ ID NO: 37063 - DNA, 21 bp, Artificial sequence
  SiRNA target sequence
ataagagctttttctaaaatt

SEQ ID NO: 37064 - DNA, 21 bp, Artificial sequence
  SiRNA target sequence
taagagctttttctaaaattg

SEQ ID NO: 37065 - DNA, 21 bp, Artificial sequence
  SiRNA target sequence
aagagctttttctaaaattga

SEQ ID NO: 37066 - DNA, 21 bp, Artificial sequence
  SiRNA target sequence
agagctttttctaaaattgac

SEQ ID NO: 37067 - DNA, 21 bp, Artificial sequence
  SiRNA target sequence
gagctttttctaaaattgacg

SEQ ID NO: 37068 - DNA, 21 bp, Artificial sequence
  SiRNA target sequence
agctttttctaaaattgacgt

SEQ ID NO: 37069 - DNA, 21 bp, Artificial sequence
  SiRNA target sequence
gctttttctaaaattgacgtt

SEQ ID NO: 37070 - DNA, 21 bp, Artificial sequence
  SiRNA target sequence
ctttttctaaaattgacgtta

SEQ ID NO: 37071 - DNA, 21 bp, Artificial sequence
  SiRNA target sequence
tttttctaaaattgacgttag

SEQ ID NO: 37072 - DNA, 21 bp, Artificial sequence
  SiRNA target sequence
ttttctaaaattgacgttagt

SEQ ID NO: 37073 - DNA, 21 bp, Artificial sequence
  SiRNA target sequence
tttctaaaattgacgttagta

SEQ ID NO: 37074 - DNA, 21 bp, Artificial sequence
  SiRNA target sequence
ttctaaaattgacgttagtat

SEQ ID NO: 37075 - DNA, 21 bp, Artificial sequence
  SiRNA target sequence
tctaaaattgacgttagtatg

SEQ ID NO: 37076 - DNA, 21 bp, Artificial sequence
  SiRNA target sequence
ctaaaattgacgttagtatgc

SEQ ID NO: 37077 - DNA, 21 bp, Artificial sequence
  SiRNA target sequence
taaaattgacgttagtatgca

SEQ ID NO: 37078 - DNA, 21 bp, Artificial sequence
  SiRNA target sequence
aaaattgacgttagtatgcag

SEQ ID NO: 37079 - DNA, 21 bp, Artificial sequence
  SiRNA target sequence
aaattgacgttagtatgcaga

SEQ ID NO: 37080 - DNA, 21 bp, Artificial sequence
  SiRNA target sequence
aattgacgttagtatgcagat

SEQ ID NO: 37081 - DNA, 21 bp, Artificial sequence
  SiRNA target sequence
attgacgttagtatgcagatt

SEQ ID NO: 37082 - DNA, 21 bp, Artificial sequence
  SiRNA target sequence
ttgacgttagtatgcagattc

SEQ ID NO: 37083 - DNA, 21 bp, Artificial sequence
  SiRNA target sequence
tgacgttagtatgcagattca

SEQ ID NO: 37084 - DNA, 21 bp, Artificial sequence
  SiRNA target sequence
gacgttagtatgcagattcaa

SEQ ID NO: 37085 - DNA, 21 bp, Artificial sequence
  SiRNA target sequence
acgttagtatgcagattcaat

SEQ ID NO: 37086 - DNA, 21 bp, Artificial sequence
  SiRNA target sequence
cgttagtatgcagattcaatt

SEQ ID NO: 37087 - DNA, 21 bp, Artificial sequence
  SiRNA target sequence
gttagtatgcagattcaattg

SEQ ID NO: 37088 - DNA, 21 bp, Artificial sequence
  SiRNA target sequence
ttagtatgcagattcaattgg

SEQ ID NO: 37089 - DNA, 21 bp, Artificial sequence
  SiRNA target sequence
tagtatgcagattcaattgga

SEQ ID NO: 37090 - DNA, 21 bp, Artificial sequence
  SiRNA target sequence
agtatgcagattcaattggac

SEQ ID NO: 37091 - DNA, 21 bp, Artificial sequence
  SiRNA target sequence
gtatgcagattcaattggacc

SEQ ID NO: 37092 - DNA, 21 bp, Artificial sequence
  SiRNA target sequence
tatgcagattcaattggacct

SEQ ID NO: 37093 - DNA, 21 bp, Artificial sequence
  SiRNA target sequence
atgcagattcaattggaccta

SEQ ID NO: 37094 - DNA, 21 bp, Artificial sequence
  SiRNA target sequence
tgcagattcaattggacctag

SEQ ID NO: 37095 - DNA, 21 bp, Artificial sequence
  SiRNA target sequence
gcagattcaattggacctaga

SEQ ID NO: 37096 - DNA, 21 bp, Artificial sequence
  SiRNA target sequence
cagattcaattggacctagat

SEQ ID NO: 37097 - DNA, 21 bp, Artificial sequence
  SiRNA target sequence
agattcaattggacctagatc

SEQ ID NO: 37098 - DNA, 21 bp, Artificial sequence
  SiRNA target sequence
gattcaattggacctagatca

SEQ ID NO: 37099 - DNA, 21 bp, Artificial sequence
  SiRNA target sequence
attcaattggacctagatcag

SEQ ID NO: 37100 - DNA, 21 bp, Artificial sequence
  SiRNA target sequence
ttcaattggacctagatcaga

SEQ ID NO: 37101 - DNA, 21 bp, Artificial sequence
  SiRNA target sequence
tcaattggacctagatcagac

SEQ ID NO: 37102 - DNA, 21 bp, Artificial sequence
  SiRNA target sequence
caattggacctagatcagaca

SEQ ID NO: 37103 - DNA, 21 bp, Artificial sequence
  SiRNA target sequence
aattggacctagatcagacat

SEQ ID NO: 37104 - DNA, 21 bp, Artificial sequence
  SiRNA target sequence
attggacctagatcagacatt

SEQ ID NO: 37105 - DNA, 21 bp, Artificial sequence
  SiRNA target sequence
ttggacctagatcagacattg

SEQ ID NO: 37106 - DNA, 21 bp, Artificial sequence
  SiRNA target sequence
tggacctagatcagacattga

SEQ ID NO: 37107 - DNA, 21 bp, Artificial sequence
  SiRNA target sequence
ggacctagatcagacattgaa

SEQ ID NO: 37108 - DNA, 21 bp, Artificial sequence
  SiRNA target sequence
gacctagatcagacattgaat

SEQ ID NO: 37109 - DNA, 21 bp, Artificial sequence
  SiRNA target sequence
acctagatcagacattgaatt

SEQ ID NO: 37110 - DNA, 21 bp, Artificial sequence
  SiRNA target sequence
cctagatcagacattgaattt

SEQ ID NO: 37111 - DNA, 21 bp, Artificial sequence
  SiRNA target sequence
ctagatcagacattgaatttt

SEQ ID NO: 37112 - DNA, 21 bp, Artificial sequence
  SiRNA target sequence
tagatcagacattgaatttta

SEQ ID NO: 37113 - DNA, 21 bp, Artificial sequence
  SiRNA target sequence
agatcagacattgaattttaa

SEQ ID NO: 37114 - DNA, 21 bp, Artificial sequence
  SiRNA target sequence
gatcagacattgaattttaac

SEQ ID NO: 37115 - DNA, 21 bp, Artificial sequence
  SiRNA target sequence
atcagacattgaattttaacc

SEQ ID NO: 37116 - DNA, 21 bp, Artificial sequence
  SiRNA target sequence
tcagacattgaattttaacca

SEQ ID NO: 37117 - DNA, 21 bp, Artificial sequence
  SiRNA target sequence
cagacattgaattttaaccaa

SEQ ID NO: 37118 - DNA, 21 bp, Artificial sequence
  SiRNA target sequence
agacattgaattttaaccaac

SEQ ID NO: 37119 - DNA, 21 bp, Artificial sequence
  SiRNA target sequence
gacattgaattttaaccaaca

SEQ ID NO: 37120 - DNA, 21 bp, Artificial sequence
  SiRNA target sequence
acattgaattttaaccaacag

SEQ ID NO: 37121 - DNA, 21 bp, Artificial sequence
  SiRNA target sequence
cattgaattttaaccaacagc

SEQ ID NO: 37122 - DNA, 21 bp, Artificial sequence
  SiRNA target sequence
attgaattttaaccaacagca

SEQ ID NO: 37123 - DNA, 21 bp, Artificial sequence
  SiRNA target sequence
ttgaattttaaccaacagcag

SEQ ID NO: 37124 - DNA, 21 bp, Artificial sequence
  SiRNA target sequence
tgaattttaaccaacagcaga

SEQ ID NO: 37125 - DNA, 21 bp, Artificial sequence
  SiRNA target sequence
gaattttaaccaacagcagav

SEQ ID NO: 37126 - DNA, 21 bp, Artificial sequence
  SiRNA target sequence
aattttaaccaacagcagava

SEQ ID NO: 37127 - DNA, 21 bp, Artificial sequence
  SiRNA target sequence
attttaaccaacagcagavaa

SEQ ID NO: 37128 - DNA, 21 bp, Artificial sequence
  SiRNA target sequence
ttttaaccaacagcagavaat

SEQ ID NO: 37129 - DNA, 21 bp, Artificial sequence
  SiRNA target sequence
tttaaccaacagcagavaata

SEQ ID NO: 37130 - DNA, 21 bp, Artificial sequence
  SiRNA target sequence
ttaaccaacagcagavaataa

SEQ ID NO: 37131 - DNA, 21 bp, Artificial sequence
  SiRNA target sequence
taaccaacagcagavaataat

SEQ ID NO: 37132 - DNA, 21 bp, Artificial sequence
  SiRNA target sequence
aaccaacagcagavaataata

SEQ ID NO: 37133 - DNA, 21 bp, Artificial sequence
  SiRNA target sequence
accaacagcagavaataatac

SEQ ID NO: 37134 - DNA, 21 bp, Artificial sequence
  SiRNA target sequence
ccaacagcagavaataatacc

SEQ ID NO: 37135 - DNA, 21 bp, Artificial sequence
  SiRNA target sequence
caacagcagavaataatacca

SEQ ID NO: 37136 - DNA, 21 bp, Artificial sequence
  SiRNA target sequence
aacagcagavaataataccac

SEQ ID NO: 37137 - DNA, 21 bp, Artificial sequence
  SiRNA target sequence
acagcagavaataataccacc

SEQ ID NO: 37138 - DNA, 21 bp, Artificial sequence
  SiRNA target sequence
cagcagavaataataccacca

SEQ ID NO: 37139 - DNA, 21 bp, Artificial sequence
  SiRNA target sequence
agcagavaataataccaccaa

SEQ ID NO: 37140 - DNA, 21 bp, Artificial sequence
  SiRNA target sequence
gcagavaataataccaccaaa

SEQ ID NO: 37141 - DNA, 21 bp, Artificial sequence
  SiRNA target sequence
cagavaataataccaccaaac

SEQ ID NO: 37142 - DNA, 21 bp, Artificial sequence
  SiRNA target sequence
agavaataataccaccaaacg

SEQ ID NO: 37143 - DNA, 21 bp, Artificial sequence
  SiRNA target sequence
gavaataataccaccaaacgc

SEQ ID NO: 37144 - DNA, 21 bp, Artificial sequence
  SiRNA target sequence
avaataataccaccaaacgca

SEQ ID NO: 37145 - DNA, 21 bp, Artificial sequence
  SiRNA target sequence
vaataataccaccaaacgcag

SEQ ID NO: 37146 - DNA, 21 bp, Artificial sequence
  SiRNA target sequence
aataataccaccaaacgcaga

SEQ ID NO: 37147 - DNA, 21 bp, Artificial sequence
  SiRNA target sequence
ataataccaccaaacgcagaa

SEQ ID NO: 37148 - DNA, 21 bp, Artificial sequence
  SiRNA target sequence
taataccaccaaacgcagaat

SEQ ID NO: 37149 - DNA, 21 bp, Artificial sequence
  SiRNA target sequence
aataccaccaaacgcagaatt

SEQ ID NO: 37150 - DNA, 21 bp, Artificial sequence
  SiRNA target sequence
ataccaccaaacgcagaattc

SEQ ID NO: 37151 - DNA, 21 bp, Artificial sequence
  SiRNA target sequence
taccaccaaacgcagaattcg

SEQ ID NO: 37152 - DNA, 21 bp, Artificial sequence
  SiRNA target sequence
accaccaaacgcagaattcgg

SEQ ID NO: 37153 - DNA, 21 bp, Artificial sequence
  SiRNA target sequence
ccaccaaacgcagaattcgga

SEQ ID NO: 37154 - DNA, 21 bp, Artificial sequence
  SiRNA target sequence
caccaaacgcagaattcggac

SEQ ID NO: 37155 - DNA, 21 bp, Artificial sequence
  SiRNA target sequence
accaaacgcagaattcggacc

SEQ ID NO: 37156 - DNA, 21 bp, Artificial sequence
  SiRNA target sequence
ccaaacgcagaattcggacct

SEQ ID NO: 37157 - DNA, 21 bp, Artificial sequence
  SiRNA target sequence
caaacgcagaattcggacctg

SEQ ID NO: 37158 - DNA, 21 bp, Artificial sequence
  SiRNA target sequence
aaacgcagaattcggacctga

SEQ ID NO: 37159 - DNA, 21 bp, Artificial sequence
  SiRNA target sequence
aacgcagaattcggacctgag

SEQ ID NO: 37160 - DNA, 21 bp, Artificial sequence
  SiRNA target sequence
acgcagaattcggacctgagg

SEQ ID NO: 37161 - DNA, 21 bp, Artificial sequence
  SiRNA target sequence
cgcagaattcggacctgagga

SEQ ID NO: 37162 - DNA, 21 bp, Artificial sequence
  SiRNA target sequence
gcagaattcggacctgaggat

SEQ ID NO: 37163 - DNA, 21 bp, Artificial sequence
  SiRNA target sequence
cagaattcggacctgaggatt

SEQ ID NO: 37164 - DNA, 21 bp, Artificial sequence
  SiRNA target sequence
agaattcggacctgaggattt

SEQ ID NO: 37165 - DNA, 21 bp, Artificial sequence
  SiRNA target sequence
gaattcggacctgaggattta

SEQ ID NO: 37166 - DNA, 21 bp, Artificial sequence
  SiRNA target sequence
aattcggacctgaggatttag

SEQ ID NO: 37167 - DNA, 21 bp, Artificial sequence
  SiRNA target sequence
attcggacctgaggatttaga

SEQ ID NO: 37168 - DNA, 21 bp, Artificial sequence
  SiRNA target sequence
ttcggacctgaggatttagat

SEQ ID NO: 37169 - DNA, 21 bp, Artificial sequence
  SiRNA target sequence
tcggacctgaggatttagatt

SEQ ID NO: 37170 - DNA, 21 bp, Artificial sequence
  SiRNA target sequence
cggacctgaggatttagattt

SEQ ID NO: 37171 - DNA, 21 bp, Artificial sequence
  SiRNA target sequence
ggacctgaggatttagatttt

SEQ ID NO: 37172 - DNA, 21 bp, Artificial sequence
  SiRNA target sequence
gacctgaggatttagattttt

SEQ ID NO: 37173 - DNA, 21 bp, Artificial sequence
  SiRNA target sequence
acctgaggatttagatttttg

SEQ ID NO: 37174 - DNA, 21 bp, Artificial sequence
  SiRNA target sequence
cctgaggatttagatttttgc

SEQ ID NO: 37175 - DNA, 21 bp, Artificial sequence
  SiRNA target sequence
ctgaggatttagatttttgcg

SEQ ID NO: 37176 - DNA, 21 bp, Artificial sequence
  SiRNA target sequence
tgaggatttagatttttgcga

SEQ ID NO: 37177 - DNA, 21 bp, Artificial sequence
  SiRNA target sequence
gaggatttagatttttgcgat

SEQ ID NO: 37178 - DNA, 21 bp, Artificial sequence
  SiRNA target sequence
aggatttagatttttgcgatt

SEQ ID NO: 37179 - DNA, 21 bp, Artificial sequence
  SiRNA target sequence
ggatttagatttttgcgattt

SEQ ID NO: 37180 - DNA, 21 bp, Artificial sequence
  SiRNA target sequence
gatttagatttttgcgatttg

SEQ ID NO: 37181 - DNA, 21 bp, Artificial sequence
  SiRNA target sequence
atttagatttttgcgatttgc

SEQ ID NO: 37182 - DNA, 21 bp, Artificial sequence
  SiRNA target sequence
tttagatttttgcgatttgcc

SEQ ID NO: 37183 - DNA, 21 bp, Artificial sequence
  SiRNA target sequence
ttagatttttgcgatttgcct

SEQ ID NO: 37184 - DNA, 21 bp, Artificial sequence
  SiRNA target sequence
tagatttttgcgatttgcctt

SEQ ID NO: 37185 - DNA, 21 bp, Artificial sequence
  SiRNA target sequence
agatttttgcgatttgccttc

SEQ ID NO: 37186 - DNA, 21 bp, Artificial sequence
  SiRNA target sequence
gatttttgcgatttgccttca

SEQ ID NO: 37187 - DNA, 21 bp, Artificial sequence
  SiRNA target sequence
atttttgcgatttgccttcac

SEQ ID NO: 37188 - DNA, 21 bp, Artificial sequence
  SiRNA target sequence
tttttgcgatttgccttcact

SEQ ID NO: 37189 - DNA, 21 bp, Artificial sequence
  SiRNA target sequence
ttttgcgatttgccttcactt

SEQ ID NO: 37190 - DNA, 21 bp, Artificial sequence
  SiRNA target sequence
tttgcgatttgccttcactta

SEQ ID NO: 37191 - DNA, 21 bp, Artificial sequence
  SiRNA target sequence
ttgcgatttgccttcacttaa

SEQ ID NO: 37192 - DNA, 21 bp, Artificial sequence
  SiRNA target sequence
tgcgatttgccttcacttaaa

SEQ ID NO: 37193 - DNA, 21 bp, Artificial sequence
  SiRNA target sequence
gcgatttgccttcacttaaaa

SEQ ID NO: 37194 - DNA, 21 bp, Artificial sequence
  SiRNA target sequence
cgatttgccttcacttaaaat

SEQ ID NO: 37195 - DNA, 21 bp, Artificial sequence
  SiRNA target sequence
gatttgccttcacttaaaatg

SEQ ID NO: 37196 - DNA, 21 bp, Artificial sequence
  SiRNA target sequence
atttgccttcacttaaaatga

SEQ ID NO: 37197 - DNA, 21 bp, Artificial sequence
  SiRNA target sequence
tttgccttcacttaaaatgat

SEQ ID NO: 37198 - DNA, 21 bp, Artificial sequence
  SiRNA target sequence
ttgccttcacttaaaatgata

SEQ ID NO: 37199 - DNA, 21 bp, Artificial sequence
  SiRNA target sequence
tgccttcacttaaaatgatac

SEQ ID NO: 37200 - DNA, 21 bp, Artificial sequence
  SiRNA target sequence
gccttcacttaaaatgatacc

SEQ ID NO: 37201 - DNA, 21 bp, Artificial sequence
  SiRNA target sequence
ccttcacttaaaatgatacca

SEQ ID NO: 37202 - DNA, 21 bp, Artificial sequence
  SiRNA target sequence
cttcacttaaaatgataccag

SEQ ID NO: 37203 - DNA, 21 bp, Artificial sequence
  SiRNA target sequence
ttcacttaaaatgataccagt

SEQ ID NO: 37204 - DNA, 21 bp, Artificial sequence
  SiRNA target sequence
tcacttaaaatgataccagtg

SEQ ID NO: 37205 - DNA, 21 bp, Artificial sequence
  SiRNA target sequence
cacttaaaatgataccagtgg

SEQ ID NO: 37206 - DNA, 21 bp, Artificial sequence
  SiRNA target sequence
acttaaaatgataccagtggg

SEQ ID NO: 37207 - DNA, 21 bp, Artificial sequence
  SiRNA target sequence
cttaaaatgataccagtgggt

SEQ ID NO: 37208 - DNA, 21 bp, Artificial sequence
  SiRNA target sequence
ttaaaatgataccagtgggta

SEQ ID NO: 37209 - DNA, 21 bp, Artificial sequence
  SiRNA target sequence
taaaatgataccagtgggtag

SEQ ID NO: 37210 - DNA, 21 bp, Artificial sequence
  SiRNA target sequence
aaaatgataccagtgggtaga

SEQ ID NO: 37211 - DNA, 21 bp, Artificial sequence
  SiRNA target sequence
aaatgataccagtgggtagat

SEQ ID NO: 37212 - DNA, 21 bp, Artificial sequence
  SiRNA target sequence
aatgataccagtgggtagatt

SEQ ID NO: 37213 - DNA, 21 bp, Artificial sequence
  SiRNA target sequence
atgataccagtgggtagattg

SEQ ID NO: 37214 - DNA, 21 bp, Artificial sequence
  SiRNA target sequence
tgataccagtgggtagattga

SEQ ID NO: 37215 - DNA, 21 bp, Artificial sequence
  SiRNA target sequence
gataccagtgggtagattgag

SEQ ID NO: 37216 - DNA, 21 bp, Artificial sequence
  SiRNA target sequence
ataccagtgggtagattgagt

SEQ ID NO: 37217 - DNA, 21 bp, Artificial sequence
  SiRNA target sequence
taccagtgggtagattgagtg

SEQ ID NO: 37218 - DNA, 21 bp, Artificial sequence
  SiRNA target sequence
accagtgggtagattgagtga

SEQ ID NO: 37219 - DNA, 21 bp, Artificial sequence
  SiRNA target sequence
ccagtgggtagattgagtgaa

SEQ ID NO: 37220 - DNA, 21 bp, Artificial sequence
  SiRNA target sequence
cagtgggtagattgagtgaac

SEQ ID NO: 37221 - DNA, 21 bp, Artificial sequence
  SiRNA target sequence
agtgggtagattgagtgaacc

SEQ ID NO: 37222 - DNA, 21 bp, Artificial sequence
  SiRNA target sequence
gtgggtagattgagtgaacct

SEQ ID NO: 37223 - DNA, 21 bp, Artificial sequence
  SiRNA target sequence
tgggtagattgagtgaacctt

SEQ ID NO: 37224 - DNA, 21 bp, Artificial sequence
  SiRNA target sequence
gggtagattgagtgaaccttt

SEQ ID NO: 37225 - DNA, 21 bp, Artificial sequence
  SiRNA target sequence
ggtagattgagtgaacctttg

SEQ ID NO: 37226 - DNA, 21 bp, Artificial sequence
  SiRNA target sequence
gtagattgagtgaacctttgt

SEQ ID NO: 37227 - DNA, 21 bp, Artificial sequence
  SiRNA target sequence
tagattgagtgaacctttgtt

SEQ ID NO: 37228 - DNA, 21 bp, Artificial sequence
  SiRNA target sequence
agattgagtgaacctttgttc

SEQ ID NO: 37229 - DNA, 21 bp, Artificial sequence
  SiRNA target sequence
gattgagtgaacctttgttcg

SEQ ID NO: 37230 - DNA, 21 bp, Artificial sequence
  SiRNA target sequence
attgagtgaacctttgttcga

SEQ ID NO: 37231 - DNA, 21 bp, Artificial sequence
  SiRNA target sequence
ttgagtgaacctttgttcgaa

SEQ ID NO: 37232 - DNA, 21 bp, Artificial sequence
  SiRNA target sequence
tgagtgaacctttgttcgaac

SEQ ID NO: 37233 - DNA, 21 bp, Artificial sequence
  SiRNA target sequence
gagtgaacctttgttcgaacc

SEQ ID NO: 37234 - DNA, 21 bp, Artificial sequence
  SiRNA target sequence
agtgaacctttgttcgaacct

SEQ ID NO: 37235 - DNA, 21 bp, Artificial sequence
  SiRNA target sequence
gtgaacctttgttcgaacctg

SEQ ID NO: 37236 - DNA, 21 bp, Artificial sequence
  SiRNA target sequence
tgaacctttgttcgaacctgg

SEQ ID NO: 37237 - DNA, 21 bp, Artificial sequence
  SiRNA target sequence
gaacctttgttcgaacctggt

SEQ ID NO: 37238 - DNA, 21 bp, Artificial sequence
  SiRNA target sequence
aacctttgttcgaacctggta

SEQ ID NO: 37239 - DNA, 21 bp, Artificial sequence
  SiRNA target sequence
acctttgttcgaacctggtaa

SEQ ID NO: 37240 - DNA, 21 bp, Artificial sequence
  SiRNA target sequence
cctttgttcgaacctggtaag

SEQ ID NO: 37241 - DNA, 21 bp, Artificial sequence
  SiRNA target sequence
ctttgttcgaacctggtaaga

SEQ ID NO: 37242 - DNA, 21 bp, Artificial sequence
  SiRNA target sequence
tttgttcgaacctggtaagac

SEQ ID NO: 37243 - DNA, 21 bp, Artificial sequence
  SiRNA target sequence
ttgttcgaacctggtaagaca

SEQ ID NO: 37244 - DNA, 21 bp, Artificial sequence
  SiRNA target sequence
tgttcgaacctggtaagacag

SEQ ID NO: 37245 - DNA, 21 bp, Artificial sequence
  SiRNA target sequence
gttcgaacctggtaagacaga

SEQ ID NO: 37246 - DNA, 21 bp, Artificial sequence
  SiRNA target sequence
ttcgaacctggtaagacagac

SEQ ID NO: 37247 - DNA, 21 bp, Artificial sequence
  SiRNA target sequence
tcgaacctggtaagacagaca

SEQ ID NO: 37248 - DNA, 21 bp, Artificial sequence
  SiRNA target sequence
cgaacctggtaagacagacat

SEQ ID NO: 37249 - DNA, 21 bp, Artificial sequence
  SiRNA target sequence
gaacctggtaagacagacata

SEQ ID NO: 37250 - DNA, 21 bp, Artificial sequence
  SiRNA target sequence
aacctggtaagacagacatac

SEQ ID NO: 37251 - DNA, 21 bp, Artificial sequence
  SiRNA target sequence
acctggtaagacagacatacg

SEQ ID NO: 37252 - DNA, 21 bp, Artificial sequence
  SiRNA target sequence
cctggtaagacagacatacga

SEQ ID NO: 37253 - DNA, 21 bp, Artificial sequence
  SiRNA target sequence
ctggtaagacagacatacgac

SEQ ID NO: 37254 - DNA, 21 bp, Artificial sequence
  SiRNA target sequence
tggtaagacagacatacgacc

SEQ ID NO: 37255 - DNA, 21 bp, Artificial sequence
  SiRNA target sequence
ggtaagacagacatacgacct

SEQ ID NO: 37256 - DNA, 21 bp, Artificial sequence
  SiRNA target sequence
gtaagacagacatacgacctt

SEQ ID NO: 37257 - DNA, 21 bp, Artificial sequence
  SiRNA target sequence
taagacagacatacgaccttc

SEQ ID NO: 37258 - DNA, 21 bp, Artificial sequence
  SiRNA target sequence
aagacagacatacgaccttcc

SEQ ID NO: 37259 - DNA, 21 bp, Artificial sequence
  SiRNA target sequence
agacagacatacgaccttccc

SEQ ID NO: 37260 - DNA, 21 bp, Artificial sequence
  SiRNA target sequence
gacagacatacgaccttccct

SEQ ID NO: 37261 - DNA, 21 bp, Artificial sequence
  SiRNA target sequence
acagacatacgaccttccctg

SEQ ID NO: 37262 - DNA, 21 bp, Artificial sequence
  SiRNA target sequence
cagacatacgaccttccctgg

SEQ ID NO: 37263 - DNA, 21 bp, Artificial sequence
  SiRNA target sequence
agacatacgaccttccctggt

SEQ ID NO: 37264 - DNA, 21 bp, Artificial sequence
  SiRNA target sequence
gacatacgaccttccctggta

SEQ ID NO: 37265 - DNA, 21 bp, Artificial sequence
  SiRNA target sequence
acatacgaccttccctggtat

SEQ ID NO: 37266 - DNA, 21 bp, Artificial sequence
  SiRNA target sequence
catacgaccttccctggtata

SEQ ID NO: 37267 - DNA, 21 bp, Artificial sequence
  SiRNA target sequence
atacgaccttccctggtatat

SEQ ID NO: 37268 - DNA, 21 bp, Artificial sequence
  SiRNA target sequence
tacgaccttccctggtatatg

SEQ ID NO: 37269 - DNA, 21 bp, Artificial sequence
  SiRNA target sequence
acgaccttccctggtatatgg

SEQ ID NO: 37270 - DNA, 21 bp, Artificial sequence
  SiRNA target sequence
cgaccttccctggtatatgga

SEQ ID NO: 37271 - DNA, 21 bp, Artificial sequence
  SiRNA target sequence
gaccttccctggtatatggaa

SEQ ID NO: 37272 - DNA, 21 bp, Artificial sequence
  SiRNA target sequence
accttccctggtatatggaaa

SEQ ID NO: 37273 - DNA, 21 bp, Artificial sequence
  SiRNA target sequence
ccttccctggtatatggaaaa

SEQ ID NO: 37274 - DNA, 21 bp, Artificial sequence
  SiRNA target sequence
cttccctggtatatggaaaaa

SEQ ID NO: 37275 - DNA, 21 bp, Artificial sequence
  SiRNA target sequence
ttccctggtatatggaaaaat

SEQ ID NO: 37276 - DNA, 21 bp, Artificial sequence
  SiRNA target sequence
tccctggtatatggaaaaatc

SEQ ID NO: 37277 - DNA, 21 bp, Artificial sequence
  SiRNA target sequence
ccctggtatatggaaaaatct

SEQ ID NO: 37278 - DNA, 21 bp, Artificial sequence
  SiRNA target sequence
cctggtatatggaaaaatctc

SEQ ID NO: 37279 - DNA, 21 bp, Artificial sequence
  SiRNA target sequence
ctggtatatggaaaaatctca

SEQ ID NO: 37280 - DNA, 21 bp, Artificial sequence
  SiRNA target sequence
tggtatatggaaaaatctcag

SEQ ID NO: 37281 - DNA, 21 bp, Artificial sequence
  SiRNA target sequence
ggtatatggaaaaatctcaga

SEQ ID NO: 37282 - DNA, 21 bp, Artificial sequence
  SiRNA target sequence
gtatatggaaaaatctcagaa

SEQ ID NO: 37283 - DNA, 21 bp, Artificial sequence
  SiRNA target sequence
tatatggaaaaatctcagaaa

SEQ ID NO: 37284 - DNA, 21 bp, Artificial sequence
  SiRNA target sequence
atatggaaaaatctcagaaat

SEQ ID NO: 37285 - DNA, 21 bp, Artificial sequence
  SiRNA target sequence
tatggaaaaatctcagaaatt

SEQ ID NO: 37286 - DNA, 21 bp, Artificial sequence
  SiRNA target sequence
atggaaaaatctcagaaatta

SEQ ID NO: 37287 - DNA, 21 bp, Artificial sequence
  SiRNA target sequence
tggaaaaatctcagaaattaa

SEQ ID NO: 37288 - DNA, 21 bp, Artificial sequence
  SiRNA target sequence
ggaaaaatctcagaaattaag

SEQ ID NO: 37289 - DNA, 21 bp, Artificial sequence
  SiRNA target sequence
gaaaaatctcagaaattaaga

SEQ ID NO: 37290 - DNA, 21 bp, Artificial sequence
  SiRNA target sequence
aaaaatctcagaaattaagac

SEQ ID NO: 37291 - DNA, 21 bp, Artificial sequence
  SiRNA target sequence
aaaatctcagaaattaagaca

SEQ ID NO: 37292 - DNA, 21 bp, Artificial sequence
  SiRNA target sequence
aaatctcagaaattaagacaa

SEQ ID NO: 37293 - DNA, 21 bp, Artificial sequence
  SiRNA target sequence
aatctcagaaattaagacaaa

SEQ ID NO: 37294 - DNA, 21 bp, Artificial sequence
  SiRNA target sequence
atctcagaaattaagacaaaa

SEQ ID NO: 37295 - DNA, 21 bp, Artificial sequence
  SiRNA target sequence
tctcagaaattaagacaaaac

SEQ ID NO: 37296 - DNA, 21 bp, Artificial sequence
  SiRNA target sequence
ctcagaaattaagacaaaacc

SEQ ID NO: 37297 - DNA, 21 bp, Artificial sequence
  SiRNA target sequence
tcagaaattaagacaaaaccc

SEQ ID NO: 37298 - DNA, 21 bp, Artificial sequence
  SiRNA target sequence
cagaaattaagacaaaacccg

SEQ ID NO: 37299 - DNA, 21 bp, Artificial sequence
  SiRNA target sequence
agaaattaagacaaaacccgc

SEQ ID NO: 37300 - DNA, 21 bp, Artificial sequence
  SiRNA target sequence
gaaattaagacaaaacccgcc

SEQ ID NO: 37301 - DNA, 21 bp, Artificial sequence
  SiRNA target sequence
aaattaagacaaaacccgcca

SEQ ID NO: 37302 - DNA, 21 bp, Artificial sequence
  SiRNA target sequence
aattaagacaaaacccgccat

SEQ ID NO: 37303 - DNA, 21 bp, Artificial sequence
  SiRNA target sequence
attaagacaaaacccgccatc

SEQ ID NO: 37304 - DNA, 21 bp, Artificial sequence
  SiRNA target sequence
ttaagacaaaacccgccatcc

SEQ ID NO: 37305 - DNA, 21 bp, Artificial sequence
  SiRNA target sequence
taagacaaaacccgccatcct

SEQ ID NO: 37306 - DNA, 21 bp, Artificial sequence
  SiRNA target sequence
aagacaaaacccgccatccta

SEQ ID NO: 37307 - DNA, 21 bp, Artificial sequence
  SiRNA target sequence
agacaaaacccgccatcctaa

SEQ ID NO: 37308 - DNA, 21 bp, Artificial sequence
  SiRNA target sequence
gacaaaacccgccatcctaag

SEQ ID NO: 37309 - DNA, 21 bp, Artificial sequence
  SiRNA target sequence
acaaaacccgccatcctaaga

SEQ ID NO: 37310 - DNA, 21 bp, Artificial sequence
  SiRNA target sequence
caaaacccgccatcctaagaa

SEQ ID NO: 37311 - DNA, 21 bp, Artificial sequence
  SiRNA target sequence
aaaacccgccatcctaagaaa

SEQ ID NO: 37312 - DNA, 21 bp, Artificial sequence
  SiRNA target sequence
aaacccgccatcctaagaaat

SEQ ID NO: 37313 - DNA, 21 bp, Artificial sequence
  SiRNA target sequence
aacccgccatcctaagaaatg

SEQ ID NO: 37314 - DNA, 21 bp, Artificial sequence
  SiRNA target sequence
acccgccatcctaagaaatgt

SEQ ID NO: 37315 - DNA, 21 bp, Artificial sequence
  SiRNA target sequence
cccgccatcctaagaaatgtg

SEQ ID NO: 37316 - DNA, 21 bp, Artificial sequence
  SiRNA target sequence
ccgccatcctaagaaatgtga

SEQ ID NO: 37317 - DNA, 21 bp, Artificial sequence
  SiRNA target sequence
cgccatcctaagaaatgtgat

SEQ ID NO: 37318 - DNA, 21 bp, Artificial sequence
  SiRNA target sequence
gccatcctaagaaatgtgata

SEQ ID NO: 37319 - DNA, 21 bp, Artificial sequence
  SiRNA target sequence
ccatcctaagaaatgtgatag

SEQ ID NO: 37320 - DNA, 21 bp, Artificial sequence
  SiRNA target sequence
catcctaagaaatgtgatagt

SEQ ID NO: 37321 - DNA, 21 bp, Artificial sequence
  SiRNA target sequence
atcctaagaaatgtgatagtg

SEQ ID NO: 37322 - DNA, 21 bp, Artificial sequence
  SiRNA target sequence
tcctaagaaatgtgatagtgg

SEQ ID NO: 37323 - DNA, 21 bp, Artificial sequence
  SiRNA target sequence
cctaagaaatgtgatagtgga

SEQ ID NO: 37324 - DNA, 21 bp, Artificial sequence
  SiRNA target sequence
ctaagaaatgtgatagtggat

SEQ ID NO: 37325 - DNA, 21 bp, Artificial sequence
  SiRNA target sequence
taagaaatgtgatagtggatg

SEQ ID NO: 37326 - DNA, 21 bp, Artificial sequence
  SiRNA target sequence
aagaaatgtgatagtggatgg

SEQ ID NO: 37327 - DNA, 21 bp, Artificial sequence
  SiRNA target sequence
agaaatgtgatagtggatgga

SEQ ID NO: 37328 - DNA, 21 bp, Artificial sequence
  SiRNA target sequence
gaaatgtgatagtggatggaa

SEQ ID NO: 37329 - DNA, 21 bp, Artificial sequence
  SiRNA target sequence
aaatgtgatagtggatggaaa

SEQ ID NO: 37330 - DNA, 21 bp, Artificial sequence
  SiRNA target sequence
aatgtgatagtggatggaaaa

SEQ ID NO: 37331 - DNA, 21 bp, Artificial sequence
  SiRNA target sequence
atgtgatagtggatggaaaaa

SEQ ID NO: 37332 - DNA, 21 bp, Artificial sequence
  SiRNA target sequence
tgtgatagtggatggaaaaat

SEQ ID NO: 37333 - DNA, 21 bp, Artificial sequence
  SiRNA target sequence
gtgatagtggatggaaaaatt

SEQ ID NO: 37334 - DNA, 21 bp, Artificial sequence
  SiRNA target sequence
tgatagtggatggaaaaattg

SEQ ID NO: 37335 - DNA, 21 bp, Artificial sequence
  SiRNA target sequence
gatagtggatggaaaaattgt

SEQ ID NO: 37336 - DNA, 21 bp, Artificial sequence
  SiRNA target sequence
atagtggatggaaaaattgtt

SEQ ID NO: 37337 - DNA, 21 bp, Artificial sequence
  SiRNA target sequence
tagtggatggaaaaattgtta

SEQ ID NO: 37338 - DNA, 21 bp, Artificial sequence
  SiRNA target sequence
agtggatggaaaaattgttaa

SEQ ID NO: 37339 - DNA, 21 bp, Artificial sequence
  SiRNA target sequence
gtggatggaaaaattgttaat

SEQ ID NO: 37340 - DNA, 21 bp, Artificial sequence
  SiRNA target sequence
tggatggaaaaattgttaata

SEQ ID NO: 37341 - DNA, 21 bp, Artificial sequence
  SiRNA target sequence
ggatggaaaaattgttaatat

SEQ ID NO: 37342 - DNA, 21 bp, Artificial sequence
  SiRNA target sequence
gatggaaaaattgttaatata

SEQ ID NO: 37343 - DNA, 21 bp, Artificial sequence
  SiRNA target sequence
atggaaaaattgttaatataa

SEQ ID NO: 37344 - DNA, 21 bp, Artificial sequence
  SiRNA target sequence
tggaaaaattgttaatataaa

SEQ ID NO: 37345 - DNA, 21 bp, Artificial sequence
  SiRNA target sequence
ggaaaaattgttaatataaaa

SEQ ID NO: 37346 - DNA, 21 bp, Artificial sequence
  SiRNA target sequence
gaaaaattgttaatataaaac

SEQ ID NO: 37347 - DNA, 21 bp, Artificial sequence
  SiRNA target sequence
aaaaattgttaatataaaaca

SEQ ID NO: 37348 - DNA, 21 bp, Artificial sequence
  SiRNA target sequence
aaaattgttaatataaaacat

SEQ ID NO: 37349 - DNA, 21 bp, Artificial sequence
  SiRNA target sequence
aaattgttaatataaaacata

SEQ ID NO: 37350 - DNA, 21 bp, Artificial sequence
  SiRNA target sequence
aattgttaatataaaacataa

SEQ ID NO: 37351 - DNA, 21 bp, Artificial sequence
  SiRNA target sequence
attgttaatataaaacataaa

SEQ ID NO: 37352 - DNA, 21 bp, Artificial sequence
  SiRNA target sequence
ttgttaatataaaacataaaa

SEQ ID NO: 37353 - DNA, 21 bp, Artificial sequence
  SiRNA target sequence
tgttaatataaaacataaaaa

SEQ ID NO: 37354 - DNA, 21 bp, Artificial sequence
  SiRNA target sequence
gttaatataaaacataaaaac

SEQ ID NO: 37355 - DNA, 21 bp, Artificial sequence
  SiRNA target sequence
ttaatataaaacataaaaact

SEQ ID NO: 37356 - DNA, 21 bp, Artificial sequence
  SiRNA target sequence
taatataaaacataaaaactt

SEQ ID NO: 37357 - DNA, 21 bp, Artificial sequence
  SiRNA target sequence
aatataaaacataaaaacttg

SEQ ID NO: 37358 - DNA, 21 bp, Artificial sequence
  SiRNA target sequence
atataaaacataaaaacttga

SEQ ID NO: 37359 - DNA, 21 bp, Artificial sequence
  SiRNA target sequence
tataaaacataaaaacttgaa

SEQ ID NO: 37360 - DNA, 21 bp, Artificial sequence
  SiRNA target sequence
ataaaacataaaaacttgaag

SEQ ID NO: 37361 - DNA, 21 bp, Artificial sequence
  SiRNA target sequence
taaaacataaaaacttgaaga

SEQ ID NO: 37362 - DNA, 21 bp, Artificial sequence
  SiRNA target sequence
aaaacataaaaacttgaagaa

SEQ ID NO: 37363 - DNA, 21 bp, Artificial sequence
  SiRNA target sequence
aaacataaaaacttgaagaaa

SEQ ID NO: 37364 - DNA, 21 bp, Artificial sequence
  SiRNA target sequence
aacataaaaacttgaagaaat

SEQ ID NO: 37365 - DNA, 21 bp, Artificial sequence
  SiRNA target sequence
acataaaaacttgaagaaatg

SEQ ID NO: 37366 - DNA, 21 bp, Artificial sequence
  SiRNA target sequence
cataaaaacttgaagaaatgc

SEQ ID NO: 37367 - DNA, 21 bp, Artificial sequence
  SiRNA target sequence
ataaaaacttgaagaaatgcg

SEQ ID NO: 37368 - DNA, 21 bp, Artificial sequence
  SiRNA target sequence
taaaaacttgaagaaatgcgc

SEQ ID NO: 37369 - DNA, 21 bp, Artificial sequence
  SiRNA target sequence
aaaaacttgaagaaatgcgcc

SEQ ID NO: 37370 - DNA, 21 bp, Artificial sequence
  SiRNA target sequence
aaaacttgaagaaatgcgcca

SEQ ID NO: 37371 - DNA, 21 bp, Artificial sequence
  SiRNA target sequence
aaacttgaagaaatgcgccat

SEQ ID NO: 37372 - DNA, 21 bp, Artificial sequence
  SiRNA target sequence
aacttgaagaaatgcgccatg

SEQ ID NO: 37373 - DNA, 21 bp, Artificial sequence
  SiRNA target sequence
acttgaagaaatgcgccatgg

SEQ ID NO: 37374 - DNA, 21 bp, Artificial sequence
  SiRNA target sequence
cttgaagaaatgcgccatgga

SEQ ID NO: 37375 - DNA, 21 bp, Artificial sequence
  SiRNA target sequence
ttgaagaaatgcgccatggac

SEQ ID NO: 37376 - DNA, 21 bp, Artificial sequence
  SiRNA target sequence
tgaagaaatgcgccatggaca

SEQ ID NO: 37377 - DNA, 21 bp, Artificial sequence
  SiRNA target sequence
gaagaaatgcgccatggacac

SEQ ID NO: 37378 - DNA, 21 bp, Artificial sequence
  SiRNA target sequence
aagaaatgcgccatggacaca

SEQ ID NO: 37379 - DNA, 21 bp, Artificial sequence
  SiRNA target sequence
agaaatgcgccatggacacac

SEQ ID NO: 37380 - DNA, 21 bp, Artificial sequence
  SiRNA target sequence
gaaatgcgccatggacacacc

SEQ ID NO: 37381 - DNA, 21 bp, Artificial sequence
  SiRNA target sequence
aaatgcgccatggacacaccc

SEQ ID NO: 37382 - DNA, 21 bp, Artificial sequence
  SiRNA target sequence
aatgcgccatggacacaccct

SEQ ID NO: 37383 - DNA, 21 bp, Artificial sequence
  SiRNA target sequence
atgcgccatggacacacccta

SEQ ID NO: 37384 - DNA, 21 bp, Artificial sequence
  SiRNA target sequence
tgcgccatggacacaccctat

SEQ ID NO: 37385 - DNA, 21 bp, Artificial sequence
  SiRNA target sequence
gcgccatggacacaccctatg

SEQ ID NO: 37386 - DNA, 21 bp, Artificial sequence
  SiRNA target sequence
cgccatggacacaccctatgt

SEQ ID NO: 37387 - DNA, 21 bp, Artificial sequence
  SiRNA target sequence
gccatggacacaccctatgtg

SEQ ID NO: 37388 - DNA, 21 bp, Artificial sequence
  SiRNA target sequence
ccatggacacaccctatgtgt

SEQ ID NO: 37389 - DNA, 21 bp, Artificial sequence
  SiRNA target sequence
catggacacaccctatgtgtc

SEQ ID NO: 37390 - DNA, 21 bp, Artificial sequence
  SiRNA target sequence
atggacacaccctatgtgtca

SEQ ID NO: 37391 - DNA, 21 bp, Artificial sequence
  SiRNA target sequence
tggacacaccctatgtgtcaa

SEQ ID NO: 37392 - DNA, 21 bp, Artificial sequence
  SiRNA target sequence
ggacacaccctatgtgtcaaa

SEQ ID NO: 37393 - DNA, 21 bp, Artificial sequence
  SiRNA target sequence
gacacaccctatgtgtcaaaa

SEQ ID NO: 37394 - DNA, 21 bp, Artificial sequence
  SiRNA target sequence
acacaccctatgtgtcaaaag

SEQ ID NO: 37395 - DNA, 21 bp, Artificial sequence
  SiRNA target sequence
cacaccctatgtgtcaaaaga

SEQ ID NO: 37396 - DNA, 21 bp, Artificial sequence
  SiRNA target sequence
acaccctatgtgtcaaaagaa

SEQ ID NO: 37397 - DNA, 21 bp, Artificial sequence
  SiRNA target sequence
caccctatgtgtcaaaagaaa

SEQ ID NO: 37398 - DNA, 21 bp, Artificial sequence
  SiRNA target sequence
accctatgtgtcaaaagaaat

SEQ ID NO: 37399 - DNA, 21 bp, Artificial sequence
  SiRNA target sequence
ccctatgtgtcaaaagaaatg

SEQ ID NO: 37400 - DNA, 21 bp, Artificial sequence
  SiRNA target sequence
cctatgtgtcaaaagaaatga

SEQ ID NO: 37401 - DNA, 21 bp, Artificial sequence
  SiRNA target sequence
ctatgtgtcaaaagaaatgac

SEQ ID NO: 37402 - DNA, 21 bp, Artificial sequence
  SiRNA target sequence
tatgtgtcaaaagaaatgact

SEQ ID NO: 37403 - DNA, 21 bp, Artificial sequence
  SiRNA target sequence
atgtgtcaaaagaaatgactg

SEQ ID NO: 37404 - DNA, 21 bp, Artificial sequence
  SiRNA target sequence
tgtgtcaaaagaaatgactga

SEQ ID NO: 37405 - DNA, 21 bp, Artificial sequence
  SiRNA target sequence
gtgtcaaaagaaatgactgaa

SEQ ID NO: 37406 - DNA, 21 bp, Artificial sequence
  SiRNA target sequence
tgtcaaaagaaatgactgaag

SEQ ID NO: 37407 - DNA, 21 bp, Artificial sequence
  SiRNA target sequence
gtcaaaagaaatgactgaaga

SEQ ID NO: 37408 - DNA, 21 bp, Artificial sequence
  SiRNA target sequence
tcaaaagaaatgactgaagaa

SEQ ID NO: 37409 - DNA, 21 bp, Artificial sequence
  SiRNA target sequence
caaaagaaatgactgaagaag

SEQ ID NO: 37410 - DNA, 21 bp, Artificial sequence
  SiRNA target sequence
aaaagaaatgactgaagaagc

SEQ ID NO: 37411 - DNA, 21 bp, Artificial sequence
  SiRNA target sequence
aaagaaatgactgaagaagct

SEQ ID NO: 37412 - DNA, 21 bp, Artificial sequence
  SiRNA target sequence
aagaaatgactgaagaagctt

SEQ ID NO: 37413 - DNA, 21 bp, Artificial sequence
  SiRNA target sequence
agaaatgactgaagaagcttt

SEQ ID NO: 37414 - DNA, 21 bp, Artificial sequence
  SiRNA target sequence
gaaatgactgaagaagctttt

SEQ ID NO: 37415 - DNA, 21 bp, Artificial sequence
  SiRNA target sequence
aaatgactgaagaagcttttc

SEQ ID NO: 37416 - DNA, 21 bp, Artificial sequence
  SiRNA target sequence
aatgactgaagaagcttttca

SEQ ID NO: 37417 - DNA, 21 bp, Artificial sequence
  SiRNA target sequence
atgactgaagaagcttttcag

SEQ ID NO: 37418 - DNA, 21 bp, Artificial sequence
  SiRNA target sequence
tgactgaagaagcttttcagt

SEQ ID NO: 37419 - DNA, 21 bp, Artificial sequence
  SiRNA target sequence
gactgaagaagcttttcagtt

SEQ ID NO: 37420 - DNA, 21 bp, Artificial sequence
  SiRNA target sequence
actgaagaagcttttcagtta

SEQ ID NO: 37421 - DNA, 21 bp, Artificial sequence
  SiRNA target sequence
ctgaagaagcttttcagttag

SEQ ID NO: 37422 - DNA, 21 bp, Artificial sequence
  SiRNA target sequence
tgaagaagcttttcagttagt

SEQ ID NO: 37423 - DNA, 21 bp, Artificial sequence
  SiRNA target sequence
gaagaagcttttcagttagtt

SEQ ID NO: 37424 - DNA, 21 bp, Artificial sequence
  SiRNA target sequence
aagaagcttttcagttagtta

SEQ ID NO: 37425 - DNA, 21 bp, Artificial sequence
  SiRNA target sequence
agaagcttttcagttagttaa

SEQ ID NO: 37426 - DNA, 21 bp, Artificial sequence
  SiRNA target sequence
gaagcttttcagttagttaaa

SEQ ID NO: 37427 - DNA, 21 bp, Artificial sequence
  SiRNA target sequence
aagcttttcagttagttaaat

SEQ ID NO: 37428 - DNA, 21 bp, Artificial sequence
  SiRNA target sequence
agcttttcagttagttaaatc

SEQ ID NO: 37429 - DNA, 21 bp, Artificial sequence
  SiRNA target sequence
gcttttcagttagttaaatca

SEQ ID NO: 37430 - DNA, 21 bp, Artificial sequence
  SiRNA target sequence
cttttcagttagttaaatcag

SEQ ID NO: 37431 - DNA, 21 bp, Artificial sequence
  SiRNA target sequence
ttttcagttagttaaatcagt

SEQ ID NO: 37432 - DNA, 21 bp, Artificial sequence
  SiRNA target sequence
tttcagttagttaaatcagtc

SEQ ID NO: 37433 - DNA, 21 bp, Artificial sequence
  SiRNA target sequence
ttcagttagttaaatcagtct

SEQ ID NO: 37434 - DNA, 21 bp, Artificial sequence
  SiRNA target sequence
tcagttagttaaatcagtctg

SEQ ID NO: 37435 - DNA, 21 bp, Artificial sequence
  SiRNA target sequence
cagttagttaaatcagtctgg

SEQ ID NO: 37436 - DNA, 21 bp, Artificial sequence
  SiRNA target sequence
agttagttaaatcagtctggt

SEQ ID NO: 37437 - DNA, 21 bp, Artificial sequence
  SiRNA target sequence
gttagttaaatcagtctggtt

SEQ ID NO: 37438 - DNA, 21 bp, Artificial sequence
  SiRNA target sequence
ttagttaaatcagtctggtta

SEQ ID NO: 37439 - DNA, 21 bp, Artificial sequence
  SiRNA target sequence
tagttaaatcagtctggttaa

SEQ ID NO: 37440 - DNA, 21 bp, Artificial sequence
  SiRNA target sequence
agttaaatcagtctggttaaa

SEQ ID NO: 37441 - DNA, 21 bp, Artificial sequence
  SiRNA target sequence
gttaaatcagtctggttaaag

SEQ ID NO: 37442 - DNA, 21 bp, Artificial sequence
  SiRNA target sequence
ttaaatcagtctggttaaagg

SEQ ID NO: 37443 - DNA, 21 bp, Artificial sequence
  SiRNA target sequence
taaatcagtctggttaaaggg

SEQ ID NO: 37444 - DNA, 21 bp, Artificial sequence
  SiRNA target sequence
aaatcagtctggttaaaggga

SEQ ID NO: 37445 - DNA, 21 bp, Artificial sequence
  SiRNA target sequence
aatcagtctggttaaagggaa

SEQ ID NO: 37446 - DNA, 21 bp, Artificial sequence
  SiRNA target sequence
atcagtctggttaaagggaat

SEQ ID NO: 37447 - DNA, 21 bp, Artificial sequence
  SiRNA target sequence
tcagtctggttaaagggaatg

SEQ ID NO: 37448 - DNA, 21 bp, Artificial sequence
  SiRNA target sequence
cagtctggttaaagggaatgc

SEQ ID NO: 37449 - DNA, 21 bp, Artificial sequence
  SiRNA target sequence
agtctggttaaagggaatgcg

SEQ ID NO: 37450 - DNA, 21 bp, Artificial sequence
  SiRNA target sequence
gtctggttaaagggaatgcgt

SEQ ID NO: 37451 - DNA, 21 bp, Artificial sequence
  SiRNA target sequence
tctggttaaagggaatgcgta

SEQ ID NO: 37452 - DNA, 21 bp, Artificial sequence
  SiRNA target sequence
ctggttaaagggaatgcgtaa

SEQ ID NO: 37453 - DNA, 21 bp, Artificial sequence
  SiRNA target sequence
tggttaaagggaatgcgtaat

SEQ ID NO: 37454 - DNA, 21 bp, Artificial sequence
  SiRNA target sequence
ggttaaagggaatgcgtaatg

SEQ ID NO: 37455 - DNA, 21 bp, Artificial sequence
  SiRNA target sequence
gttaaagggaatgcgtaatga

SEQ ID NO: 37456 - DNA, 21 bp, Artificial sequence
  SiRNA target sequence
ttaaagggaatgcgtaatgaa

SEQ ID NO: 37457 - DNA, 21 bp, Artificial sequence
  SiRNA target sequence
taaagggaatgcgtaatgaat

SEQ ID NO: 37458 - DNA, 21 bp, Artificial sequence
  SiRNA target sequence
aaagggaatgcgtaatgaatt

SEQ ID NO: 37459 - DNA, 21 bp, Artificial sequence
  SiRNA target sequence
aagggaatgcgtaatgaattg

SEQ ID NO: 37460 - DNA, 21 bp, Artificial sequence
  SiRNA target sequence
agggaatgcgtaatgaattga

SEQ ID NO: 37461 - DNA, 21 bp, Artificial sequence
  SiRNA target sequence
gggaatgcgtaatgaattgaa

SEQ ID NO: 37462 - DNA, 21 bp, Artificial sequence
  SiRNA target sequence
ggaatgcgtaatgaattgaag

SEQ ID NO: 37463 - DNA, 21 bp, Artificial sequence
  SiRNA target sequence
gaatgcgtaatgaattgaaga

SEQ ID NO: 37464 - DNA, 21 bp, Artificial sequence
  SiRNA target sequence
aatgcgtaatgaattgaagaa

SEQ ID NO: 37465 - DNA, 21 bp, Artificial sequence
  SiRNA target sequence
atgcgtaatgaattgaagaaa

SEQ ID NO: 37466 - DNA, 21 bp, Artificial sequence
  SiRNA target sequence
tgcgtaatgaattgaagaaag

SEQ ID NO: 37467 - DNA, 21 bp, Artificial sequence
  SiRNA target sequence
gcgtaatgaattgaagaaagt

SEQ ID NO: 37468 - DNA, 21 bp, Artificial sequence
  SiRNA target sequence
cgtaatgaattgaagaaagtt

SEQ ID NO: 37469 - DNA, 21 bp, Artificial sequence
  SiRNA target sequence
gtaatgaattgaagaaagttt

SEQ ID NO: 37470 - DNA, 21 bp, Artificial sequence
  SiRNA target sequence
taatgaattgaagaaagtttt

SEQ ID NO: 37471 - DNA, 21 bp, Artificial sequence
  SiRNA target sequence
aatgaattgaagaaagttttg

SEQ ID NO: 37472 - DNA, 21 bp, Artificial sequence
  SiRNA target sequence
atgaattgaagaaagttttga

SEQ ID NO: 37473 - DNA, 21 bp, Artificial sequence
  SiRNA target sequence
tgaattgaagaaagttttgac

SEQ ID NO: 37474 - DNA, 21 bp, Artificial sequence
  SiRNA target sequence
gaattgaagaaagttttgact

SEQ ID NO: 37475 - DNA, 21 bp, Artificial sequence
  SiRNA target sequence
aattgaagaaagttttgactt

SEQ ID NO: 37476 - DNA, 21 bp, Artificial sequence
  SiRNA target sequence
attgaagaaagttttgactta

SEQ ID NO: 37477 - DNA, 21 bp, Artificial sequence
  SiRNA target sequence
ttgaagaaagttttgacttat

SEQ ID NO: 37478 - DNA, 21 bp, Artificial sequence
  SiRNA target sequence
tgaagaaagttttgacttatg

SEQ ID NO: 37479 - DNA, 21 bp, Artificial sequence
  SiRNA target sequence
gaagaaagttttgacttatga

SEQ ID NO: 37480 - DNA, 21 bp, Artificial sequence
  SiRNA target sequence
aagaaagttttgacttatgag

SEQ ID NO: 37481 - DNA, 21 bp, Artificial sequence
  SiRNA target sequence
agaaagttttgacttatgagg

SEQ ID NO: 37482 - DNA, 21 bp, Artificial sequence
  SiRNA target sequence
gaaagttttgacttatgagga

SEQ ID NO: 37483 - DNA, 21 bp, Artificial sequence
  SiRNA target sequence
aaagttttgacttatgaggaa

SEQ ID NO: 37484 - DNA, 21 bp, Artificial sequence
  SiRNA target sequence
aagttttgacttatgaggaag

SEQ ID NO: 37485 - DNA, 21 bp, Artificial sequence
  SiRNA target sequence
agttttgacttatgaggaagc

SEQ ID NO: 37486 - DNA, 21 bp, Artificial sequence
  SiRNA target sequence
gttttgacttatgaggaagct

SEQ ID NO: 37487 - DNA, 21 bp, Artificial sequence
  SiRNA target sequence
ttttgacttatgaggaagcta

SEQ ID NO: 37488 - DNA, 21 bp, Artificial sequence
  SiRNA target sequence
tttgacttatgaggaagctat

SEQ ID NO: 37489 - DNA, 21 bp, Artificial sequence
  SiRNA target sequence
ttgacttatgaggaagctatt

SEQ ID NO: 37490 - DNA, 21 bp, Artificial sequence
  SiRNA target sequence
tgacttatgaggaagctattt

SEQ ID NO: 37491 - DNA, 21 bp, Artificial sequence
  SiRNA target sequence
gacttatgaggaagctatttg

SEQ ID NO: 37492 - DNA, 21 bp, Artificial sequence
  SiRNA target sequence
acttatgaggaagctatttgt

SEQ ID NO: 37493 - DNA, 21 bp, Artificial sequence
  SiRNA target sequence
cttatgaggaagctatttgtg

SEQ ID NO: 37494 - DNA, 21 bp, Artificial sequence
  SiRNA target sequence
ttatgaggaagctatttgtgg

SEQ ID NO: 37495 - DNA, 21 bp, Artificial sequence
  SiRNA target sequence
tatgaggaagctatttgtgga

SEQ ID NO: 37496 - DNA, 21 bp, Artificial sequence
  SiRNA target sequence
atgaggaagctatttgtggaa

SEQ ID NO: 37497 - DNA, 21 bp, Artificial sequence
  SiRNA target sequence
tgaggaagctatttgtggaaa

SEQ ID NO: 37498 - DNA, 21 bp, Artificial sequence
  SiRNA target sequence
gaggaagctatttgtggaaat

SEQ ID NO: 37499 - DNA, 21 bp, Artificial sequence
  SiRNA target sequence
aggaagctatttgtggaaatg

SEQ ID NO: 37500 - DNA, 21 bp, Artificial sequence
  SiRNA target sequence
ggaagctatttgtggaaatga

SEQ ID NO: 37501 - DNA, 21 bp, Artificial sequence
  SiRNA target sequence
gaagctatttgtggaaatgat

SEQ ID NO: 37502 - DNA, 21 bp, Artificial sequence
  SiRNA target sequence
aagctatttgtggaaatgatt

SEQ ID NO: 37503 - DNA, 21 bp, Artificial sequence
  SiRNA target sequence
agctatttgtggaaatgattc

SEQ ID NO: 37504 - DNA, 21 bp, Artificial sequence
  SiRNA target sequence
gctatttgtggaaatgattca

SEQ ID NO: 37505 - DNA, 21 bp, Artificial sequence
  SiRNA target sequence
ctatttgtggaaatgattcaa

SEQ ID NO: 37506 - DNA, 21 bp, Artificial sequence
  SiRNA target sequence
tatttgtggaaatgattcaag

SEQ ID NO: 37507 - DNA, 21 bp, Artificial sequence
  SiRNA target sequence
atttgtggaaatgattcaagt

SEQ ID NO: 37508 - DNA, 21 bp, Artificial sequence
  SiRNA target sequence
tttgtggaaatgattcaagtg

SEQ ID NO: 37509 - DNA, 21 bp, Artificial sequence
  SiRNA target sequence
ttgtggaaatgattcaagtga

SEQ ID NO: 37510 - DNA, 21 bp, Artificial sequence
  SiRNA target sequence
tgtggaaatgattcaagtgaa

SEQ ID NO: 37511 - DNA, 21 bp, Artificial sequence
  SiRNA target sequence
gtggaaatgattcaagtgaat

SEQ ID NO: 37512 - DNA, 21 bp, Artificial sequence
  SiRNA target sequence
tggaaatgattcaagtgaatt

SEQ ID NO: 37513 - DNA, 21 bp, Artificial sequence
  SiRNA target sequence
ggaaatgattcaagtgaattt

SEQ ID NO: 37514 - DNA, 21 bp, Artificial sequence
  SiRNA target sequence
gaaatgattcaagtgaattta

SEQ ID NO: 37515 - DNA, 21 bp, Artificial sequence
  SiRNA target sequence
aaatgattcaagtgaatttat

SEQ ID NO: 37516 - DNA, 21 bp, Artificial sequence
  SiRNA target sequence
aatgattcaagtgaatttata

SEQ ID NO: 37517 - DNA, 21 bp, Artificial sequence
  SiRNA target sequence
atgattcaagtgaatttatat

SEQ ID NO: 37518 - DNA, 21 bp, Artificial sequence
  SiRNA target sequence
tgattcaagtgaatttatatc

SEQ ID NO: 37519 - DNA, 21 bp, Artificial sequence
  SiRNA target sequence
gattcaagtgaatttatatca

SEQ ID NO: 37520 - DNA, 21 bp, Artificial sequence
  SiRNA target sequence
attcaagtgaatttatatcag

SEQ ID NO: 37521 - DNA, 21 bp, Artificial sequence
  SiRNA target sequence
ttcaagtgaatttatatcagc

SEQ ID NO: 37522 - DNA, 21 bp, Artificial sequence
  SiRNA target sequence
tcaagtgaatttatatcagca

SEQ ID NO: 37523 - DNA, 21 bp, Artificial sequence
  SiRNA target sequence
caagtgaatttatatcagcaa

SEQ ID NO: 37524 - DNA, 21 bp, Artificial sequence
  SiRNA target sequence
aagtgaatttatatcagcaat

SEQ ID NO: 37525 - DNA, 21 bp, Artificial sequence
  SiRNA target sequence
agtgaatttatatcagcaata

SEQ ID NO: 37526 - DNA, 21 bp, Artificial sequence
  SiRNA target sequence
gtgaatttatatcagcaataa

SEQ ID NO: 37527 - DNA, 21 bp, Artificial sequence
  SiRNA target sequence
tgaatttatatcagcaataaa

SEQ ID NO: 37528 - DNA, 21 bp, Artificial sequence
  SiRNA target sequence
gaatttatatcagcaataaat

SEQ ID NO: 37529 - DNA, 21 bp, Artificial sequence
  SiRNA target sequence
aatttatatcagcaataaata

SEQ ID NO: 37530 - DNA, 21 bp, Artificial sequence
  SiRNA target sequence
atttatatcagcaataaatag

SEQ ID NO: 37531 - DNA, 21 bp, Artificial sequence
  SiRNA target sequence
tttatatcagcaataaataga

SEQ ID NO: 37532 - DNA, 21 bp, Artificial sequence
  SiRNA target sequence
ttatatcagcaataaatagat

SEQ ID NO: 37533 - DNA, 21 bp, Artificial sequence
  SiRNA target sequence
tatatcagcaataaatagatc

SEQ ID NO: 37534 - DNA, 21 bp, Artificial sequence
  SiRNA target sequence
atatcagcaataaatagatct

SEQ ID NO: 37535 - DNA, 21 bp, Artificial sequence
  SiRNA target sequence
tatcagcaataaatagatcta

SEQ ID NO: 37536 - DNA, 21 bp, Artificial sequence
  SiRNA target sequence
atcagcaataaatagatctag

SEQ ID NO: 37537 - DNA, 21 bp, Artificial sequence
  SiRNA target sequence
tcagcaataaatagatctagt

SEQ ID NO: 37538 - DNA, 21 bp, Artificial sequence
  SiRNA target sequence
cagcaataaatagatctagtt

SEQ ID NO: 37539 - DNA, 21 bp, Artificial sequence
  SiRNA target sequence
agcaataaatagatctagttc

SEQ ID NO: 37540 - DNA, 21 bp, Artificial sequence
  SiRNA target sequence
gcaataaatagatctagttca

SEQ ID NO: 37541 - DNA, 21 bp, Artificial sequence
  SiRNA target sequence
caataaatagatctagttcac

SEQ ID NO: 37542 - DNA, 21 bp, Artificial sequence
  SiRNA target sequence
aataaatagatctagttcacc

SEQ ID NO: 37543 - DNA, 21 bp, Artificial sequence
  SiRNA target sequence
ataaatagatctagttcaccg

SEQ ID NO: 37544 - DNA, 21 bp, Artificial sequence
  SiRNA target sequence
taaatagatctagttcaccgg

SEQ ID NO: 37545 - DNA, 21 bp, Artificial sequence
  SiRNA target sequence
aaatagatctagttcaccggg

SEQ ID NO: 37546 - DNA, 21 bp, Artificial sequence
  SiRNA target sequence
aatagatctagttcaccgggt

SEQ ID NO: 37547 - DNA, 21 bp, Artificial sequence
  SiRNA target sequence
atagatctagttcaccgggtt

SEQ ID NO: 37548 - DNA, 21 bp, Artificial sequence
  SiRNA target sequence
tagatctagttcaccgggttt

SEQ ID NO: 37549 - DNA, 21 bp, Artificial sequence
  SiRNA target sequence
agatctagttcaccgggtttc

SEQ ID NO: 37550 - DNA, 21 bp, Artificial sequence
  SiRNA target sequence
gatctagttcaccgggtttcc

SEQ ID NO: 37551 - DNA, 21 bp, Artificial sequence
  SiRNA target sequence
atctagttcaccgggtttccc

SEQ ID NO: 37552 - DNA, 21 bp, Artificial sequence
  SiRNA target sequence
tctagttcaccgggtttccca

SEQ ID NO: 37553 - DNA, 21 bp, Artificial sequence
  SiRNA target sequence
ctagttcaccgggtttcccat

SEQ ID NO: 37554 - DNA, 21 bp, Artificial sequence
  SiRNA target sequence
tagttcaccgggtttcccatg

SEQ ID NO: 37555 - DNA, 21 bp, Artificial sequence
  SiRNA target sequence
agttcaccgggtttcccatgg

SEQ ID NO: 37556 - DNA, 21 bp, Artificial sequence
  SiRNA target sequence
gttcaccgggtttcccatgga

SEQ ID NO: 37557 - DNA, 21 bp, Artificial sequence
  SiRNA target sequence
ttcaccgggtttcccatggat

SEQ ID NO: 37558 - DNA, 21 bp, Artificial sequence
  SiRNA target sequence
tcaccgggtttcccatggata

SEQ ID NO: 37559 - DNA, 21 bp, Artificial sequence
  SiRNA target sequence
caccgggtttcccatggatac

SEQ ID NO: 37560 - DNA, 21 bp, Artificial sequence
  SiRNA target sequence
accgggtttcccatggatacg

SEQ ID NO: 37561 - DNA, 21 bp, Artificial sequence
  SiRNA target sequence
ccgggtttcccatggatacgc

SEQ ID NO: 37562 - DNA, 21 bp, Artificial sequence
  SiRNA target sequence
cgggtttcccatggatacgcg

SEQ ID NO: 37563 - DNA, 21 bp, Artificial sequence
  SiRNA target sequence
gggtttcccatggatacgcga

SEQ ID NO: 37564 - DNA, 21 bp, Artificial sequence
  SiRNA target sequence
ggtttcccatggatacgcgat

SEQ ID NO: 37565 - DNA, 21 bp, Artificial sequence
  SiRNA target sequence
gtttcccatggatacgcgata

SEQ ID NO: 37566 - DNA, 21 bp, Artificial sequence
  SiRNA target sequence
tttcccatggatacgcgatag

SEQ ID NO: 37567 - DNA, 21 bp, Artificial sequence
  SiRNA target sequence
ttcccatggatacgcgataga

SEQ ID NO: 37568 - DNA, 21 bp, Artificial sequence
  SiRNA target sequence
tcccatggatacgcgatagaa

SEQ ID NO: 37569 - DNA, 21 bp, Artificial sequence
  SiRNA target sequence
cccatggatacgcgatagaat

SEQ ID NO: 37570 - DNA, 21 bp, Artificial sequence
  SiRNA target sequence
ccatggatacgcgatagaatt

SEQ ID NO: 37571 - DNA, 21 bp, Artificial sequence
  SiRNA target sequence
catggatacgcgatagaatta

SEQ ID NO: 37572 - DNA, 21 bp, Artificial sequence
  SiRNA target sequence
atggatacgcgatagaattaa

SEQ ID NO: 37573 - DNA, 21 bp, Artificial sequence
  SiRNA target sequence
tggatacgcgatagaattaaa

SEQ ID NO: 37574 - DNA, 21 bp, Artificial sequence
  SiRNA target sequence
ggatacgcgatagaattaaag

SEQ ID NO: 37575 - DNA, 21 bp, Artificial sequence
  SiRNA target sequence
gatacgcgatagaattaaagg

SEQ ID NO: 37576 - DNA, 21 bp, Artificial sequence
  SiRNA target sequence
atacgcgatagaattaaagga

SEQ ID NO: 37577 - DNA, 21 bp, Artificial sequence
  SiRNA target sequence
tacgcgatagaattaaaggaa

SEQ ID NO: 37578 - DNA, 21 bp, Artificial sequence
  SiRNA target sequence
acgcgatagaattaaaggaac

SEQ ID NO: 37579 - DNA, 21 bp, Artificial sequence
  SiRNA target sequence
cgcgatagaattaaaggaact

SEQ ID NO: 37580 - DNA, 21 bp, Artificial sequence
  SiRNA target sequence
gcgatagaattaaaggaacta

SEQ ID NO: 37581 - DNA, 21 bp, Artificial sequence
  SiRNA target sequence
cgatagaattaaaggaactaa

SEQ ID NO: 37582 - DNA, 21 bp, Artificial sequence
  SiRNA target sequence
gatagaattaaaggaactaaa

SEQ ID NO: 37583 - DNA, 21 bp, Artificial sequence
  SiRNA target sequence
atagaattaaaggaactaaag

SEQ ID NO: 37584 - DNA, 21 bp, Artificial sequence
  SiRNA target sequence
tagaattaaaggaactaaagg

SEQ ID NO: 37585 - DNA, 21 bp, Artificial sequence
  SiRNA target sequence
agaattaaaggaactaaaggg

SEQ ID NO: 37586 - DNA, 21 bp, Artificial sequence
  SiRNA target sequence
gaattaaaggaactaaaggga

SEQ ID NO: 37587 - DNA, 21 bp, Artificial sequence
  SiRNA target sequence
aattaaaggaactaaagggaa

SEQ ID NO: 37588 - DNA, 21 bp, Artificial sequence
  SiRNA target sequence
attaaaggaactaaagggaag

SEQ ID NO: 37589 - DNA, 21 bp, Artificial sequence
  SiRNA target sequence
ttaaaggaactaaagggaagc

SEQ ID NO: 37590 - DNA, 21 bp, Artificial sequence
  SiRNA target sequence
taaaggaactaaagggaagca

SEQ ID NO: 37591 - DNA, 21 bp, Artificial sequence
  SiRNA target sequence
aaaggaactaaagggaagcaa

SEQ ID NO: 37592 - DNA, 21 bp, Artificial sequence
  SiRNA target sequence
aaggaactaaagggaagcaag

SEQ ID NO: 37593 - DNA, 21 bp, Artificial sequence
  SiRNA target sequence
aggaactaaagggaagcaagg

SEQ ID NO: 37594 - DNA, 21 bp, Artificial sequence
  SiRNA target sequence
ggaactaaagggaagcaaggt

SEQ ID NO: 37595 - DNA, 21 bp, Artificial sequence
  SiRNA target sequence
gaactaaagggaagcaaggtt

SEQ ID NO: 37596 - DNA, 21 bp, Artificial sequence
  SiRNA target sequence
aactaaagggaagcaaggttg

SEQ ID NO: 37597 - DNA, 21 bp, Artificial sequence
  SiRNA target sequence
actaaagggaagcaaggttgg

SEQ ID NO: 37598 - DNA, 21 bp, Artificial sequence
  SiRNA target sequence
ctaaagggaagcaaggttggt

SEQ ID NO: 37599 - DNA, 21 bp, Artificial sequence
  SiRNA target sequence
taaagggaagcaaggttggtt

SEQ ID NO: 37600 - DNA, 21 bp, Artificial sequence
  SiRNA target sequence
aaagggaagcaaggttggttt

SEQ ID NO: 37601 - DNA, 21 bp, Artificial sequence
  SiRNA target sequence
aagggaagcaaggttggtttg

SEQ ID NO: 37602 - DNA, 21 bp, Artificial sequence
  SiRNA target sequence
agggaagcaaggttggtttgg

SEQ ID NO: 37603 - DNA, 21 bp, Artificial sequence
  SiRNA target sequence
gggaagcaaggttggtttggt

SEQ ID NO: 37604 - DNA, 21 bp, Artificial sequence
  SiRNA target sequence
ggaagcaaggttggtttggtg

SEQ ID NO: 37605 - DNA, 21 bp, Artificial sequence
  SiRNA target sequence
gaagcaaggttggtttggtgc

SEQ ID NO: 37606 - DNA, 21 bp, Artificial sequence
  SiRNA target sequence
aagcaaggttggtttggtgcg

SEQ ID NO: 37607 - DNA, 21 bp, Artificial sequence
  SiRNA target sequence
agcaaggttggtttggtgcgg

SEQ ID NO: 37608 - DNA, 21 bp, Artificial sequence
  SiRNA target sequence
gcaaggttggtttggtgcgga

SEQ ID NO: 37609 - DNA, 21 bp, Artificial sequence
  SiRNA target sequence
caaggttggtttggtgcggaa

SEQ ID NO: 37610 - DNA, 21 bp, Artificial sequence
  SiRNA target sequence
aaggttggtttggtgcggaag

SEQ ID NO: 37611 - DNA, 21 bp, Artificial sequence
  SiRNA target sequence
aggttggtttggtgcggaagg

SEQ ID NO: 37612 - DNA, 21 bp, Artificial sequence
  SiRNA target sequence
ggttggtttggtgcggaaggc

SEQ ID NO: 37613 - DNA, 21 bp, Artificial sequence
  SiRNA target sequence
gttggtttggtgcggaaggcg

SEQ ID NO: 37614 - DNA, 21 bp, Artificial sequence
  SiRNA target sequence
ttggtttggtgcggaaggcga

SEQ ID NO: 37615 - DNA, 21 bp, Artificial sequence
  SiRNA target sequence
tggtttggtgcggaaggcgaa

SEQ ID NO: 37616 - DNA, 21 bp, Artificial sequence
  SiRNA target sequence
ggtttggtgcggaaggcgaat

SEQ ID NO: 37617 - DNA, 21 bp, Artificial sequence
  SiRNA target sequence
gtttggtgcggaaggcgaata

SEQ ID NO: 37618 - DNA, 21 bp, Artificial sequence
  SiRNA target sequence
tttggtgcggaaggcgaatat

SEQ ID NO: 37619 - DNA, 21 bp, Artificial sequence
  SiRNA target sequence
ttggtgcggaaggcgaatata

SEQ ID NO: 37620 - DNA, 21 bp, Artificial sequence
  SiRNA target sequence
tggtgcggaaggcgaatatat

SEQ ID NO: 37621 - DNA, 21 bp, Artificial sequence
  SiRNA target sequence
ggtgcggaaggcgaatatatt

SEQ ID NO: 37622 - DNA, 21 bp, Artificial sequence
  SiRNA target sequence
gtgcggaaggcgaatatattc

SEQ ID NO: 37623 - DNA, 21 bp, Artificial sequence
  SiRNA target sequence
tgcggaaggcgaatatattct

SEQ ID NO: 37624 - DNA, 21 bp, Artificial sequence
  SiRNA target sequence
gcggaaggcgaatatattctg

SEQ ID NO: 37625 - DNA, 21 bp, Artificial sequence
  SiRNA target sequence
cggaaggcgaatatattctgg

SEQ ID NO: 37626 - DNA, 21 bp, Artificial sequence
  SiRNA target sequence
ggaaggcgaatatattctgga

SEQ ID NO: 37627 - DNA, 21 bp, Artificial sequence
  SiRNA target sequence
gaaggcgaatatattctggat

SEQ ID NO: 37628 - DNA, 21 bp, Artificial sequence
  SiRNA target sequence
aaggcgaatatattctggatg

SEQ ID NO: 37629 - DNA, 21 bp, Artificial sequence
  SiRNA target sequence
aggcgaatatattctggatga

SEQ ID NO: 37630 - DNA, 21 bp, Artificial sequence
  SiRNA target sequence
ggcgaatatattctggatgaa

SEQ ID NO: 37631 - DNA, 21 bp, Artificial sequence
  SiRNA target sequence
gcgaatatattctggatgaag

SEQ ID NO: 37632 - DNA, 21 bp, Artificial sequence
  SiRNA target sequence
cgaatatattctggatgaaga

SEQ ID NO: 37633 - DNA, 21 bp, Artificial sequence
  SiRNA target sequence
gaatatattctggatgaagat

SEQ ID NO: 37634 - DNA, 21 bp, Artificial sequence
  SiRNA target sequence
aatatattctggatgaagatg

SEQ ID NO: 37635 - DNA, 21 bp, Artificial sequence
  SiRNA target sequence
atatattctggatgaagatgt

SEQ ID NO: 37636 - DNA, 21 bp, Artificial sequence
  SiRNA target sequence
tatattctggatgaagatgtc

SEQ ID NO: 37637 - DNA, 21 bp, Artificial sequence
  SiRNA target sequence
atattctggatgaagatgtct

SEQ ID NO: 37638 - DNA, 21 bp, Artificial sequence
  SiRNA target sequence
tattctggatgaagatgtctt

SEQ ID NO: 37639 - DNA, 21 bp, Artificial sequence
  SiRNA target sequence
attctggatgaagatgtcttt

SEQ ID NO: 37640 - DNA, 21 bp, Artificial sequence
  SiRNA target sequence
ttctggatgaagatgtctttg

SEQ ID NO: 37641 - DNA, 21 bp, Artificial sequence
  SiRNA target sequence
tctggatgaagatgtctttga

SEQ ID NO: 37642 - DNA, 21 bp, Artificial sequence
  SiRNA target sequence
ctggatgaagatgtctttgaa

SEQ ID NO: 37643 - DNA, 21 bp, Artificial sequence
  SiRNA target sequence
tggatgaagatgtctttgaag

SEQ ID NO: 37644 - DNA, 21 bp, Artificial sequence
  SiRNA target sequence
ggatgaagatgtctttgaagc

SEQ ID NO: 37645 - DNA, 21 bp, Artificial sequence
  SiRNA target sequence
gatgaagatgtctttgaagcg

SEQ ID NO: 37646 - DNA, 21 bp, Artificial sequence
  SiRNA target sequence
atgaagatgtctttgaagcgg

SEQ ID NO: 37647 - DNA, 21 bp, Artificial sequence
  SiRNA target sequence
tgaagatgtctttgaagcggt

SEQ ID NO: 37648 - DNA, 21 bp, Artificial sequence
  SiRNA target sequence
gaagatgtctttgaagcggtt

SEQ ID NO: 37649 - DNA, 21 bp, Artificial sequence
  SiRNA target sequence
aagatgtctttgaagcggtta

SEQ ID NO: 37650 - DNA, 21 bp, Artificial sequence
  SiRNA target sequence
agatgtctttgaagcggttaa

SEQ ID NO: 37651 - DNA, 21 bp, Artificial sequence
  SiRNA target sequence
gatgtctttgaagcggttaaa

SEQ ID NO: 37652 - DNA, 21 bp, Artificial sequence
  SiRNA target sequence
atgtctttgaagcggttaaaa

SEQ ID NO: 37653 - DNA, 21 bp, Artificial sequence
  SiRNA target sequence
tgtctttgaagcggttaaaac

SEQ ID NO: 37654 - DNA, 21 bp, Artificial sequence
  SiRNA target sequence
gtctttgaagcggttaaaaca

SEQ ID NO: 37655 - DNA, 21 bp, Artificial sequence
  SiRNA target sequence
tctttgaagcggttaaaacac

SEQ ID NO: 37656 - DNA, 21 bp, Artificial sequence
  SiRNA target sequence
ctttgaagcggttaaaacacg

SEQ ID NO: 37657 - DNA, 21 bp, Artificial sequence
  SiRNA target sequence
tttgaagcggttaaaacacgt

SEQ ID NO: 37658 - DNA, 21 bp, Artificial sequence
  SiRNA target sequence
ttgaagcggttaaaacacgta

SEQ ID NO: 37659 - DNA, 21 bp, Artificial sequence
  SiRNA target sequence
tgaagcggttaaaacacgtat

SEQ ID NO: 37660 - DNA, 21 bp, Artificial sequence
  SiRNA target sequence
gaagcggttaaaacacgtatt

SEQ ID NO: 37661 - DNA, 21 bp, Artificial sequence
  SiRNA target sequence
aagcggttaaaacacgtattc

SEQ ID NO: 37662 - DNA, 21 bp, Artificial sequence
  SiRNA target sequence
agcggttaaaacacgtattca

SEQ ID NO: 37663 - DNA, 21 bp, Artificial sequence
  SiRNA target sequence
gcggttaaaacacgtattcag

SEQ ID NO: 37664 - DNA, 21 bp, Artificial sequence
  SiRNA target sequence
cggttaaaacacgtattcaga

SEQ ID NO: 37665 - DNA, 21 bp, Artificial sequence
  SiRNA target sequence
ggttaaaacacgtattcagaa

SEQ ID NO: 37666 - DNA, 21 bp, Artificial sequence
  SiRNA target sequence
gttaaaacacgtattcagaat

SEQ ID NO: 37667 - DNA, 21 bp, Artificial sequence
  SiRNA target sequence
ttaaaacacgtattcagaatg

SEQ ID NO: 37668 - DNA, 21 bp, Artificial sequence
  SiRNA target sequence
taaaacacgtattcagaatgc

SEQ ID NO: 37669 - DNA, 21 bp, Artificial sequence
  SiRNA target sequence
aaaacacgtattcagaatgca

SEQ ID NO: 37670 - DNA, 21 bp, Artificial sequence
  SiRNA target sequence
aaacacgtattcagaatgcaa

SEQ ID NO: 37671 - DNA, 21 bp, Artificial sequence
  SiRNA target sequence
aacacgtattcagaatgcaaa

SEQ ID NO: 37672 - DNA, 21 bp, Artificial sequence
  SiRNA target sequence
acacgtattcagaatgcaaag

SEQ ID NO: 37673 - DNA, 21 bp, Artificial sequence
  SiRNA target sequence
cacgtattcagaatgcaaaga

SEQ ID NO: 37674 - DNA, 21 bp, Artificial sequence
  SiRNA target sequence
acgtattcagaatgcaaagaa

SEQ ID NO: 37675 - DNA, 21 bp, Artificial sequence
  SiRNA target sequence
cgtattcagaatgcaaagaat

SEQ ID NO: 37676 - DNA, 21 bp, Artificial sequence
  SiRNA target sequence
gtattcagaatgcaaagaatg

SEQ ID NO: 37677 - DNA, 21 bp, Artificial sequence
  SiRNA target sequence
tattcagaatgcaaagaatgg

SEQ ID NO: 37678 - DNA, 21 bp, Artificial sequence
  SiRNA target sequence
attcagaatgcaaagaatggt

SEQ ID NO: 37679 - DNA, 21 bp, Artificial sequence
  SiRNA target sequence
ttcagaatgcaaagaatggtg

SEQ ID NO: 37680 - DNA, 21 bp, Artificial sequence
  SiRNA target sequence
tcagaatgcaaagaatggtgt

SEQ ID NO: 37681 - DNA, 21 bp, Artificial sequence
  SiRNA target sequence
cagaatgcaaagaatggtgtg

SEQ ID NO: 37682 - DNA, 21 bp, Artificial sequence
  SiRNA target sequence
agaatgcaaagaatggtgtga

SEQ ID NO: 37683 - DNA, 21 bp, Artificial sequence
  SiRNA target sequence
gaatgcaaagaatggtgtgag

SEQ ID NO: 37684 - DNA, 21 bp, Artificial sequence
  SiRNA target sequence
aatgcaaagaatggtgtgaga

SEQ ID NO: 37685 - DNA, 21 bp, Artificial sequence
  SiRNA target sequence
atgcaaagaatggtgtgagaa

SEQ ID NO: 37686 - DNA, 21 bp, Artificial sequence
  SiRNA target sequence
tgcaaagaatggtgtgagaac

SEQ ID NO: 37687 - DNA, 21 bp, Artificial sequence
  SiRNA target sequence
gcaaagaatggtgtgagaaca

SEQ ID NO: 37688 - DNA, 21 bp, Artificial sequence
  SiRNA target sequence
caaagaatggtgtgagaacac

SEQ ID NO: 37689 - DNA, 21 bp, Artificial sequence
  SiRNA target sequence
aaagaatggtgtgagaacacc

SEQ ID NO: 37690 - DNA, 21 bp, Artificial sequence
  SiRNA target sequence
aagaatggtgtgagaacacct

SEQ ID NO: 37691 - DNA, 21 bp, Artificial sequence
  SiRNA target sequence
agaatggtgtgagaacacctg

SEQ ID NO: 37692 - DNA, 21 bp, Artificial sequence
  SiRNA target sequence
gaatggtgtgagaacacctgt

SEQ ID NO: 37693 - DNA, 21 bp, Artificial sequence
  SiRNA target sequence
aatggtgtgagaacacctgta

SEQ ID NO: 37694 - DNA, 21 bp, Artificial sequence
  SiRNA target sequence
atggtgtgagaacacctgtaa

SEQ ID NO: 37695 - DNA, 21 bp, Artificial sequence
  SiRNA target sequence
tggtgtgagaacacctgtaat

SEQ ID NO: 37696 - DNA, 21 bp, Artificial sequence
  SiRNA target sequence
ggtgtgagaacacctgtaatg

SEQ ID NO: 37697 - DNA, 21 bp, Artificial sequence
  SiRNA target sequence
gtgtgagaacacctgtaatgt

SEQ ID NO: 37698 - DNA, 21 bp, Artificial sequence
  SiRNA target sequence
tgtgagaacacctgtaatgtg

SEQ ID NO: 37699 - DNA, 21 bp, Artificial sequence
  SiRNA target sequence
gtgagaacacctgtaatgtgg

SEQ ID NO: 37700 - DNA, 21 bp, Artificial sequence
  SiRNA target sequence
tgagaacacctgtaatgtggg

SEQ ID NO: 37701 - DNA, 21 bp, Artificial sequence
  SiRNA target sequence
gagaacacctgtaatgtgggt

SEQ ID NO: 37702 - DNA, 21 bp, Artificial sequence
  SiRNA target sequence
agaacacctgtaatgtgggtg

SEQ ID NO: 37703 - DNA, 21 bp, Artificial sequence
  SiRNA target sequence
gaacacctgtaatgtgggtgg

SEQ ID NO: 37704 - DNA, 21 bp, Artificial sequence
  SiRNA target sequence
aacacctgtaatgtgggtgga

SEQ ID NO: 37705 - DNA, 21 bp, Artificial sequence
  SiRNA target sequence
acacctgtaatgtgggtggat

SEQ ID NO: 37706 - DNA, 21 bp, Artificial sequence
  SiRNA target sequence
cacctgtaatgtgggtggata

SEQ ID NO: 37707 - DNA, 21 bp, Artificial sequence
  SiRNA target sequence
acctgtaatgtgggtggatac

SEQ ID NO: 37708 - DNA, 21 bp, Artificial sequence
  SiRNA target sequence
cctgtaatgtgggtggataca

SEQ ID NO: 37709 - DNA, 21 bp, Artificial sequence
  SiRNA target sequence
ctgtaatgtgggtggatacat

SEQ ID NO: 37710 - DNA, 21 bp, Artificial sequence
  SiRNA target sequence
tgtaatgtgggtggatacatt

SEQ ID NO: 37711 - DNA, 21 bp, Artificial sequence
  SiRNA target sequence
gtaatgtgggtggatacatta

SEQ ID NO: 37712 - DNA, 21 bp, Artificial sequence
  SiRNA target sequence
taatgtgggtggatacattaa

SEQ ID NO: 37713 - DNA, 21 bp, Artificial sequence
  SiRNA target sequence
aatgtgggtggatacattaaa

SEQ ID NO: 37714 - DNA, 21 bp, Artificial sequence
  SiRNA target sequence
atgtgggtggatacattaaag

SEQ ID NO: 37715 - DNA, 21 bp, Artificial sequence
  SiRNA target sequence
tgtgggtggatacattaaagg

SEQ ID NO: 37716 - DNA, 21 bp, Artificial sequence
  SiRNA target sequence
gtgggtggatacattaaagga

SEQ ID NO: 37717 - DNA, 21 bp, Artificial sequence
  SiRNA target sequence
tgggtggatacattaaaggat

SEQ ID NO: 37718 - DNA, 21 bp, Artificial sequence
  SiRNA target sequence
gggtggatacattaaaggatg

SEQ ID NO: 37719 - DNA, 21 bp, Artificial sequence
  SiRNA target sequence
ggtggatacattaaaggatga

SEQ ID NO: 37720 - DNA, 21 bp, Artificial sequence
  SiRNA target sequence
gtggatacattaaaggatgag

SEQ ID NO: 37721 - DNA, 21 bp, Artificial sequence
  SiRNA target sequence
tggatacattaaaggatgaga

SEQ ID NO: 37722 - DNA, 21 bp, Artificial sequence
  SiRNA target sequence
ggatacattaaaggatgagag

SEQ ID NO: 37723 - DNA, 21 bp, Artificial sequence
  SiRNA target sequence
gatacattaaaggatgagaga

SEQ ID NO: 37724 - DNA, 21 bp, Artificial sequence
  SiRNA target sequence
atacattaaaggatgagagaa

SEQ ID NO: 37725 - DNA, 21 bp, Artificial sequence
  SiRNA target sequence
tacattaaaggatgagagaag

SEQ ID NO: 37726 - DNA, 21 bp, Artificial sequence
  SiRNA target sequence
acattaaaggatgagagaaga

SEQ ID NO: 37727 - DNA, 21 bp, Artificial sequence
  SiRNA target sequence
cattaaaggatgagagaagac

SEQ ID NO: 37728 - DNA, 21 bp, Artificial sequence
  SiRNA target sequence
attaaaggatgagagaagacc

SEQ ID NO: 37729 - DNA, 21 bp, Artificial sequence
  SiRNA target sequence
ttaaaggatgagagaagacca

SEQ ID NO: 37730 - DNA, 21 bp, Artificial sequence
  SiRNA target sequence
taaaggatgagagaagaccaa

SEQ ID NO: 37731 - DNA, 21 bp, Artificial sequence
  SiRNA target sequence
aaaggatgagagaagaccaat

SEQ ID NO: 37732 - DNA, 21 bp, Artificial sequence
  SiRNA target sequence
aaggatgagagaagaccaatt

SEQ ID NO: 37733 - DNA, 21 bp, Artificial sequence
  SiRNA target sequence
aggatgagagaagaccaattg

SEQ ID NO: 37734 - DNA, 21 bp, Artificial sequence
  SiRNA target sequence
ggatgagagaagaccaattga

SEQ ID NO: 37735 - DNA, 21 bp, Artificial sequence
  SiRNA target sequence
gatgagagaagaccaattgaa

SEQ ID NO: 37736 - DNA, 21 bp, Artificial sequence
  SiRNA target sequence
atgagagaagaccaattgaaa

SEQ ID NO: 37737 - DNA, 21 bp, Artificial sequence
  SiRNA target sequence
tgagagaagaccaattgaaaa

SEQ ID NO: 37738 - DNA, 21 bp, Artificial sequence
  SiRNA target sequence
gagagaagaccaattgaaaaa

SEQ ID NO: 37739 - DNA, 21 bp, Artificial sequence
  SiRNA target sequence
agagaagaccaattgaaaaag

SEQ ID NO: 37740 - DNA, 21 bp, Artificial sequence
  SiRNA target sequence
gagaagaccaattgaaaaagt

SEQ ID NO: 37741 - DNA, 21 bp, Artificial sequence
  SiRNA target sequence
agaagaccaattgaaaaagta

SEQ ID NO: 37742 - DNA, 21 bp, Artificial sequence
  SiRNA target sequence
gaagaccaattgaaaaagtag

SEQ ID NO: 37743 - DNA, 21 bp, Artificial sequence
  SiRNA target sequence
aagaccaattgaaaaagtaga

SEQ ID NO: 37744 - DNA, 21 bp, Artificial sequence
  SiRNA target sequence
agaccaattgaaaaagtagat

SEQ ID NO: 37745 - DNA, 21 bp, Artificial sequence
  SiRNA target sequence
gaccaattgaaaaagtagatc

SEQ ID NO: 37746 - DNA, 21 bp, Artificial sequence
  SiRNA target sequence
accaattgaaaaagtagatca

SEQ ID NO: 37747 - DNA, 21 bp, Artificial sequence
  SiRNA target sequence
ccaattgaaaaagtagatcaa

SEQ ID NO: 37748 - DNA, 21 bp, Artificial sequence
  SiRNA target sequence
caattgaaaaagtagatcaac

SEQ ID NO: 37749 - DNA, 21 bp, Artificial sequence
  SiRNA target sequence
aattgaaaaagtagatcaact

SEQ ID NO: 37750 - DNA, 21 bp, Artificial sequence
  SiRNA target sequence
attgaaaaagtagatcaactg

SEQ ID NO: 37751 - DNA, 21 bp, Artificial sequence
  SiRNA target sequence
ttgaaaaagtagatcaactga

SEQ ID NO: 37752 - DNA, 21 bp, Artificial sequence
  SiRNA target sequence
tgaaaaagtagatcaactgaa

SEQ ID NO: 37753 - DNA, 21 bp, Artificial sequence
  SiRNA target sequence
gaaaaagtagatcaactgaaa

SEQ ID NO: 37754 - DNA, 21 bp, Artificial sequence
  SiRNA target sequence
aaaaagtagatcaactgaaaa

SEQ ID NO: 37755 - DNA, 21 bp, Artificial sequence
  SiRNA target sequence
aaaagtagatcaactgaaaac

SEQ ID NO: 37756 - DNA, 21 bp, Artificial sequence
  SiRNA target sequence
aaagtagatcaactgaaaaca

SEQ ID NO: 37757 - DNA, 21 bp, Artificial sequence
  SiRNA target sequence
aagtagatcaactgaaaacac

SEQ ID NO: 37758 - DNA, 21 bp, Artificial sequence
  SiRNA target sequence
agtagatcaactgaaaacacg

SEQ ID NO: 37759 - DNA, 21 bp, Artificial sequence
  SiRNA target sequence
gtagatcaactgaaaacacgt

SEQ ID NO: 37760 - DNA, 21 bp, Artificial sequence
  SiRNA target sequence
tagatcaactgaaaacacgtg

SEQ ID NO: 37761 - DNA, 21 bp, Artificial sequence
  SiRNA target sequence
agatcaactgaaaacacgtgt

SEQ ID NO: 37762 - DNA, 21 bp, Artificial sequence
  SiRNA target sequence
gatcaactgaaaacacgtgtg

SEQ ID NO: 37763 - DNA, 21 bp, Artificial sequence
  SiRNA target sequence
atcaactgaaaacacgtgtgt

SEQ ID NO: 37764 - DNA, 21 bp, Artificial sequence
  SiRNA target sequence
tcaactgaaaacacgtgtgtt

SEQ ID NO: 37765 - DNA, 21 bp, Artificial sequence
  SiRNA target sequence
caactgaaaacacgtgtgttt

SEQ ID NO: 37766 - DNA, 21 bp, Artificial sequence
  SiRNA target sequence
aactgaaaacacgtgtgtttt

SEQ ID NO: 37767 - DNA, 21 bp, Artificial sequence
  SiRNA target sequence
actgaaaacacgtgtgttttc

SEQ ID NO: 37768 - DNA, 21 bp, Artificial sequence
  SiRNA target sequence
ctgaaaacacgtgtgttttct

SEQ ID NO: 37769 - DNA, 21 bp, Artificial sequence
  SiRNA target sequence
tgaaaacacgtgtgttttcta

SEQ ID NO: 37770 - DNA, 21 bp, Artificial sequence
  SiRNA target sequence
gaaaacacgtgtgttttctaa

SEQ ID NO: 37771 - DNA, 21 bp, Artificial sequence
  SiRNA target sequence
aaaacacgtgtgttttctaat

SEQ ID NO: 37772 - DNA, 21 bp, Artificial sequence
  SiRNA target sequence
aaacacgtgtgttttctaatg

SEQ ID NO: 37773 - DNA, 21 bp, Artificial sequence
  SiRNA target sequence
aacacgtgtgttttctaatgg

SEQ ID NO: 37774 - DNA, 21 bp, Artificial sequence
  SiRNA target sequence
acacgtgtgttttctaatggg

SEQ ID NO: 37775 - DNA, 21 bp, Artificial sequence
  SiRNA target sequence
cacgtgtgttttctaatgggc

SEQ ID NO: 37776 - DNA, 21 bp, Artificial sequence
  SiRNA target sequence
acgtgtgttttctaatgggcc

SEQ ID NO: 37777 - DNA, 21 bp, Artificial sequence
  SiRNA target sequence
cgtgtgttttctaatgggcct

SEQ ID NO: 37778 - DNA, 21 bp, Artificial sequence
  SiRNA target sequence
gtgtgttttctaatgggccta

SEQ ID NO: 37779 - DNA, 21 bp, Artificial sequence
  SiRNA target sequence
tgtgttttctaatgggcctat

SEQ ID NO: 37780 - DNA, 21 bp, Artificial sequence
  SiRNA target sequence
gtgttttctaatgggcctatg

SEQ ID NO: 37781 - DNA, 21 bp, Artificial sequence
  SiRNA target sequence
tgttttctaatgggcctatgg

SEQ ID NO: 37782 - DNA, 21 bp, Artificial sequence
  SiRNA target sequence
gttttctaatgggcctatgga

SEQ ID NO: 37783 - DNA, 21 bp, Artificial sequence
  SiRNA target sequence
ttttctaatgggcctatggac

SEQ ID NO: 37784 - DNA, 21 bp, Artificial sequence
  SiRNA target sequence
tttctaatgggcctatggact

SEQ ID NO: 37785 - DNA, 21 bp, Artificial sequence
  SiRNA target sequence
ttctaatgggcctatggactt

SEQ ID NO: 37786 - DNA, 21 bp, Artificial sequence
  SiRNA target sequence
tctaatgggcctatggacttt

SEQ ID NO: 37787 - DNA, 21 bp, Artificial sequence
  SiRNA target sequence
ctaatgggcctatggactttt

SEQ ID NO: 37788 - DNA, 21 bp, Artificial sequence
  SiRNA target sequence
taatgggcctatggacttttc

SEQ ID NO: 37789 - DNA, 21 bp, Artificial sequence
  SiRNA target sequence
aatgggcctatggacttttct

SEQ ID NO: 37790 - DNA, 21 bp, Artificial sequence
  SiRNA target sequence
atgggcctatggacttttcta

SEQ ID NO: 37791 - DNA, 21 bp, Artificial sequence
  SiRNA target sequence
tgggcctatggacttttctat

SEQ ID NO: 37792 - DNA, 21 bp, Artificial sequence
  SiRNA target sequence
gggcctatggacttttctatc

SEQ ID NO: 37793 - DNA, 21 bp, Artificial sequence
  SiRNA target sequence
ggcctatggacttttctatca

SEQ ID NO: 37794 - DNA, 21 bp, Artificial sequence
  SiRNA target sequence
gcctatggacttttctatcac

SEQ ID NO: 37795 - DNA, 21 bp, Artificial sequence
  SiRNA target sequence
cctatggacttttctatcact

SEQ ID NO: 37796 - DNA, 21 bp, Artificial sequence
  SiRNA target sequence
ctatggacttttctatcactt

SEQ ID NO: 37797 - DNA, 21 bp, Artificial sequence
  SiRNA target sequence
tatggacttttctatcacttt

SEQ ID NO: 37798 - DNA, 21 bp, Artificial sequence
  SiRNA target sequence
atggacttttctatcactttt

SEQ ID NO: 37799 - DNA, 21 bp, Artificial sequence
  SiRNA target sequence
tggacttttctatcactttta

SEQ ID NO: 37800 - DNA, 21 bp, Artificial sequence
  SiRNA target sequence
ggacttttctatcacttttag

SEQ ID NO: 37801 - DNA, 21 bp, Artificial sequence
  SiRNA target sequence
gacttttctatcacttttaga

SEQ ID NO: 37802 - DNA, 21 bp, Artificial sequence
  SiRNA target sequence
acttttctatcacttttagaa

SEQ ID NO: 37803 - DNA, 21 bp, Artificial sequence
  SiRNA target sequence
cttttctatcacttttagaat

SEQ ID NO: 37804 - DNA, 21 bp, Artificial sequence
  SiRNA target sequence
ttttctatcacttttagaatg

SEQ ID NO: 37805 - DNA, 21 bp, Artificial sequence
  SiRNA target sequence
tttctatcacttttagaatgt

SEQ ID NO: 37806 - DNA, 21 bp, Artificial sequence
  SiRNA target sequence
ttctatcacttttagaatgta

SEQ ID NO: 37807 - DNA, 21 bp, Artificial sequence
  SiRNA target sequence
tctatcacttttagaatgtac

SEQ ID NO: 37808 - DNA, 21 bp, Artificial sequence
  SiRNA target sequence
ctatcacttttagaatgtact

SEQ ID NO: 37809 - DNA, 21 bp, Artificial sequence
  SiRNA target sequence
tatcacttttagaatgtacta

SEQ ID NO: 37810 - DNA, 21 bp, Artificial sequence
  SiRNA target sequence
atcacttttagaatgtactat

SEQ ID NO: 37811 - DNA, 21 bp, Artificial sequence
  SiRNA target sequence
tcacttttagaatgtactatt

SEQ ID NO: 37812 - DNA, 21 bp, Artificial sequence
  SiRNA target sequence
cacttttagaatgtactattt

SEQ ID NO: 37813 - DNA, 21 bp, Artificial sequence
  SiRNA target sequence
acttttagaatgtactatttg

SEQ ID NO: 37814 - DNA, 21 bp, Artificial sequence
  SiRNA target sequence
cttttagaatgtactatttgg

SEQ ID NO: 37815 - DNA, 21 bp, Artificial sequence
  SiRNA target sequence
ttttagaatgtactatttggg

SEQ ID NO: 37816 - DNA, 21 bp, Artificial sequence
  SiRNA target sequence
tttagaatgtactatttgggc

SEQ ID NO: 37817 - DNA, 21 bp, Artificial sequence
  SiRNA target sequence
ttagaatgtactatttgggct

SEQ ID NO: 37818 - DNA, 21 bp, Artificial sequence
  SiRNA target sequence
tagaatgtactatttgggctt

SEQ ID NO: 37819 - DNA, 21 bp, Artificial sequence
  SiRNA target sequence
agaatgtactatttgggcttc

SEQ ID NO: 37820 - DNA, 21 bp, Artificial sequence
  SiRNA target sequence
gaatgtactatttgggcttca

SEQ ID NO: 37821 - DNA, 21 bp, Artificial sequence
  SiRNA target sequence
aatgtactatttgggcttcat

SEQ ID NO: 37822 - DNA, 21 bp, Artificial sequence
  SiRNA target sequence
atgtactatttgggcttcata

SEQ ID NO: 37823 - DNA, 21 bp, Artificial sequence
  SiRNA target sequence
tgtactatttgggcttcatag

SEQ ID NO: 37824 - DNA, 21 bp, Artificial sequence
  SiRNA target sequence
gtactatttgggcttcatagc

SEQ ID NO: 37825 - DNA, 21 bp, Artificial sequence
  SiRNA target sequence
tactatttgggcttcatagca

SEQ ID NO: 37826 - DNA, 21 bp, Artificial sequence
  SiRNA target sequence
actatttgggcttcatagcac

SEQ ID NO: 37827 - DNA, 21 bp, Artificial sequence
  SiRNA target sequence
ctatttgggcttcatagcaca

SEQ ID NO: 37828 - DNA, 21 bp, Artificial sequence
  SiRNA target sequence
tatttgggcttcatagcacac

SEQ ID NO: 37829 - DNA, 21 bp, Artificial sequence
  SiRNA target sequence
atttgggcttcatagcacacc

SEQ ID NO: 37830 - DNA, 21 bp, Artificial sequence
  SiRNA target sequence
tttgggcttcatagcacacct

SEQ ID NO: 37831 - DNA, 21 bp, Artificial sequence
  SiRNA target sequence
ttgggcttcatagcacacctt

SEQ ID NO: 37832 - DNA, 21 bp, Artificial sequence
  SiRNA target sequence
tgggcttcatagcacacctta

SEQ ID NO: 37833 - DNA, 21 bp, Artificial sequence
  SiRNA target sequence
gggcttcatagcacaccttat

SEQ ID NO: 37834 - DNA, 21 bp, Artificial sequence
  SiRNA target sequence
ggcttcatagcacaccttatg

SEQ ID NO: 37835 - DNA, 21 bp, Artificial sequence
  SiRNA target sequence
gcttcatagcacaccttatgg

SEQ ID NO: 37836 - DNA, 21 bp, Artificial sequence
  SiRNA target sequence
cttcatagcacaccttatgga

SEQ ID NO: 37837 - DNA, 21 bp, Artificial sequence
  SiRNA target sequence
ttcatagcacaccttatggaa

SEQ ID NO: 37838 - DNA, 21 bp, Artificial sequence
  SiRNA target sequence
tcatagcacaccttatggaaa

SEQ ID NO: 37839 - DNA, 21 bp, Artificial sequence
  SiRNA target sequence
catagcacaccttatggaaaa

SEQ ID NO: 37840 - DNA, 21 bp, Artificial sequence
  SiRNA target sequence
atagcacaccttatggaaaat

SEQ ID NO: 37841 - DNA, 21 bp, Artificial sequence
  SiRNA target sequence
tagcacaccttatggaaaatc

SEQ ID NO: 37842 - DNA, 21 bp, Artificial sequence
  SiRNA target sequence
agcacaccttatggaaaatcg

SEQ ID NO: 37843 - DNA, 21 bp, Artificial sequence
  SiRNA target sequence
gcacaccttatggaaaatcga

SEQ ID NO: 37844 - DNA, 21 bp, Artificial sequence
  SiRNA target sequence
cacaccttatggaaaatcgaa

SEQ ID NO: 37845 - DNA, 21 bp, Artificial sequence
  SiRNA target sequence
acaccttatggaaaatcgaat

SEQ ID NO: 37846 - DNA, 21 bp, Artificial sequence
  SiRNA target sequence
caccttatggaaaatcgaata

SEQ ID NO: 37847 - DNA, 21 bp, Artificial sequence
  SiRNA target sequence
accttatggaaaatcgaataa

SEQ ID NO: 37848 - DNA, 21 bp, Artificial sequence
  SiRNA target sequence
ccttatggaaaatcgaataac

SEQ ID NO: 37849 - DNA, 21 bp, Artificial sequence
  SiRNA target sequence
cttatggaaaatcgaataacc

SEQ ID NO: 37850 - DNA, 21 bp, Artificial sequence
  SiRNA target sequence
ttatggaaaatcgaataacca

SEQ ID NO: 37851 - DNA, 21 bp, Artificial sequence
  SiRNA target sequence
tatggaaaatcgaataaccaa

SEQ ID NO: 37852 - DNA, 21 bp, Artificial sequence
  SiRNA target sequence
atggaaaatcgaataaccaat

SEQ ID NO: 37853 - DNA, 21 bp, Artificial sequence
  SiRNA target sequence
tggaaaatcgaataaccaatg

SEQ ID NO: 37854 - DNA, 21 bp, Artificial sequence
  SiRNA target sequence
ggaaaatcgaataaccaatga

SEQ ID NO: 37855 - DNA, 21 bp, Artificial sequence
  SiRNA target sequence
gaaaatcgaataaccaatgaa

SEQ ID NO: 37856 - DNA, 21 bp, Artificial sequence
  SiRNA target sequence
aaaatcgaataaccaatgaag

SEQ ID NO: 37857 - DNA, 21 bp, Artificial sequence
  SiRNA target sequence
aaatcgaataaccaatgaagt

SEQ ID NO: 37858 - DNA, 21 bp, Artificial sequence
  SiRNA target sequence
aatcgaataaccaatgaagta

SEQ ID NO: 37859 - DNA, 21 bp, Artificial sequence
  SiRNA target sequence
atcgaataaccaatgaagtat

SEQ ID NO: 37860 - DNA, 21 bp, Artificial sequence
  SiRNA target sequence
tcgaataaccaatgaagtatc

SEQ ID NO: 37861 - DNA, 21 bp, Artificial sequence
  SiRNA target sequence
cgaataaccaatgaagtatcc

SEQ ID NO: 37862 - DNA, 21 bp, Artificial sequence
  SiRNA target sequence
gaataaccaatgaagtatcca

SEQ ID NO: 37863 - DNA, 21 bp, Artificial sequence
  SiRNA target sequence
aataaccaatgaagtatccat

SEQ ID NO: 37864 - DNA, 21 bp, Artificial sequence
  SiRNA target sequence
ataaccaatgaagtatccata

SEQ ID NO: 37865 - DNA, 21 bp, Artificial sequence
  SiRNA target sequence
taaccaatgaagtatccatag

SEQ ID NO: 37866 - DNA, 21 bp, Artificial sequence
  SiRNA target sequence
aaccaatgaagtatccatagg

SEQ ID NO: 37867 - DNA, 21 bp, Artificial sequence
  SiRNA target sequence
accaatgaagtatccatagga

SEQ ID NO: 37868 - DNA, 21 bp, Artificial sequence
  SiRNA target sequence
ccaatgaagtatccataggaa

SEQ ID NO: 37869 - DNA, 21 bp, Artificial sequence
  SiRNA target sequence
caatgaagtatccataggaac

SEQ ID NO: 37870 - DNA, 21 bp, Artificial sequence
  SiRNA target sequence
aatgaagtatccataggaact

SEQ ID NO: 37871 - DNA, 21 bp, Artificial sequence
  SiRNA target sequence
atgaagtatccataggaacta

SEQ ID NO: 37872 - DNA, 21 bp, Artificial sequence
  SiRNA target sequence
tgaagtatccataggaactaa

SEQ ID NO: 37873 - DNA, 21 bp, Artificial sequence
  SiRNA target sequence
gaagtatccataggaactaat

SEQ ID NO: 37874 - DNA, 21 bp, Artificial sequence
  SiRNA target sequence
aagtatccataggaactaatg

SEQ ID NO: 37875 - DNA, 21 bp, Artificial sequence
  SiRNA target sequence
agtatccataggaactaatgt

SEQ ID NO: 37876 - DNA, 21 bp, Artificial sequence
  SiRNA target sequence
gtatccataggaactaatgtt

SEQ ID NO: 37877 - DNA, 21 bp, Artificial sequence
  SiRNA target sequence
tatccataggaactaatgttt

SEQ ID NO: 37878 - DNA, 21 bp, Artificial sequence
  SiRNA target sequence
atccataggaactaatgttta

SEQ ID NO: 37879 - DNA, 21 bp, Artificial sequence
  SiRNA target sequence
tccataggaactaatgtttat

SEQ ID NO: 37880 - DNA, 21 bp, Artificial sequence
  SiRNA target sequence
ccataggaactaatgtttatt

SEQ ID NO: 37881 - DNA, 21 bp, Artificial sequence
  SiRNA target sequence
cataggaactaatgtttattc

SEQ ID NO: 37882 - DNA, 21 bp, Artificial sequence
  SiRNA target sequence
ataggaactaatgtttattcc

SEQ ID NO: 37883 - DNA, 21 bp, Artificial sequence
  SiRNA target sequence
taggaactaatgtttattccc

SEQ ID NO: 37884 - DNA, 21 bp, Artificial sequence
  SiRNA target sequence
aggaactaatgtttattccca

SEQ ID NO: 37885 - DNA, 21 bp, Artificial sequence
  SiRNA target sequence
ggaactaatgtttattcccaa

SEQ ID NO: 37886 - DNA, 21 bp, Artificial sequence
  SiRNA target sequence
gaactaatgtttattcccaag

SEQ ID NO: 37887 - DNA, 21 bp, Artificial sequence
  SiRNA target sequence
aactaatgtttattcccaaga

SEQ ID NO: 37888 - DNA, 21 bp, Artificial sequence
  SiRNA target sequence
actaatgtttattcccaagat

SEQ ID NO: 37889 - DNA, 21 bp, Artificial sequence
  SiRNA target sequence
ctaatgtttattcccaagatt

SEQ ID NO: 37890 - DNA, 21 bp, Artificial sequence
  SiRNA target sequence
taatgtttattcccaagattg

SEQ ID NO: 37891 - DNA, 21 bp, Artificial sequence
  SiRNA target sequence
aatgtttattcccaagattgg

SEQ ID NO: 37892 - DNA, 21 bp, Artificial sequence
  SiRNA target sequence
atgtttattcccaagattgga

SEQ ID NO: 37893 - DNA, 21 bp, Artificial sequence
  SiRNA target sequence
tgtttattcccaagattggaa

SEQ ID NO: 37894 - DNA, 21 bp, Artificial sequence
  SiRNA target sequence
gtttattcccaagattggaat

SEQ ID NO: 37895 - DNA, 21 bp, Artificial sequence
  SiRNA target sequence
tttattcccaagattggaata

SEQ ID NO: 37896 - DNA, 21 bp, Artificial sequence
  SiRNA target sequence
ttattcccaagattggaataa

SEQ ID NO: 37897 - DNA, 21 bp, Artificial sequence
  SiRNA target sequence
tattcccaagattggaataag

SEQ ID NO: 37898 - DNA, 21 bp, Artificial sequence
  SiRNA target sequence
attcccaagattggaataaga

SEQ ID NO: 37899 - DNA, 21 bp, Artificial sequence
  SiRNA target sequence
ttcccaagattggaataagac

SEQ ID NO: 37900 - DNA, 21 bp, Artificial sequence
  SiRNA target sequence
tcccaagattggaataagaca

SEQ ID NO: 37901 - DNA, 21 bp, Artificial sequence
  SiRNA target sequence
cccaagattggaataagacag

SEQ ID NO: 37902 - DNA, 21 bp, Artificial sequence
  SiRNA target sequence
ccaagattggaataagacagt

SEQ ID NO: 37903 - DNA, 21 bp, Artificial sequence
  SiRNA target sequence
caagattggaataagacagtt

SEQ ID NO: 37904 - DNA, 21 bp, Artificial sequence
  SiRNA target sequence
aagattggaataagacagtta

SEQ ID NO: 37905 - DNA, 21 bp, Artificial sequence
  SiRNA target sequence
agattggaataagacagttag

SEQ ID NO: 37906 - DNA, 21 bp, Artificial sequence
  SiRNA target sequence
gattggaataagacagttaga

SEQ ID NO: 37907 - DNA, 21 bp, Artificial sequence
  SiRNA target sequence
attggaataagacagttagaa

SEQ ID NO: 37908 - DNA, 21 bp, Artificial sequence
  SiRNA target sequence
ttggaataagacagttagaaa

SEQ ID NO: 37909 - DNA, 21 bp, Artificial sequence
  SiRNA target sequence
tggaataagacagttagaaaa

SEQ ID NO: 37910 - DNA, 21 bp, Artificial sequence
  SiRNA target sequence
ggaataagacagttagaaaac

SEQ ID NO: 37911 - DNA, 21 bp, Artificial sequence
  SiRNA target sequence
gaataagacagttagaaaact

SEQ ID NO: 37912 - DNA, 21 bp, Artificial sequence
  SiRNA target sequence
aataagacagttagaaaactt

SEQ ID NO: 37913 - DNA, 21 bp, Artificial sequence
  SiRNA target sequence
ataagacagttagaaaactta

SEQ ID NO: 37914 - DNA, 21 bp, Artificial sequence
  SiRNA target sequence
taagacagttagaaaacttaa

SEQ ID NO: 37915 - DNA, 21 bp, Artificial sequence
  SiRNA target sequence
aagacagttagaaaacttaaa

SEQ ID NO: 37916 - DNA, 21 bp, Artificial sequence
  SiRNA target sequence
agacagttagaaaacttaaaa

SEQ ID NO: 37917 - DNA, 21 bp, Artificial sequence
  SiRNA target sequence
gacagttagaaaacttaaaac

SEQ ID NO: 37918 - DNA, 21 bp, Artificial sequence
  SiRNA target sequence
acagttagaaaacttaaaact

SEQ ID NO: 37919 - DNA, 21 bp, Artificial sequence
  SiRNA target sequence
cagttagaaaacttaaaacta

SEQ ID NO: 37920 - DNA, 21 bp, Artificial sequence
  SiRNA target sequence
agttagaaaacttaaaactat

SEQ ID NO: 37921 - DNA, 21 bp, Artificial sequence
  SiRNA target sequence
gttagaaaacttaaaactatg

SEQ ID NO: 37922 - DNA, 21 bp, Artificial sequence
  SiRNA target sequence
ttagaaaacttaaaactatgg

SEQ ID NO: 37923 - DNA, 21 bp, Artificial sequence
  SiRNA target sequence
tagaaaacttaaaactatggg

SEQ ID NO: 37924 - DNA, 21 bp, Artificial sequence
  SiRNA target sequence
agaaaacttaaaactatggga

SEQ ID NO: 37925 - DNA, 21 bp, Artificial sequence
  SiRNA target sequence
gaaaacttaaaactatgggac

SEQ ID NO: 37926 - DNA, 21 bp, Artificial sequence
  SiRNA target sequence
aaaacttaaaactatgggacc

SEQ ID NO: 37927 - DNA, 21 bp, Artificial sequence
  SiRNA target sequence
aaacttaaaactatgggaccc

SEQ ID NO: 37928 - DNA, 21 bp, Artificial sequence
  SiRNA target sequence
aacttaaaactatgggaccca

SEQ ID NO: 37929 - DNA, 21 bp, Artificial sequence
  SiRNA target sequence
acttaaaactatgggacccaa

SEQ ID NO: 37930 - DNA, 21 bp, Artificial sequence
  SiRNA target sequence
cttaaaactatgggacccaag

SEQ ID NO: 37931 - DNA, 21 bp, Artificial sequence
  SiRNA target sequence
ttaaaactatgggacccaagg

SEQ ID NO: 37932 - DNA, 21 bp, Artificial sequence
  SiRNA target sequence
taaaactatgggacccaaggt

SEQ ID NO: 37933 - DNA, 21 bp, Artificial sequence
  SiRNA target sequence
aaaactatgggacccaaggtt

SEQ ID NO: 37934 - DNA, 21 bp, Artificial sequence
  SiRNA target sequence
aaactatgggacccaaggtta

SEQ ID NO: 37935 - DNA, 21 bp, Artificial sequence
  SiRNA target sequence
aactatgggacccaaggttat

SEQ ID NO: 37936 - DNA, 21 bp, Artificial sequence
  SiRNA target sequence
actatgggacccaaggttatt

SEQ ID NO: 37937 - DNA, 21 bp, Artificial sequence
  SiRNA target sequence
ctatgggacccaaggttattg

SEQ ID NO: 37938 - DNA, 21 bp, Artificial sequence
  SiRNA target sequence
tatgggacccaaggttattgc

SEQ ID NO: 37939 - DNA, 21 bp, Artificial sequence
  SiRNA target sequence
atgggacccaaggttattgca

SEQ ID NO: 37940 - DNA, 21 bp, Artificial sequence
  SiRNA target sequence
tgggacccaaggttattgcag

SEQ ID NO: 37941 - DNA, 21 bp, Artificial sequence
  SiRNA target sequence
gggacccaaggttattgcagg

SEQ ID NO: 37942 - DNA, 21 bp, Artificial sequence
  SiRNA target sequence
ggacccaaggttattgcagga

SEQ ID NO: 37943 - DNA, 21 bp, Artificial sequence
  SiRNA target sequence
gacccaaggttattgcaggag

SEQ ID NO: 37944 - DNA, 21 bp, Artificial sequence
  SiRNA target sequence
acccaaggttattgcaggaga

SEQ ID NO: 37945 - DNA, 21 bp, Artificial sequence
  SiRNA target sequence
cccaaggttattgcaggagat

SEQ ID NO: 37946 - DNA, 21 bp, Artificial sequence
  SiRNA target sequence
ccaaggttattgcaggagatt

SEQ ID NO: 37947 - DNA, 21 bp, Artificial sequence
  SiRNA target sequence
caaggttattgcaggagattt

SEQ ID NO: 37948 - DNA, 21 bp, Artificial sequence
  SiRNA target sequence
aaggttattgcaggagatttc

SEQ ID NO: 37949 - DNA, 21 bp, Artificial sequence
  SiRNA target sequence
aggttattgcaggagatttct

SEQ ID NO: 37950 - DNA, 21 bp, Artificial sequence
  SiRNA target sequence
ggttattgcaggagatttctc

SEQ ID NO: 37951 - DNA, 21 bp, Artificial sequence
  SiRNA target sequence
gttattgcaggagatttctca

SEQ ID NO: 37952 - DNA, 21 bp, Artificial sequence
  SiRNA target sequence
ttattgcaggagatttctcaa

SEQ ID NO: 37953 - DNA, 21 bp, Artificial sequence
  SiRNA target sequence
tattgcaggagatttctcaac

SEQ ID NO: 37954 - DNA, 21 bp, Artificial sequence
  SiRNA target sequence
attgcaggagatttctcaacc

SEQ ID NO: 37955 - DNA, 21 bp, Artificial sequence
  SiRNA target sequence
ttgcaggagatttctcaacct

SEQ ID NO: 37956 - DNA, 21 bp, Artificial sequence
  SiRNA target sequence
tgcaggagatttctcaacctt

SEQ ID NO: 37957 - DNA, 21 bp, Artificial sequence
  SiRNA target sequence
gcaggagatttctcaaccttt

SEQ ID NO: 37958 - DNA, 21 bp, Artificial sequence
  SiRNA target sequence
caggagatttctcaacctttg

SEQ ID NO: 37959 - DNA, 21 bp, Artificial sequence
  SiRNA target sequence
aggagatttctcaacctttga

SEQ ID NO: 37960 - DNA, 21 bp, Artificial sequence
  SiRNA target sequence
ggagatttctcaacctttgat

SEQ ID NO: 37961 - DNA, 21 bp, Artificial sequence
  SiRNA target sequence
gagatttctcaacctttgatg

SEQ ID NO: 37962 - DNA, 21 bp, Artificial sequence
  SiRNA target sequence
agatttctcaacctttgatgg

SEQ ID NO: 37963 - DNA, 21 bp, Artificial sequence
  SiRNA target sequence
gatttctcaacctttgatgga

SEQ ID NO: 37964 - DNA, 21 bp, Artificial sequence
  SiRNA target sequence
atttctcaacctttgatggat

SEQ ID NO: 37965 - DNA, 21 bp, Artificial sequence
  SiRNA target sequence
tttctcaacctttgatggatc

SEQ ID NO: 37966 - DNA, 21 bp, Artificial sequence
  SiRNA target sequence
ttctcaacctttgatggatct

SEQ ID NO: 37967 - DNA, 21 bp, Artificial sequence
  SiRNA target sequence
tctcaacctttgatggatctt

SEQ ID NO: 37968 - DNA, 21 bp, Artificial sequence
  SiRNA target sequence
ctcaacctttgatggatcttt

SEQ ID NO: 37969 - DNA, 21 bp, Artificial sequence
  SiRNA target sequence
tcaacctttgatggatctttg

SEQ ID NO: 37970 - DNA, 21 bp, Artificial sequence
  SiRNA target sequence
caacctttgatggatctttga

SEQ ID NO: 37971 - DNA, 21 bp, Artificial sequence
  SiRNA target sequence
aacctttgatggatctttgaa

SEQ ID NO: 37972 - DNA, 21 bp, Artificial sequence
  SiRNA target sequence
acctttgatggatctttgaat

SEQ ID NO: 37973 - DNA, 21 bp, Artificial sequence
  SiRNA target sequence
cctttgatggatctttgaatg

SEQ ID NO: 37974 - DNA, 21 bp, Artificial sequence
  SiRNA target sequence
ctttgatggatctttgaatgt

SEQ ID NO: 37975 - DNA, 21 bp, Artificial sequence
  SiRNA target sequence
tttgatggatctttgaatgtt

SEQ ID NO: 37976 - DNA, 21 bp, Artificial sequence
  SiRNA target sequence
ttgatggatctttgaatgttt

SEQ ID NO: 37977 - DNA, 21 bp, Artificial sequence
  SiRNA target sequence
tgatggatctttgaatgtttg

SEQ ID NO: 37978 - DNA, 21 bp, Artificial sequence
  SiRNA target sequence
gatggatctttgaatgtttgc

SEQ ID NO: 37979 - DNA, 21 bp, Artificial sequence
  SiRNA target sequence
atggatctttgaatgtttgca

SEQ ID NO: 37980 - DNA, 21 bp, Artificial sequence
  SiRNA target sequence
tggatctttgaatgtttgcat

SEQ ID NO: 37981 - DNA, 21 bp, Artificial sequence
  SiRNA target sequence
ggatctttgaatgtttgcatt

SEQ ID NO: 37982 - DNA, 21 bp, Artificial sequence
  SiRNA target sequence
gatctttgaatgtttgcatta

SEQ ID NO: 37983 - DNA, 21 bp, Artificial sequence
  SiRNA target sequence
atctttgaatgtttgcattat

SEQ ID NO: 37984 - DNA, 21 bp, Artificial sequence
  SiRNA target sequence
tctttgaatgtttgcattatg

SEQ ID NO: 37985 - DNA, 21 bp, Artificial sequence
  SiRNA target sequence
ctttgaatgtttgcattatgg

SEQ ID NO: 37986 - DNA, 21 bp, Artificial sequence
  SiRNA target sequence
tttgaatgtttgcattatgga

SEQ ID NO: 37987 - DNA, 21 bp, Artificial sequence
  SiRNA target sequence
ttgaatgtttgcattatggaa

SEQ ID NO: 37988 - DNA, 21 bp, Artificial sequence
  SiRNA target sequence
tgaatgtttgcattatggaaa

SEQ ID NO: 37989 - DNA, 21 bp, Artificial sequence
  SiRNA target sequence
gaatgtttgcattatggaaaa

SEQ ID NO: 37990 - DNA, 21 bp, Artificial sequence
  SiRNA target sequence
aatgtttgcattatggaaaaa

SEQ ID NO: 37991 - DNA, 21 bp, Artificial sequence
  SiRNA target sequence
atgtttgcattatggaaaaat

SEQ ID NO: 37992 - DNA, 21 bp, Artificial sequence
  SiRNA target sequence
tgtttgcattatggaaaaatt

SEQ ID NO: 37993 - DNA, 21 bp, Artificial sequence
  SiRNA target sequence
gtttgcattatggaaaaattt

SEQ ID NO: 37994 - DNA, 21 bp, Artificial sequence
  SiRNA target sequence
tttgcattatggaaaaatttg

SEQ ID NO: 37995 - DNA, 21 bp, Artificial sequence
  SiRNA target sequence
ttgcattatggaaaaatttgc

SEQ ID NO: 37996 - DNA, 21 bp, Artificial sequence
  SiRNA target sequence
tgcattatggaaaaatttgct

SEQ ID NO: 37997 - DNA, 21 bp, Artificial sequence
  SiRNA target sequence
gcattatggaaaaatttgctg

SEQ ID NO: 37998 - DNA, 21 bp, Artificial sequence
  SiRNA target sequence
cattatggaaaaatttgctga

SEQ ID NO: 37999 - DNA, 21 bp, Artificial sequence
  SiRNA target sequence
attatggaaaaatttgctgac

SEQ ID NO: 38000 - DNA, 21 bp, Artificial sequence
  SiRNA target sequence
ttatggaaaaatttgctgacc

SEQ ID NO: 38001 - DNA, 21 bp, Artificial sequence
  SiRNA target sequence
tatggaaaaatttgctgacct

SEQ ID NO: 38002 - DNA, 21 bp, Artificial sequence
  SiRNA target sequence
atggaaaaatttgctgaccta

SEQ ID NO: 38003 - DNA, 21 bp, Artificial sequence
  SiRNA target sequence
tggaaaaatttgctgacctag

SEQ ID NO: 38004 - DNA, 21 bp, Artificial sequence
  SiRNA target sequence
ggaaaaatttgctgacctagc

SEQ ID NO: 38005 - DNA, 21 bp, Artificial sequence
  SiRNA target sequence
gaaaaatttgctgacctagcg

SEQ ID NO: 38006 - DNA, 21 bp, Artificial sequence
  SiRNA target sequence
aaaaatttgctgacctagcga

SEQ ID NO: 38007 - DNA, 21 bp, Artificial sequence
  SiRNA target sequence
aaaatttgctgacctagcgaa

SEQ ID NO: 38008 - DNA, 21 bp, Artificial sequence
  SiRNA target sequence
aaatttgctgacctagcgaat

SEQ ID NO: 38009 - DNA, 21 bp, Artificial sequence
  SiRNA target sequence
aatttgctgacctagcgaatg

SEQ ID NO: 38010 - DNA, 21 bp, Artificial sequence
  SiRNA target sequence
atttgctgacctagcgaatga

SEQ ID NO: 38011 - DNA, 21 bp, Artificial sequence
  SiRNA target sequence
tttgctgacctagcgaatgaa

SEQ ID NO: 38012 - DNA, 21 bp, Artificial sequence
  SiRNA target sequence
ttgctgacctagcgaatgaat

SEQ ID NO: 38013 - DNA, 21 bp, Artificial sequence
  SiRNA target sequence
tgctgacctagcgaatgaatt

SEQ ID NO: 38014 - DNA, 21 bp, Artificial sequence
  SiRNA target sequence
gctgacctagcgaatgaattt

SEQ ID NO: 38015 - DNA, 21 bp, Artificial sequence
  SiRNA target sequence
ctgacctagcgaatgaatttt

SEQ ID NO: 38016 - DNA, 21 bp, Artificial sequence
  SiRNA target sequence
tgacctagcgaatgaatttta

SEQ ID NO: 38017 - DNA, 21 bp, Artificial sequence
  SiRNA target sequence
gacctagcgaatgaattttat

SEQ ID NO: 38018 - DNA, 21 bp, Artificial sequence
  SiRNA target sequence
acctagcgaatgaattttatg

SEQ ID NO: 38019 - DNA, 21 bp, Artificial sequence
  SiRNA target sequence
cctagcgaatgaattttatga

SEQ ID NO: 38020 - DNA, 21 bp, Artificial sequence
  SiRNA target sequence
ctagcgaatgaattttatgat

SEQ ID NO: 38021 - DNA, 21 bp, Artificial sequence
  SiRNA target sequence
tagcgaatgaattttatgatg

SEQ ID NO: 38022 - DNA, 21 bp, Artificial sequence
  SiRNA target sequence
agcgaatgaattttatgatga

SEQ ID NO: 38023 - DNA, 21 bp, Artificial sequence
  SiRNA target sequence
gcgaatgaattttatgatgac

SEQ ID NO: 38024 - DNA, 21 bp, Artificial sequence
  SiRNA target sequence
cgaatgaattttatgatgacg

SEQ ID NO: 38025 - DNA, 21 bp, Artificial sequence
  SiRNA target sequence
gaatgaattttatgatgacgg

SEQ ID NO: 38026 - DNA, 21 bp, Artificial sequence
  SiRNA target sequence
aatgaattttatgatgacgga

SEQ ID NO: 38027 - DNA, 21 bp, Artificial sequence
  SiRNA target sequence
atgaattttatgatgacggat

SEQ ID NO: 38028 - DNA, 21 bp, Artificial sequence
  SiRNA target sequence
tgaattttatgatgacggatc

SEQ ID NO: 38029 - DNA, 21 bp, Artificial sequence
  SiRNA target sequence
gaattttatgatgacggatca

SEQ ID NO: 38030 - DNA, 21 bp, Artificial sequence
  SiRNA target sequence
aattttatgatgacggatcag

SEQ ID NO: 38031 - DNA, 21 bp, Artificial sequence
  SiRNA target sequence
attttatgatgacggatcaga

SEQ ID NO: 38032 - DNA, 21 bp, Artificial sequence
  SiRNA target sequence
ttttatgatgacggatcagag

SEQ ID NO: 38033 - DNA, 21 bp, Artificial sequence
  SiRNA target sequence
tttatgatgacggatcagaga

SEQ ID NO: 38034 - DNA, 21 bp, Artificial sequence
  SiRNA target sequence
ttatgatgacggatcagagaa

SEQ ID NO: 38035 - DNA, 21 bp, Artificial sequence
  SiRNA target sequence
tatgatgacggatcagagaat

SEQ ID NO: 38036 - DNA, 21 bp, Artificial sequence
  SiRNA target sequence
atgatgacggatcagagaatg

SEQ ID NO: 38037 - DNA, 21 bp, Artificial sequence
  SiRNA target sequence
tgatgacggatcagagaatgc

SEQ ID NO: 38038 - DNA, 21 bp, Artificial sequence
  SiRNA target sequence
gatgacggatcagagaatgca

SEQ ID NO: 38039 - DNA, 21 bp, Artificial sequence
  SiRNA target sequence
atgacggatcagagaatgcat

SEQ ID NO: 38040 - DNA, 21 bp, Artificial sequence
  SiRNA target sequence
tgacggatcagagaatgcatt

SEQ ID NO: 38041 - DNA, 21 bp, Artificial sequence
  SiRNA target sequence
gacggatcagagaatgcatta

SEQ ID NO: 38042 - DNA, 21 bp, Artificial sequence
  SiRNA target sequence
acggatcagagaatgcattaa

SEQ ID NO: 38043 - DNA, 21 bp, Artificial sequence
  SiRNA target sequence
cggatcagagaatgcattaat

SEQ ID NO: 38044 - DNA, 21 bp, Artificial sequence
  SiRNA target sequence
ggatcagagaatgcattaatt

SEQ ID NO: 38045 - DNA, 21 bp, Artificial sequence
  SiRNA target sequence
gatcagagaatgcattaattc

SEQ ID NO: 38046 - DNA, 21 bp, Artificial sequence
  SiRNA target sequence
atcagagaatgcattaattcg

SEQ ID NO: 38047 - DNA, 21 bp, Artificial sequence
  SiRNA target sequence
tcagagaatgcattaattcga

SEQ ID NO: 38048 - DNA, 21 bp, Artificial sequence
  SiRNA target sequence
cagagaatgcattaattcgac

SEQ ID NO: 38049 - DNA, 21 bp, Artificial sequence
  SiRNA target sequence
agagaatgcattaattcgaca

SEQ ID NO: 38050 - DNA, 21 bp, Artificial sequence
  SiRNA target sequence
gagaatgcattaattcgacat

SEQ ID NO: 38051 - DNA, 21 bp, Artificial sequence
  SiRNA target sequence
agaatgcattaattcgacatg

SEQ ID NO: 38052 - DNA, 21 bp, Artificial sequence
  SiRNA target sequence
gaatgcattaattcgacatgt

SEQ ID NO: 38053 - DNA, 21 bp, Artificial sequence
  SiRNA target sequence
aatgcattaattcgacatgtt

SEQ ID NO: 38054 - DNA, 21 bp, Artificial sequence
  SiRNA target sequence
atgcattaattcgacatgttt

SEQ ID NO: 38055 - DNA, 21 bp, Artificial sequence
  SiRNA target sequence
tgcattaattcgacatgtttt

SEQ ID NO: 38056 - DNA, 21 bp, Artificial sequence
  SiRNA target sequence
gcattaattcgacatgttttg

SEQ ID NO: 38057 - DNA, 21 bp, Artificial sequence
  SiRNA target sequence
cattaattcgacatgttttgc

SEQ ID NO: 38058 - DNA, 21 bp, Artificial sequence
  SiRNA target sequence
attaattcgacatgttttgct

SEQ ID NO: 38059 - DNA, 21 bp, Artificial sequence
  SiRNA target sequence
ttaattcgacatgttttgctt

SEQ ID NO: 38060 - DNA, 21 bp, Artificial sequence
  SiRNA target sequence
taattcgacatgttttgctta

SEQ ID NO: 38061 - DNA, 21 bp, Artificial sequence
  SiRNA target sequence
aattcgacatgttttgcttat

SEQ ID NO: 38062 - DNA, 21 bp, Artificial sequence
  SiRNA target sequence
attcgacatgttttgcttatg

SEQ ID NO: 38063 - DNA, 21 bp, Artificial sequence
  SiRNA target sequence
ttcgacatgttttgcttatgg

SEQ ID NO: 38064 - DNA, 21 bp, Artificial sequence
  SiRNA target sequence
tcgacatgttttgcttatgga

SEQ ID NO: 38065 - DNA, 21 bp, Artificial sequence
  SiRNA target sequence
cgacatgttttgcttatggat

SEQ ID NO: 38066 - DNA, 21 bp, Artificial sequence
  SiRNA target sequence
gacatgttttgcttatggatg

SEQ ID NO: 38067 - DNA, 21 bp, Artificial sequence
  SiRNA target sequence
acatgttttgcttatggatgt

SEQ ID NO: 38068 - DNA, 21 bp, Artificial sequence
  SiRNA target sequence
catgttttgcttatggatgta

SEQ ID NO: 38069 - DNA, 21 bp, Artificial sequence
  SiRNA target sequence
atgttttgcttatggatgtat

SEQ ID NO: 38070 - DNA, 21 bp, Artificial sequence
  SiRNA target sequence
tgttttgcttatggatgtata

SEQ ID NO: 38071 - DNA, 21 bp, Artificial sequence
  SiRNA target sequence
gttttgcttatggatgtatat

SEQ ID NO: 38072 - DNA, 21 bp, Artificial sequence
  SiRNA target sequence
ttttgcttatggatgtatata

SEQ ID NO: 38073 - DNA, 21 bp, Artificial sequence
  SiRNA target sequence
tttgcttatggatgtatataa

SEQ ID NO: 38074 - DNA, 21 bp, Artificial sequence
  SiRNA target sequence
ttgcttatggatgtatataac

SEQ ID NO: 38075 - DNA, 21 bp, Artificial sequence
  SiRNA target sequence
tgcttatggatgtatataact

SEQ ID NO: 38076 - DNA, 21 bp, Artificial sequence
  SiRNA target sequence
gcttatggatgtatataactc

SEQ ID NO: 38077 - DNA, 21 bp, Artificial sequence
  SiRNA target sequence
cttatggatgtatataactca

SEQ ID NO: 38078 - DNA, 21 bp, Artificial sequence
  SiRNA target sequence
ttatggatgtatataactcaa

SEQ ID NO: 38079 - DNA, 21 bp, Artificial sequence
  SiRNA target sequence
tatggatgtatataactcaac

SEQ ID NO: 38080 - DNA, 21 bp, Artificial sequence
  SiRNA target sequence
atggatgtatataactcaaca

SEQ ID NO: 38081 - DNA, 21 bp, Artificial sequence
  SiRNA target sequence
tggatgtatataactcaacac

SEQ ID NO: 38082 - DNA, 21 bp, Artificial sequence
  SiRNA target sequence
ggatgtatataactcaacaca

SEQ ID NO: 38083 - DNA, 21 bp, Artificial sequence
  SiRNA target sequence
gatgtatataactcaacacac

SEQ ID NO: 38084 - DNA, 21 bp, Artificial sequence
  SiRNA target sequence
atgtatataactcaacacaca

SEQ ID NO: 38085 - DNA, 21 bp, Artificial sequence
  SiRNA target sequence
tgtatataactcaacacacat

SEQ ID NO: 38086 - DNA, 21 bp, Artificial sequence
  SiRNA target sequence
gtatataactcaacacacatt

SEQ ID NO: 38087 - DNA, 21 bp, Artificial sequence
  SiRNA target sequence
tatataactcaacacacattt

SEQ ID NO: 38088 - DNA, 21 bp, Artificial sequence
  SiRNA target sequence
atataactcaacacacatttg

SEQ ID NO: 38089 - DNA, 21 bp, Artificial sequence
  SiRNA target sequence
tataactcaacacacatttgt

SEQ ID NO: 38090 - DNA, 21 bp, Artificial sequence
  SiRNA target sequence
ataactcaacacacatttgtg

SEQ ID NO: 38091 - DNA, 21 bp, Artificial sequence
  SiRNA target sequence
taactcaacacacatttgtgg

SEQ ID NO: 38092 - DNA, 21 bp, Artificial sequence
  SiRNA target sequence
aactcaacacacatttgtggt

SEQ ID NO: 38093 - DNA, 21 bp, Artificial sequence
  SiRNA target sequence
actcaacacacatttgtggtg

SEQ ID NO: 38094 - DNA, 21 bp, Artificial sequence
  SiRNA target sequence
ctcaacacacatttgtggtga

SEQ ID NO: 38095 - DNA, 21 bp, Artificial sequence
  SiRNA target sequence
tcaacacacatttgtggtgat

SEQ ID NO: 38096 - DNA, 21 bp, Artificial sequence
  SiRNA target sequence
caacacacatttgtggtgatt

SEQ ID NO: 38097 - DNA, 21 bp, Artificial sequence
  SiRNA target sequence
aacacacatttgtggtgattc

SEQ ID NO: 38098 - DNA, 21 bp, Artificial sequence
  SiRNA target sequence
acacacatttgtggtgattcc

SEQ ID NO: 38099 - DNA, 21 bp, Artificial sequence
  SiRNA target sequence
cacacatttgtggtgattccg

SEQ ID NO: 38100 - DNA, 21 bp, Artificial sequence
  SiRNA target sequence
acacatttgtggtgattccgt

SEQ ID NO: 38101 - DNA, 21 bp, Artificial sequence
  SiRNA target sequence
cacatttgtggtgattccgta

SEQ ID NO: 38102 - DNA, 21 bp, Artificial sequence
  SiRNA target sequence
acatttgtggtgattccgtat

SEQ ID NO: 38103 - DNA, 21 bp, Artificial sequence
  SiRNA target sequence
catttgtggtgattccgtata

SEQ ID NO: 38104 - DNA, 21 bp, Artificial sequence
  SiRNA target sequence
atttgtggtgattccgtatat

SEQ ID NO: 38105 - DNA, 21 bp, Artificial sequence
  SiRNA target sequence
tttgtggtgattccgtatata

SEQ ID NO: 38106 - DNA, 21 bp, Artificial sequence
  SiRNA target sequence
ttgtggtgattccgtatatat

SEQ ID NO: 38107 - DNA, 21 bp, Artificial sequence
  SiRNA target sequence
tgtggtgattccgtatatatg

SEQ ID NO: 38108 - DNA, 21 bp, Artificial sequence
  SiRNA target sequence
gtggtgattccgtatatatga

SEQ ID NO: 38109 - DNA, 21 bp, Artificial sequence
  SiRNA target sequence
tggtgattccgtatatatgat

SEQ ID NO: 38110 - DNA, 21 bp, Artificial sequence
  SiRNA target sequence
ggtgattccgtatatatgatg

SEQ ID NO: 38111 - DNA, 21 bp, Artificial sequence
  SiRNA target sequence
gtgattccgtatatatgatga

SEQ ID NO: 38112 - DNA, 21 bp, Artificial sequence
  SiRNA target sequence
tgattccgtatatatgatgac

SEQ ID NO: 38113 - DNA, 21 bp, Artificial sequence
  SiRNA target sequence
gattccgtatatatgatgaca

SEQ ID NO: 38114 - DNA, 21 bp, Artificial sequence
  SiRNA target sequence
attccgtatatatgatgacac

SEQ ID NO: 38115 - DNA, 21 bp, Artificial sequence
  SiRNA target sequence
ttccgtatatatgatgacaca

SEQ ID NO: 38116 - DNA, 21 bp, Artificial sequence
  SiRNA target sequence
tccgtatatatgatgacacac

SEQ ID NO: 38117 - DNA, 21 bp, Artificial sequence
  SiRNA target sequence
ccgtatatatgatgacacaca

SEQ ID NO: 38118 - DNA, 21 bp, Artificial sequence
  SiRNA target sequence
cgtatatatgatgacacacag

SEQ ID NO: 38119 - DNA, 21 bp, Artificial sequence
  SiRNA target sequence
gtatatatgatgacacacagt

SEQ ID NO: 38120 - DNA, 21 bp, Artificial sequence
  SiRNA target sequence
tatatatgatgacacacagtc

SEQ ID NO: 38121 - DNA, 21 bp, Artificial sequence
  SiRNA target sequence
atatatgatgacacacagtca

SEQ ID NO: 38122 - DNA, 21 bp, Artificial sequence
  SiRNA target sequence
tatatgatgacacacagtcaa

SEQ ID NO: 38123 - DNA, 21 bp, Artificial sequence
  SiRNA target sequence
atatgatgacacacagtcaac

SEQ ID NO: 38124 - DNA, 21 bp, Artificial sequence
  SiRNA target sequence
tatgatgacacacagtcaacc

SEQ ID NO: 38125 - DNA, 21 bp, Artificial sequence
  SiRNA target sequence
atgatgacacacagtcaaccc

SEQ ID NO: 38126 - DNA, 21 bp, Artificial sequence
  SiRNA target sequence
tgatgacacacagtcaaccct

SEQ ID NO: 38127 - DNA, 21 bp, Artificial sequence
  SiRNA target sequence
gatgacacacagtcaaccctc

SEQ ID NO: 38128 - DNA, 21 bp, Artificial sequence
  SiRNA target sequence
atgacacacagtcaaccctct

SEQ ID NO: 38129 - DNA, 21 bp, Artificial sequence
  SiRNA target sequence
tgacacacagtcaaccctctg

SEQ ID NO: 38130 - DNA, 21 bp, Artificial sequence
  SiRNA target sequence
gacacacagtcaaccctctgg

SEQ ID NO: 38131 - DNA, 21 bp, Artificial sequence
  SiRNA target sequence
acacacagtcaaccctctggt

SEQ ID NO: 38132 - DNA, 21 bp, Artificial sequence
  SiRNA target sequence
cacacagtcaaccctctggta

SEQ ID NO: 38133 - DNA, 21 bp, Artificial sequence
  SiRNA target sequence
acacagtcaaccctctggtaa

SEQ ID NO: 38134 - DNA, 21 bp, Artificial sequence
  SiRNA target sequence
cacagtcaaccctctggtaat

SEQ ID NO: 38135 - DNA, 21 bp, Artificial sequence
  SiRNA target sequence
acagtcaaccctctggtaatc

SEQ ID NO: 38136 - DNA, 21 bp, Artificial sequence
  SiRNA target sequence
cagtcaaccctctggtaatcc

SEQ ID NO: 38137 - DNA, 21 bp, Artificial sequence
  SiRNA target sequence
agtcaaccctctggtaatccg

SEQ ID NO: 38138 - DNA, 21 bp, Artificial sequence
  SiRNA target sequence
gtcaaccctctggtaatccgg

SEQ ID NO: 38139 - DNA, 21 bp, Artificial sequence
  SiRNA target sequence
tcaaccctctggtaatccggc

SEQ ID NO: 38140 - DNA, 21 bp, Artificial sequence
  SiRNA target sequence
caaccctctggtaatccggca

SEQ ID NO: 38141 - DNA, 21 bp, Artificial sequence
  SiRNA target sequence
aaccctctggtaatccggcaa

SEQ ID NO: 38142 - DNA, 21 bp, Artificial sequence
  SiRNA target sequence
accctctggtaatccggcaac

SEQ ID NO: 38143 - DNA, 21 bp, Artificial sequence
  SiRNA target sequence
ccctctggtaatccggcaaca

SEQ ID NO: 38144 - DNA, 21 bp, Artificial sequence
  SiRNA target sequence
cctctggtaatccggcaacaa

SEQ ID NO: 38145 - DNA, 21 bp, Artificial sequence
  SiRNA target sequence
ctctggtaatccggcaacaac

SEQ ID NO: 38146 - DNA, 21 bp, Artificial sequence
  SiRNA target sequence
tctggtaatccggcaacaaca

SEQ ID NO: 38147 - DNA, 21 bp, Artificial sequence
  SiRNA target sequence
ctggtaatccggcaacaacac

SEQ ID NO: 38148 - DNA, 21 bp, Artificial sequence
  SiRNA target sequence
tggtaatccggcaacaacacc

SEQ ID NO: 38149 - DNA, 21 bp, Artificial sequence
  SiRNA target sequence
ggtaatccggcaacaacacct

SEQ ID NO: 38150 - DNA, 21 bp, Artificial sequence
  SiRNA target sequence
gtaatccggcaacaacacctc

SEQ ID NO: 38151 - DNA, 21 bp, Artificial sequence
  SiRNA target sequence
taatccggcaacaacacctct

SEQ ID NO: 38152 - DNA, 21 bp, Artificial sequence
  SiRNA target sequence
aatccggcaacaacacctcta

SEQ ID NO: 38153 - DNA, 21 bp, Artificial sequence
  SiRNA target sequence
atccggcaacaacacctctaa

SEQ ID NO: 38154 - DNA, 21 bp, Artificial sequence
  SiRNA target sequence
tccggcaacaacacctctaaa

SEQ ID NO: 38155 - DNA, 21 bp, Artificial sequence
  SiRNA target sequence
ccggcaacaacacctctaaat

SEQ ID NO: 38156 - DNA, 21 bp, Artificial sequence
  SiRNA target sequence
cggcaacaacacctctaaatt

SEQ ID NO: 38157 - DNA, 21 bp, Artificial sequence
  SiRNA target sequence
ggcaacaacacctctaaattg

SEQ ID NO: 38158 - DNA, 21 bp, Artificial sequence
  SiRNA target sequence
gcaacaacacctctaaattgt

SEQ ID NO: 38159 - DNA, 21 bp, Artificial sequence
  SiRNA target sequence
caacaacacctctaaattgtt

SEQ ID NO: 38160 - DNA, 21 bp, Artificial sequence
  SiRNA target sequence
aacaacacctctaaattgttt

SEQ ID NO: 38161 - DNA, 21 bp, Artificial sequence
  SiRNA target sequence
acaacacctctaaattgtttc

SEQ ID NO: 38162 - DNA, 21 bp, Artificial sequence
  SiRNA target sequence
caacacctctaaattgtttca

SEQ ID NO: 38163 - DNA, 21 bp, Artificial sequence
  SiRNA target sequence
aacacctctaaattgtttcat

SEQ ID NO: 38164 - DNA, 21 bp, Artificial sequence
  SiRNA target sequence
acacctctaaattgtttcata

SEQ ID NO: 38165 - DNA, 21 bp, Artificial sequence
  SiRNA target sequence
cacctctaaattgtttcataa

SEQ ID NO: 38166 - DNA, 21 bp, Artificial sequence
  SiRNA target sequence
acctctaaattgtttcataaa

SEQ ID NO: 38167 - DNA, 21 bp, Artificial sequence
  SiRNA target sequence
cctctaaattgtttcataaac

SEQ ID NO: 38168 - DNA, 21 bp, Artificial sequence
  SiRNA target sequence
ctctaaattgtttcataaaca

SEQ ID NO: 38169 - DNA, 21 bp, Artificial sequence
  SiRNA target sequence
tctaaattgtttcataaacag

SEQ ID NO: 38170 - DNA, 21 bp, Artificial sequence
  SiRNA target sequence
ctaaattgtttcataaacagt

SEQ ID NO: 38171 - DNA, 21 bp, Artificial sequence
  SiRNA target sequence
taaattgtttcataaacagta

SEQ ID NO: 38172 - DNA, 21 bp, Artificial sequence
  SiRNA target sequence
aaattgtttcataaacagtat

SEQ ID NO: 38173 - DNA, 21 bp, Artificial sequence
  SiRNA target sequence
aattgtttcataaacagtatg

SEQ ID NO: 38174 - DNA, 21 bp, Artificial sequence
  SiRNA target sequence
attgtttcataaacagtatgg

SEQ ID NO: 38175 - DNA, 21 bp, Artificial sequence
  SiRNA target sequence
ttgtttcataaacagtatggg

SEQ ID NO: 38176 - DNA, 21 bp, Artificial sequence
  SiRNA target sequence
tgtttcataaacagtatgggc

SEQ ID NO: 38177 - DNA, 21 bp, Artificial sequence
  SiRNA target sequence
gtttcataaacagtatgggct

SEQ ID NO: 38178 - DNA, 21 bp, Artificial sequence
  SiRNA target sequence
tttcataaacagtatgggctt

SEQ ID NO: 38179 - DNA, 21 bp, Artificial sequence
  SiRNA target sequence
ttcataaacagtatgggcttg

SEQ ID NO: 38180 - DNA, 21 bp, Artificial sequence
  SiRNA target sequence
tcataaacagtatgggcttgc

SEQ ID NO: 38181 - DNA, 21 bp, Artificial sequence
  SiRNA target sequence
cataaacagtatgggcttgcg

SEQ ID NO: 38182 - DNA, 21 bp, Artificial sequence
  SiRNA target sequence
ataaacagtatgggcttgcga

SEQ ID NO: 38183 - DNA, 21 bp, Artificial sequence
  SiRNA target sequence
taaacagtatgggcttgcgaa

SEQ ID NO: 38184 - DNA, 21 bp, Artificial sequence
  SiRNA target sequence
aaacagtatgggcttgcgaat

SEQ ID NO: 38185 - DNA, 21 bp, Artificial sequence
  SiRNA target sequence
aacagtatgggcttgcgaatg

SEQ ID NO: 38186 - DNA, 21 bp, Artificial sequence
  SiRNA target sequence
acagtatgggcttgcgaatgg

SEQ ID NO: 38187 - DNA, 21 bp, Artificial sequence
  SiRNA target sequence
cagtatgggcttgcgaatggt

SEQ ID NO: 38188 - DNA, 21 bp, Artificial sequence
  SiRNA target sequence
agtatgggcttgcgaatggtc

SEQ ID NO: 38189 - DNA, 21 bp, Artificial sequence
  SiRNA target sequence
gtatgggcttgcgaatggtct

SEQ ID NO: 38190 - DNA, 21 bp, Artificial sequence
  SiRNA target sequence
tatgggcttgcgaatggtctt

SEQ ID NO: 38191 - DNA, 21 bp, Artificial sequence
  SiRNA target sequence
atgggcttgcgaatggtcttt

SEQ ID NO: 38192 - DNA, 21 bp, Artificial sequence
  SiRNA target sequence
tgggcttgcgaatggtctttg

SEQ ID NO: 38193 - DNA, 21 bp, Artificial sequence
  SiRNA target sequence
gggcttgcgaatggtctttga

SEQ ID NO: 38194 - DNA, 21 bp, Artificial sequence
  SiRNA target sequence
ggcttgcgaatggtctttgaa

SEQ ID NO: 38195 - DNA, 21 bp, Artificial sequence
  SiRNA target sequence
gcttgcgaatggtctttgaac

SEQ ID NO: 38196 - DNA, 21 bp, Artificial sequence
  SiRNA target sequence
cttgcgaatggtctttgaact

SEQ ID NO: 38197 - DNA, 21 bp, Artificial sequence
  SiRNA target sequence
ttgcgaatggtctttgaactt

SEQ ID NO: 38198 - DNA, 21 bp, Artificial sequence
  SiRNA target sequence
tgcgaatggtctttgaacttt

SEQ ID NO: 38199 - DNA, 21 bp, Artificial sequence
  SiRNA target sequence
gcgaatggtctttgaactttg

SEQ ID NO: 38200 - DNA, 21 bp, Artificial sequence
  SiRNA target sequence
cgaatggtctttgaactttgt

SEQ ID NO: 38201 - DNA, 21 bp, Artificial sequence
  SiRNA target sequence
gaatggtctttgaactttgtt

SEQ ID NO: 38202 - DNA, 21 bp, Artificial sequence
  SiRNA target sequence
aatggtctttgaactttgttc

SEQ ID NO: 38203 - DNA, 21 bp, Artificial sequence
  SiRNA target sequence
atggtctttgaactttgttca

SEQ ID NO: 38204 - DNA, 21 bp, Artificial sequence
  SiRNA target sequence
tggtctttgaactttgttcaa

SEQ ID NO: 38205 - DNA, 21 bp, Artificial sequence
  SiRNA target sequence
ggtctttgaactttgttcaaa

SEQ ID NO: 38206 - DNA, 21 bp, Artificial sequence
  SiRNA target sequence
gtctttgaactttgttcaaag

SEQ ID NO: 38207 - DNA, 21 bp, Artificial sequence
  SiRNA target sequence
tctttgaactttgttcaaaga

SEQ ID NO: 38208 - DNA, 21 bp, Artificial sequence
  SiRNA target sequence
ctttgaactttgttcaaagaa

SEQ ID NO: 38209 - DNA, 21 bp, Artificial sequence
  SiRNA target sequence
tttgaactttgttcaaagaaa

SEQ ID NO: 38210 - DNA, 21 bp, Artificial sequence
  SiRNA target sequence
ttgaactttgttcaaagaaat

SEQ ID NO: 38211 - DNA, 21 bp, Artificial sequence
  SiRNA target sequence
tgaactttgttcaaagaaata

SEQ ID NO: 38212 - DNA, 21 bp, Artificial sequence
  SiRNA target sequence
gaactttgttcaaagaaatat

SEQ ID NO: 38213 - DNA, 21 bp, Artificial sequence
  SiRNA target sequence
aactttgttcaaagaaatatt

SEQ ID NO: 38214 - DNA, 21 bp, Artificial sequence
  SiRNA target sequence
actttgttcaaagaaatattc

SEQ ID NO: 38215 - DNA, 21 bp, Artificial sequence
  SiRNA target sequence
ctttgttcaaagaaatattcc

SEQ ID NO: 38216 - DNA, 21 bp, Artificial sequence
  SiRNA target sequence
tttgttcaaagaaatattccg

SEQ ID NO: 38217 - DNA, 21 bp, Artificial sequence
  SiRNA target sequence
ttgttcaaagaaatattccgc

SEQ ID NO: 38218 - DNA, 21 bp, Artificial sequence
  SiRNA target sequence
tgttcaaagaaatattccgcc

SEQ ID NO: 38219 - DNA, 21 bp, Artificial sequence
  SiRNA target sequence
gttcaaagaaatattccgccc

SEQ ID NO: 38220 - DNA, 21 bp, Artificial sequence
  SiRNA target sequence
ttcaaagaaatattccgccct

SEQ ID NO: 38221 - DNA, 21 bp, Artificial sequence
  SiRNA target sequence
tcaaagaaatattccgccctt

SEQ ID NO: 38222 - DNA, 21 bp, Artificial sequence
  SiRNA target sequence
caaagaaatattccgccctta

SEQ ID NO: 38223 - DNA, 21 bp, Artificial sequence
  SiRNA target sequence
aaagaaatattccgcccttaa

SEQ ID NO: 38224 - DNA, 21 bp, Artificial sequence
  SiRNA target sequence
aagaaatattccgcccttaac

SEQ ID NO: 38225 - DNA, 21 bp, Artificial sequence
  SiRNA target sequence
agaaatattccgcccttaacg

SEQ ID NO: 38226 - DNA, 21 bp, Artificial sequence
  SiRNA target sequence
gaaatattccgcccttaacgg

SEQ ID NO: 38227 - DNA, 21 bp, Artificial sequence
  SiRNA target sequence
aaatattccgcccttaacgga

SEQ ID NO: 38228 - DNA, 21 bp, Artificial sequence
  SiRNA target sequence
aatattccgcccttaacggaa

SEQ ID NO: 38229 - DNA, 21 bp, Artificial sequence
  SiRNA target sequence
atattccgcccttaacggaac

SEQ ID NO: 38230 - DNA, 21 bp, Artificial sequence
  SiRNA target sequence
tattccgcccttaacggaaca

SEQ ID NO: 38231 - DNA, 21 bp, Artificial sequence
  SiRNA target sequence
attccgcccttaacggaacaa

SEQ ID NO: 38232 - DNA, 21 bp, Artificial sequence
  SiRNA target sequence
ttccgcccttaacggaacaaa

SEQ ID NO: 38233 - DNA, 21 bp, Artificial sequence
  SiRNA target sequence
tccgcccttaacggaacaaaa

SEQ ID NO: 38234 - DNA, 21 bp, Artificial sequence
  SiRNA target sequence
ccgcccttaacggaacaaaat

SEQ ID NO: 38235 - DNA, 21 bp, Artificial sequence
  SiRNA target sequence
cgcccttaacggaacaaaatg

SEQ ID NO: 38236 - DNA, 21 bp, Artificial sequence
  SiRNA target sequence
gcccttaacggaacaaaatgc

SEQ ID NO: 38237 - DNA, 21 bp, Artificial sequence
  SiRNA target sequence
cccttaacggaacaaaatgct

SEQ ID NO: 38238 - DNA, 21 bp, Artificial sequence
  SiRNA target sequence
ccttaacggaacaaaatgcta

SEQ ID NO: 38239 - DNA, 21 bp, Artificial sequence
  SiRNA target sequence
cttaacggaacaaaatgctat

SEQ ID NO: 38240 - DNA, 21 bp, Artificial sequence
  SiRNA target sequence
ttaacggaacaaaatgctatg

SEQ ID NO: 38241 - DNA, 21 bp, Artificial sequence
  SiRNA target sequence
taacggaacaaaatgctatgt

SEQ ID NO: 38242 - DNA, 21 bp, Artificial sequence
  SiRNA target sequence
aacggaacaaaatgctatgta

SEQ ID NO: 38243 - DNA, 21 bp, Artificial sequence
  SiRNA target sequence
acggaacaaaatgctatgtaa

SEQ ID NO: 38244 - DNA, 21 bp, Artificial sequence
  SiRNA target sequence
cggaacaaaatgctatgtaat

SEQ ID NO: 38245 - DNA, 21 bp, Artificial sequence
  SiRNA target sequence
ggaacaaaatgctatgtaatg

SEQ ID NO: 38246 - DNA, 21 bp, Artificial sequence
  SiRNA target sequence
gaacaaaatgctatgtaatga

SEQ ID NO: 38247 - DNA, 21 bp, Artificial sequence
  SiRNA target sequence
aacaaaatgctatgtaatgaa

SEQ ID NO: 38248 - DNA, 21 bp, Artificial sequence
  SiRNA target sequence
acaaaatgctatgtaatgaaa

SEQ ID NO: 38249 - DNA, 21 bp, Artificial sequence
  SiRNA target sequence
caaaatgctatgtaatgaaag

SEQ ID NO: 38250 - DNA, 21 bp, Artificial sequence
  SiRNA target sequence
aaaatgctatgtaatgaaaga

SEQ ID NO: 38251 - DNA, 21 bp, Artificial sequence
  SiRNA target sequence
aaatgctatgtaatgaaagac

SEQ ID NO: 38252 - DNA, 21 bp, Artificial sequence
  SiRNA target sequence
aatgctatgtaatgaaagact

SEQ ID NO: 38253 - DNA, 21 bp, Artificial sequence
  SiRNA target sequence
atgctatgtaatgaaagactt

SEQ ID NO: 38254 - DNA, 21 bp, Artificial sequence
  SiRNA target sequence
tgctatgtaatgaaagacttt

SEQ ID NO: 38255 - DNA, 21 bp, Artificial sequence
  SiRNA target sequence
gctatgtaatgaaagactttt

SEQ ID NO: 38256 - DNA, 21 bp, Artificial sequence
  SiRNA target sequence
ctatgtaatgaaagacttttc

SEQ ID NO: 38257 - DNA, 21 bp, Artificial sequence
  SiRNA target sequence
tatgtaatgaaagacttttct

SEQ ID NO: 38258 - DNA, 21 bp, Artificial sequence
  SiRNA target sequence
atgtaatgaaagacttttcta

SEQ ID NO: 38259 - DNA, 21 bp, Artificial sequence
  SiRNA target sequence
tgtaatgaaagacttttctaa

SEQ ID NO: 38260 - DNA, 21 bp, Artificial sequence
  SiRNA target sequence
gtaatgaaagacttttctaag

SEQ ID NO: 38261 - DNA, 21 bp, Artificial sequence
  SiRNA target sequence
taatgaaagacttttctaagc

SEQ ID NO: 38262 - DNA, 21 bp, Artificial sequence
  SiRNA target sequence
aatgaaagacttttctaagca

SEQ ID NO: 38263 - DNA, 21 bp, Artificial sequence
  SiRNA target sequence
atgaaagacttttctaagcat

SEQ ID NO: 38264 - DNA, 21 bp, Artificial sequence
  SiRNA target sequence
tgaaagacttttctaagcatg

SEQ ID NO: 38265 - DNA, 21 bp, Artificial sequence
  SiRNA target sequence
gaaagacttttctaagcatgt

SEQ ID NO: 38266 - DNA, 21 bp, Artificial sequence
  SiRNA target sequence
aaagacttttctaagcatgta

SEQ ID NO: 38267 - DNA, 21 bp, Artificial sequence
  SiRNA target sequence
aagacttttctaagcatgtaa

SEQ ID NO: 38268 - DNA, 21 bp, Artificial sequence
  SiRNA target sequence
agacttttctaagcatgtaag

SEQ ID NO: 38269 - DNA, 21 bp, Artificial sequence
  SiRNA target sequence
gacttttctaagcatgtaagt

SEQ ID NO: 38270 - DNA, 21 bp, Artificial sequence
  SiRNA target sequence
acttttctaagcatgtaagta

SEQ ID NO: 38271 - DNA, 21 bp, Artificial sequence
  SiRNA target sequence
cttttctaagcatgtaagtat

SEQ ID NO: 38272 - DNA, 21 bp, Artificial sequence
  SiRNA target sequence
ttttctaagcatgtaagtata

SEQ ID NO: 38273 - DNA, 21 bp, Artificial sequence
  SiRNA target sequence
tttctaagcatgtaagtatag

SEQ ID NO: 38274 - DNA, 21 bp, Artificial sequence
  SiRNA target sequence
ttctaagcatgtaagtatagt

SEQ ID NO: 38275 - DNA, 21 bp, Artificial sequence
  SiRNA target sequence
tctaagcatgtaagtatagtt

SEQ ID NO: 38276 - DNA, 21 bp, Artificial sequence
  SiRNA target sequence
ctaagcatgtaagtatagttt

SEQ ID NO: 38277 - DNA, 21 bp, Artificial sequence
  SiRNA target sequence
taagcatgtaagtatagtttc

SEQ ID NO: 38278 - DNA, 21 bp, Artificial sequence
  SiRNA target sequence
aagcatgtaagtatagtttct

SEQ ID NO: 38279 - DNA, 21 bp, Artificial sequence
  SiRNA target sequence
agcatgtaagtatagtttctt

SEQ ID NO: 38280 - DNA, 21 bp, Artificial sequence
  SiRNA target sequence
gcatgtaagtatagtttctta

SEQ ID NO: 38281 - DNA, 21 bp, Artificial sequence
  SiRNA target sequence
catgtaagtatagtttcttat

SEQ ID NO: 38282 - DNA, 21 bp, Artificial sequence
  SiRNA target sequence
atgtaagtatagtttcttatg

SEQ ID NO: 38283 - DNA, 21 bp, Artificial sequence
  SiRNA target sequence
tgtaagtatagtttcttatgg

SEQ ID NO: 38284 - DNA, 21 bp, Artificial sequence
  SiRNA target sequence
gtaagtatagtttcttatgga

SEQ ID NO: 38285 - DNA, 21 bp, Artificial sequence
  SiRNA target sequence
taagtatagtttcttatggag

SEQ ID NO: 38286 - DNA, 21 bp, Artificial sequence
  SiRNA target sequence
aagtatagtttcttatggaga

SEQ ID NO: 38287 - DNA, 21 bp, Artificial sequence
  SiRNA target sequence
agtatagtttcttatggagat

SEQ ID NO: 38288 - DNA, 21 bp, Artificial sequence
  SiRNA target sequence
gtatagtttcttatggagatg

SEQ ID NO: 38289 - DNA, 21 bp, Artificial sequence
  SiRNA target sequence
tatagtttcttatggagatga

SEQ ID NO: 38290 - DNA, 21 bp, Artificial sequence
  SiRNA target sequence
atagtttcttatggagatgat

SEQ ID NO: 38291 - DNA, 21 bp, Artificial sequence
  SiRNA target sequence
tagtttcttatggagatgata

SEQ ID NO: 38292 - DNA, 21 bp, Artificial sequence
  SiRNA target sequence
agtttcttatggagatgataa

SEQ ID NO: 38293 - DNA, 21 bp, Artificial sequence
  SiRNA target sequence
gtttcttatggagatgataat

SEQ ID NO: 38294 - DNA, 21 bp, Artificial sequence
  SiRNA target sequence
tttcttatggagatgataatg

SEQ ID NO: 38295 - DNA, 21 bp, Artificial sequence
  SiRNA target sequence
ttcttatggagatgataatgt

SEQ ID NO: 38296 - DNA, 21 bp, Artificial sequence
  SiRNA target sequence
tcttatggagatgataatgtt

SEQ ID NO: 38297 - DNA, 21 bp, Artificial sequence
  SiRNA target sequence
cttatggagatgataatgtta

SEQ ID NO: 38298 - DNA, 21 bp, Artificial sequence
  SiRNA target sequence
ttatggagatgataatgttat

SEQ ID NO: 38299 - DNA, 21 bp, Artificial sequence
  SiRNA target sequence
tatggagatgataatgttatt

SEQ ID NO: 38300 - DNA, 21 bp, Artificial sequence
  SiRNA target sequence
atggagatgataatgttatta

SEQ ID NO: 38301 - DNA, 21 bp, Artificial sequence
  SiRNA target sequence
tggagatgataatgttattaa

SEQ ID NO: 38302 - DNA, 21 bp, Artificial sequence
  SiRNA target sequence
ggagatgataatgttattaac

SEQ ID NO: 38303 - DNA, 21 bp, Artificial sequence
  SiRNA target sequence
gagatgataatgttattaact

SEQ ID NO: 38304 - DNA, 21 bp, Artificial sequence
  SiRNA target sequence
agatgataatgttattaactt

SEQ ID NO: 38305 - DNA, 21 bp, Artificial sequence
  SiRNA target sequence
gatgataatgttattaacttt

SEQ ID NO: 38306 - DNA, 21 bp, Artificial sequence
  SiRNA target sequence
atgataatgttattaacttta

SEQ ID NO: 38307 - DNA, 21 bp, Artificial sequence
  SiRNA target sequence
tgataatgttattaactttag

SEQ ID NO: 38308 - DNA, 21 bp, Artificial sequence
  SiRNA target sequence
gataatgttattaactttagt

SEQ ID NO: 38309 - DNA, 21 bp, Artificial sequence
  SiRNA target sequence
ataatgttattaactttagtg

SEQ ID NO: 38310 - DNA, 21 bp, Artificial sequence
  SiRNA target sequence
taatgttattaactttagtga

SEQ ID NO: 38311 - DNA, 21 bp, Artificial sequence
  SiRNA target sequence
aatgttattaactttagtgat

SEQ ID NO: 38312 - DNA, 21 bp, Artificial sequence
  SiRNA target sequence
atgttattaactttagtgatg

SEQ ID NO: 38313 - DNA, 21 bp, Artificial sequence
  SiRNA target sequence
tgttattaactttagtgatga

SEQ ID NO: 38314 - DNA, 21 bp, Artificial sequence
  SiRNA target sequence
gttattaactttagtgatgaa

SEQ ID NO: 38315 - DNA, 21 bp, Artificial sequence
  SiRNA target sequence
ttattaactttagtgatgaag

SEQ ID NO: 38316 - DNA, 21 bp, Artificial sequence
  SiRNA target sequence
tattaactttagtgatgaagt

SEQ ID NO: 38317 - DNA, 21 bp, Artificial sequence
  SiRNA target sequence
attaactttagtgatgaagtt

SEQ ID NO: 38318 - DNA, 21 bp, Artificial sequence
  SiRNA target sequence
ttaactttagtgatgaagtta

SEQ ID NO: 38319 - DNA, 21 bp, Artificial sequence
  SiRNA target sequence
taactttagtgatgaagttag

SEQ ID NO: 38320 - DNA, 21 bp, Artificial sequence
  SiRNA target sequence
aactttagtgatgaagttagt

SEQ ID NO: 38321 - DNA, 21 bp, Artificial sequence
  SiRNA target sequence
actttagtgatgaagttagtg

SEQ ID NO: 38322 - DNA, 21 bp, Artificial sequence
  SiRNA target sequence
ctttagtgatgaagttagtga

SEQ ID NO: 38323 - DNA, 21 bp, Artificial sequence
  SiRNA target sequence
tttagtgatgaagttagtgaa

SEQ ID NO: 38324 - DNA, 21 bp, Artificial sequence
  SiRNA target sequence
ttagtgatgaagttagtgaat

SEQ ID NO: 38325 - DNA, 21 bp, Artificial sequence
  SiRNA target sequence
tagtgatgaagttagtgaatg

SEQ ID NO: 38326 - DNA, 21 bp, Artificial sequence
  SiRNA target sequence
agtgatgaagttagtgaatgg

SEQ ID NO: 38327 - DNA, 21 bp, Artificial sequence
  SiRNA target sequence
gtgatgaagttagtgaatggt

SEQ ID NO: 38328 - DNA, 21 bp, Artificial sequence
  SiRNA target sequence
tgatgaagttagtgaatggtt

SEQ ID NO: 38329 - DNA, 21 bp, Artificial sequence
  SiRNA target sequence
gatgaagttagtgaatggttc

SEQ ID NO: 38330 - DNA, 21 bp, Artificial sequence
  SiRNA target sequence
atgaagttagtgaatggttca

SEQ ID NO: 38331 - DNA, 21 bp, Artificial sequence
  SiRNA target sequence
tgaagttagtgaatggttcaa

SEQ ID NO: 38332 - DNA, 21 bp, Artificial sequence
  SiRNA target sequence
gaagttagtgaatggttcaac

SEQ ID NO: 38333 - DNA, 21 bp, Artificial sequence
  SiRNA target sequence
aagttagtgaatggttcaaca

SEQ ID NO: 38334 - DNA, 21 bp, Artificial sequence
  SiRNA target sequence
agttagtgaatggttcaacat

SEQ ID NO: 38335 - DNA, 21 bp, Artificial sequence
  SiRNA target sequence
gttagtgaatggttcaacatg

SEQ ID NO: 38336 - DNA, 21 bp, Artificial sequence
  SiRNA target sequence
ttagtgaatggttcaacatgg

SEQ ID NO: 38337 - DNA, 21 bp, Artificial sequence
  SiRNA target sequence
tagtgaatggttcaacatgga

SEQ ID NO: 38338 - DNA, 21 bp, Artificial sequence
  SiRNA target sequence
agtgaatggttcaacatggaa

SEQ ID NO: 38339 - DNA, 21 bp, Artificial sequence
  SiRNA target sequence
gtgaatggttcaacatggaaa

SEQ ID NO: 38340 - DNA, 21 bp, Artificial sequence
  SiRNA target sequence
tgaatggttcaacatggaaac

SEQ ID NO: 38341 - DNA, 21 bp, Artificial sequence
  SiRNA target sequence
gaatggttcaacatggaaact

SEQ ID NO: 38342 - DNA, 21 bp, Artificial sequence
  SiRNA target sequence
aatggttcaacatggaaacta

SEQ ID NO: 38343 - DNA, 21 bp, Artificial sequence
  SiRNA target sequence
atggttcaacatggaaactat

SEQ ID NO: 38344 - DNA, 21 bp, Artificial sequence
  SiRNA target sequence
tggttcaacatggaaactatt

SEQ ID NO: 38345 - DNA, 21 bp, Artificial sequence
  SiRNA target sequence
ggttcaacatggaaactatta

SEQ ID NO: 38346 - DNA, 21 bp, Artificial sequence
  SiRNA target sequence
gttcaacatggaaactattac

SEQ ID NO: 38347 - DNA, 21 bp, Artificial sequence
  SiRNA target sequence
ttcaacatggaaactattact

SEQ ID NO: 38348 - DNA, 21 bp, Artificial sequence
  SiRNA target sequence
tcaacatggaaactattactg

SEQ ID NO: 38349 - DNA, 21 bp, Artificial sequence
  SiRNA target sequence
caacatggaaactattactga

SEQ ID NO: 38350 - DNA, 21 bp, Artificial sequence
  SiRNA target sequence
aacatggaaactattactgaa

SEQ ID NO: 38351 - DNA, 21 bp, Artificial sequence
  SiRNA target sequence
acatggaaactattactgaag

SEQ ID NO: 38352 - DNA, 21 bp, Artificial sequence
  SiRNA target sequence
catggaaactattactgaagc

SEQ ID NO: 38353 - DNA, 21 bp, Artificial sequence
  SiRNA target sequence
atggaaactattactgaagct

SEQ ID NO: 38354 - DNA, 21 bp, Artificial sequence
  SiRNA target sequence
tggaaactattactgaagctt

SEQ ID NO: 38355 - DNA, 21 bp, Artificial sequence
  SiRNA target sequence
ggaaactattactgaagcttt

SEQ ID NO: 38356 - DNA, 21 bp, Artificial sequence
  SiRNA target sequence
gaaactattactgaagctttt

SEQ ID NO: 38357 - DNA, 21 bp, Artificial sequence
  SiRNA target sequence
aaactattactgaagcttttg

SEQ ID NO: 38358 - DNA, 21 bp, Artificial sequence
  SiRNA target sequence
aactattactgaagcttttga

SEQ ID NO: 38359 - DNA, 21 bp, Artificial sequence
  SiRNA target sequence
actattactgaagcttttgag

SEQ ID NO: 38360 - DNA, 21 bp, Artificial sequence
  SiRNA target sequence
ctattactgaagcttttgaga

SEQ ID NO: 38361 - DNA, 21 bp, Artificial sequence
  SiRNA target sequence
tattactgaagcttttgagaa

SEQ ID NO: 38362 - DNA, 21 bp, Artificial sequence
  SiRNA target sequence
attactgaagcttttgagaag

SEQ ID NO: 38363 - DNA, 21 bp, Artificial sequence
  SiRNA target sequence
ttactgaagcttttgagaagt

SEQ ID NO: 38364 - DNA, 21 bp, Artificial sequence
  SiRNA target sequence
tactgaagcttttgagaagtt

SEQ ID NO: 38365 - DNA, 21 bp, Artificial sequence
  SiRNA target sequence
actgaagcttttgagaagtta

SEQ ID NO: 38366 - DNA, 21 bp, Artificial sequence
  SiRNA target sequence
ctgaagcttttgagaagttag

SEQ ID NO: 38367 - DNA, 21 bp, Artificial sequence
  SiRNA target sequence
tgaagcttttgagaagttagg

SEQ ID NO: 38368 - DNA, 21 bp, Artificial sequence
  SiRNA target sequence
gaagcttttgagaagttaggg

SEQ ID NO: 38369 - DNA, 21 bp, Artificial sequence
  SiRNA target sequence
aagcttttgagaagttagggt

SEQ ID NO: 38370 - DNA, 21 bp, Artificial sequence
  SiRNA target sequence
agcttttgagaagttagggtt

SEQ ID NO: 38371 - DNA, 21 bp, Artificial sequence
  SiRNA target sequence
gcttttgagaagttagggttt

SEQ ID NO: 38372 - DNA, 21 bp, Artificial sequence
  SiRNA target sequence
cttttgagaagttagggttta

SEQ ID NO: 38373 - DNA, 21 bp, Artificial sequence
  SiRNA target sequence
ttttgagaagttagggtttac

SEQ ID NO: 38374 - DNA, 21 bp, Artificial sequence
  SiRNA target sequence
tttgagaagttagggtttacg

SEQ ID NO: 38375 - DNA, 21 bp, Artificial sequence
  SiRNA target sequence
ttgagaagttagggtttacgt

SEQ ID NO: 38376 - DNA, 21 bp, Artificial sequence
  SiRNA target sequence
tgagaagttagggtttacgta

SEQ ID NO: 38377 - DNA, 21 bp, Artificial sequence
  SiRNA target sequence
gagaagttagggtttacgtat

SEQ ID NO: 38378 - DNA, 21 bp, Artificial sequence
  SiRNA target sequence
agaagttagggtttacgtata

SEQ ID NO: 38379 - DNA, 21 bp, Artificial sequence
  SiRNA target sequence
gaagttagggtttacgtatac

SEQ ID NO: 38380 - DNA, 21 bp, Artificial sequence
  SiRNA target sequence
aagttagggtttacgtatact

SEQ ID NO: 38381 - DNA, 21 bp, Artificial sequence
  SiRNA target sequence
agttagggtttacgtatactg

SEQ ID NO: 38382 - DNA, 21 bp, Artificial sequence
  SiRNA target sequence
gttagggtttacgtatactga

SEQ ID NO: 38383 - DNA, 21 bp, Artificial sequence
  SiRNA target sequence
ttagggtttacgtatactgac

SEQ ID NO: 38384 - DNA, 21 bp, Artificial sequence
  SiRNA target sequence
tagggtttacgtatactgacg

SEQ ID NO: 38385 - DNA, 21 bp, Artificial sequence
  SiRNA target sequence
agggtttacgtatactgacga

SEQ ID NO: 38386 - DNA, 21 bp, Artificial sequence
  SiRNA target sequence
gggtttacgtatactgacgaa

SEQ ID NO: 38387 - DNA, 21 bp, Artificial sequence
  SiRNA target sequence
ggtttacgtatactgacgaac

SEQ ID NO: 38388 - DNA, 21 bp, Artificial sequence
  SiRNA target sequence
gtttacgtatactgacgaact

SEQ ID NO: 38389 - DNA, 21 bp, Artificial sequence
  SiRNA target sequence
tttacgtatactgacgaactt

SEQ ID NO: 38390 - DNA, 21 bp, Artificial sequence
  SiRNA target sequence
ttacgtatactgacgaactta

SEQ ID NO: 38391 - DNA, 21 bp, Artificial sequence
  SiRNA target sequence
tacgtatactgacgaacttaa

SEQ ID NO: 38392 - DNA, 21 bp, Artificial sequence
  SiRNA target sequence
acgtatactgacgaacttaaa

SEQ ID NO: 38393 - DNA, 21 bp, Artificial sequence
  SiRNA target sequence
cgtatactgacgaacttaaag

SEQ ID NO: 38394 - DNA, 21 bp, Artificial sequence
  SiRNA target sequence
gtatactgacgaacttaaagg

SEQ ID NO: 38395 - DNA, 21 bp, Artificial sequence
  SiRNA target sequence
tatactgacgaacttaaaggc

SEQ ID NO: 38396 - DNA, 21 bp, Artificial sequence
  SiRNA target sequence
atactgacgaacttaaaggca

SEQ ID NO: 38397 - DNA, 21 bp, Artificial sequence
  SiRNA target sequence
tactgacgaacttaaaggcaa

SEQ ID NO: 38398 - DNA, 21 bp, Artificial sequence
  SiRNA target sequence
actgacgaacttaaaggcaag

SEQ ID NO: 38399 - DNA, 21 bp, Artificial sequence
  SiRNA target sequence
ctgacgaacttaaaggcaaga

SEQ ID NO: 38400 - DNA, 21 bp, Artificial sequence
  SiRNA target sequence
tgacgaacttaaaggcaagaa

SEQ ID NO: 38401 - DNA, 21 bp, Artificial sequence
  SiRNA target sequence
gacgaacttaaaggcaagaat

SEQ ID NO: 38402 - DNA, 21 bp, Artificial sequence
  SiRNA target sequence
acgaacttaaaggcaagaatg

SEQ ID NO: 38403 - DNA, 21 bp, Artificial sequence
  SiRNA target sequence
cgaacttaaaggcaagaatgg

SEQ ID NO: 38404 - DNA, 21 bp, Artificial sequence
  SiRNA target sequence
gaacttaaaggcaagaatgga

SEQ ID NO: 38405 - DNA, 21 bp, Artificial sequence
  SiRNA target sequence
aacttaaaggcaagaatggag

SEQ ID NO: 38406 - DNA, 21 bp, Artificial sequence
  SiRNA target sequence
acttaaaggcaagaatggaga

SEQ ID NO: 38407 - DNA, 21 bp, Artificial sequence
  SiRNA target sequence
cttaaaggcaagaatggagaa

SEQ ID NO: 38408 - DNA, 21 bp, Artificial sequence
  SiRNA target sequence
ttaaaggcaagaatggagaag

SEQ ID NO: 38409 - DNA, 21 bp, Artificial sequence
  SiRNA target sequence
taaaggcaagaatggagaagt

SEQ ID NO: 38410 - DNA, 21 bp, Artificial sequence
  SiRNA target sequence
aaaggcaagaatggagaagta

SEQ ID NO: 38411 - DNA, 21 bp, Artificial sequence
  SiRNA target sequence
aaggcaagaatggagaagtac

SEQ ID NO: 38412 - DNA, 21 bp, Artificial sequence
  SiRNA target sequence
aggcaagaatggagaagtacc

SEQ ID NO: 38413 - DNA, 21 bp, Artificial sequence
  SiRNA target sequence
ggcaagaatggagaagtacca

SEQ ID NO: 38414 - DNA, 21 bp, Artificial sequence
  SiRNA target sequence
gcaagaatggagaagtaccaa

SEQ ID NO: 38415 - DNA, 21 bp, Artificial sequence
  SiRNA target sequence
caagaatggagaagtaccaaa

SEQ ID NO: 38416 - DNA, 21 bp, Artificial sequence
  SiRNA target sequence
aagaatggagaagtaccaaaa

SEQ ID NO: 38417 - DNA, 21 bp, Artificial sequence
  SiRNA target sequence
agaatggagaagtaccaaaat

SEQ ID NO: 38418 - DNA, 21 bp, Artificial sequence
  SiRNA target sequence
gaatggagaagtaccaaaatg

SEQ ID NO: 38419 - DNA, 21 bp, Artificial sequence
  SiRNA target sequence
aatggagaagtaccaaaatgg

SEQ ID NO: 38420 - DNA, 21 bp, Artificial sequence
  SiRNA target sequence
atggagaagtaccaaaatggc

SEQ ID NO: 38421 - DNA, 21 bp, Artificial sequence
  SiRNA target sequence
tggagaagtaccaaaatggcg

SEQ ID NO: 38422 - DNA, 21 bp, Artificial sequence
  SiRNA target sequence
ggagaagtaccaaaatggcga

SEQ ID NO: 38423 - DNA, 21 bp, Artificial sequence
  SiRNA target sequence
gagaagtaccaaaatggcgaa

SEQ ID NO: 38424 - DNA, 21 bp, Artificial sequence
  SiRNA target sequence
agaagtaccaaaatggcgaac

SEQ ID NO: 38425 - DNA, 21 bp, Artificial sequence
  SiRNA target sequence
gaagtaccaaaatggcgaact

SEQ ID NO: 38426 - DNA, 21 bp, Artificial sequence
  SiRNA target sequence
aagtaccaaaatggcgaacta

SEQ ID NO: 38427 - DNA, 21 bp, Artificial sequence
  SiRNA target sequence
agtaccaaaatggcgaactat

SEQ ID NO: 38428 - DNA, 21 bp, Artificial sequence
  SiRNA target sequence
gtaccaaaatggcgaactatt

SEQ ID NO: 38429 - DNA, 21 bp, Artificial sequence
  SiRNA target sequence
taccaaaatggcgaactattg

SEQ ID NO: 38430 - DNA, 21 bp, Artificial sequence
  SiRNA target sequence
accaaaatggcgaactattga

SEQ ID NO: 38431 - DNA, 21 bp, Artificial sequence
  SiRNA target sequence
ccaaaatggcgaactattgaa

SEQ ID NO: 38432 - DNA, 21 bp, Artificial sequence
  SiRNA target sequence
caaaatggcgaactattgaag

SEQ ID NO: 38433 - DNA, 21 bp, Artificial sequence
  SiRNA target sequence
aaaatggcgaactattgaaga

SEQ ID NO: 38434 - DNA, 21 bp, Artificial sequence
  SiRNA target sequence
aaatggcgaactattgaagat

SEQ ID NO: 38435 - DNA, 21 bp, Artificial sequence
  SiRNA target sequence
aatggcgaactattgaagatg

SEQ ID NO: 38436 - DNA, 21 bp, Artificial sequence
  SiRNA target sequence
atggcgaactattgaagatgt

SEQ ID NO: 38437 - DNA, 21 bp, Artificial sequence
  SiRNA target sequence
tggcgaactattgaagatgtg

SEQ ID NO: 38438 - DNA, 21 bp, Artificial sequence
  SiRNA target sequence
ggcgaactattgaagatgtgc

SEQ ID NO: 38439 - DNA, 21 bp, Artificial sequence
  SiRNA target sequence
gcgaactattgaagatgtgca

SEQ ID NO: 38440 - DNA, 21 bp, Artificial sequence
  SiRNA target sequence
cgaactattgaagatgtgcaa

SEQ ID NO: 38441 - DNA, 21 bp, Artificial sequence
  SiRNA target sequence
gaactattgaagatgtgcaat

SEQ ID NO: 38442 - DNA, 21 bp, Artificial sequence
  SiRNA target sequence
aactattgaagatgtgcaata

SEQ ID NO: 38443 - DNA, 21 bp, Artificial sequence
  SiRNA target sequence
actattgaagatgtgcaatat

SEQ ID NO: 38444 - DNA, 21 bp, Artificial sequence
  SiRNA target sequence
ctattgaagatgtgcaatatc

SEQ ID NO: 38445 - DNA, 21 bp, Artificial sequence
  SiRNA target sequence
tattgaagatgtgcaatatct

SEQ ID NO: 38446 - DNA, 21 bp, Artificial sequence
  SiRNA target sequence
attgaagatgtgcaatatctc

SEQ ID NO: 38447 - DNA, 21 bp, Artificial sequence
  SiRNA target sequence
ttgaagatgtgcaatatctca

SEQ ID NO: 38448 - DNA, 21 bp, Artificial sequence
  SiRNA target sequence
tgaagatgtgcaatatctcaa

SEQ ID NO: 38449 - DNA, 21 bp, Artificial sequence
  SiRNA target sequence
gaagatgtgcaatatctcaaa

SEQ ID NO: 38450 - DNA, 21 bp, Artificial sequence
  SiRNA target sequence
aagatgtgcaatatctcaaaa

SEQ ID NO: 38451 - DNA, 21 bp, Artificial sequence
  SiRNA target sequence
agatgtgcaatatctcaaaag

SEQ ID NO: 38452 - DNA, 21 bp, Artificial sequence
  SiRNA target sequence
gatgtgcaatatctcaaaagg

SEQ ID NO: 38453 - DNA, 21 bp, Artificial sequence
  SiRNA target sequence
atgtgcaatatctcaaaagga

SEQ ID NO: 38454 - DNA, 21 bp, Artificial sequence
  SiRNA target sequence
tgtgcaatatctcaaaaggaa

SEQ ID NO: 38455 - DNA, 21 bp, Artificial sequence
  SiRNA target sequence
gtgcaatatctcaaaaggaaa

SEQ ID NO: 38456 - DNA, 21 bp, Artificial sequence
  SiRNA target sequence
tgcaatatctcaaaaggaaat

SEQ ID NO: 38457 - DNA, 21 bp, Artificial sequence
  SiRNA target sequence
gcaatatctcaaaaggaaatt

SEQ ID NO: 38458 - DNA, 21 bp, Artificial sequence
  SiRNA target sequence
caatatctcaaaaggaaattt

SEQ ID NO: 38459 - DNA, 21 bp, Artificial sequence
  SiRNA target sequence
aatatctcaaaaggaaatttc

SEQ ID NO: 38460 - DNA, 21 bp, Artificial sequence
  SiRNA target sequence
atatctcaaaaggaaatttcg

SEQ ID NO: 38461 - DNA, 21 bp, Artificial sequence
  SiRNA target sequence
tatctcaaaaggaaatttcga

SEQ ID NO: 38462 - DNA, 21 bp, Artificial sequence
  SiRNA target sequence
atctcaaaaggaaatttcgat

SEQ ID NO: 38463 - DNA, 21 bp, Artificial sequence
  SiRNA target sequence
tctcaaaaggaaatttcgata

SEQ ID NO: 38464 - DNA, 21 bp, Artificial sequence
  SiRNA target sequence
ctcaaaaggaaatttcgatat

SEQ ID NO: 38465 - DNA, 21 bp, Artificial sequence
  SiRNA target sequence
tcaaaaggaaatttcgatatg

SEQ ID NO: 38466 - DNA, 21 bp, Artificial sequence
  SiRNA target sequence
caaaaggaaatttcgatatga

SEQ ID NO: 38467 - DNA, 21 bp, Artificial sequence
  SiRNA target sequence
aaaaggaaatttcgatatgat

SEQ ID NO: 38468 - DNA, 21 bp, Artificial sequence
  SiRNA target sequence
aaaggaaatttcgatatgatt

SEQ ID NO: 38469 - DNA, 21 bp, Artificial sequence
  SiRNA target sequence
aaggaaatttcgatatgattc

SEQ ID NO: 38470 - DNA, 21 bp, Artificial sequence
  SiRNA target sequence
aggaaatttcgatatgattct

SEQ ID NO: 38471 - DNA, 21 bp, Artificial sequence
  SiRNA target sequence
ggaaatttcgatatgattcta

SEQ ID NO: 38472 - DNA, 21 bp, Artificial sequence
  SiRNA target sequence
gaaatttcgatatgattctaa

SEQ ID NO: 38473 - DNA, 21 bp, Artificial sequence
  SiRNA target sequence
aaatttcgatatgattctaaa

SEQ ID NO: 38474 - DNA, 21 bp, Artificial sequence
  SiRNA target sequence
aatttcgatatgattctaaac

SEQ ID NO: 38475 - DNA, 21 bp, Artificial sequence
  SiRNA target sequence
atttcgatatgattctaaacg

SEQ ID NO: 38476 - DNA, 21 bp, Artificial sequence
  SiRNA target sequence
tttcgatatgattctaaacgg

SEQ ID NO: 38477 - DNA, 21 bp, Artificial sequence
  SiRNA target sequence
ttcgatatgattctaaacgga

SEQ ID NO: 38478 - DNA, 21 bp, Artificial sequence
  SiRNA target sequence
tcgatatgattctaaacggaa

SEQ ID NO: 38479 - DNA, 21 bp, Artificial sequence
  SiRNA target sequence
cgatatgattctaaacggaaa

SEQ ID NO: 38480 - DNA, 21 bp, Artificial sequence
  SiRNA target sequence
gatatgattctaaacggaaag

SEQ ID NO: 38481 - DNA, 21 bp, Artificial sequence
  SiRNA target sequence
atatgattctaaacggaaagt

SEQ ID NO: 38482 - DNA, 21 bp, Artificial sequence
  SiRNA target sequence
tatgattctaaacggaaagta

SEQ ID NO: 38483 - DNA, 21 bp, Artificial sequence
  SiRNA target sequence
atgattctaaacggaaagtat

SEQ ID NO: 38484 - DNA, 21 bp, Artificial sequence
  SiRNA target sequence
tgattctaaacggaaagtatg

SEQ ID NO: 38485 - DNA, 21 bp, Artificial sequence
  SiRNA target sequence
gattctaaacggaaagtatgg

SEQ ID NO: 38486 - DNA, 21 bp, Artificial sequence
  SiRNA target sequence
attctaaacggaaagtatggg

SEQ ID NO: 38487 - DNA, 21 bp, Artificial sequence
  SiRNA target sequence
ttctaaacggaaagtatggga

SEQ ID NO: 38488 - DNA, 21 bp, Artificial sequence
  SiRNA target sequence
tctaaacggaaagtatgggaa

SEQ ID NO: 38489 - DNA, 21 bp, Artificial sequence
  SiRNA target sequence
ctaaacggaaagtatgggaag

SEQ ID NO: 38490 - DNA, 21 bp, Artificial sequence
  SiRNA target sequence
taaacggaaagtatgggaagc

SEQ ID NO: 38491 - DNA, 21 bp, Artificial sequence
  SiRNA target sequence
aaacggaaagtatgggaagcg

SEQ ID NO: 38492 - DNA, 21 bp, Artificial sequence
  SiRNA target sequence
aacggaaagtatgggaagcgc

SEQ ID NO: 38493 - DNA, 21 bp, Artificial sequence
  SiRNA target sequence
acggaaagtatgggaagcgcc

SEQ ID NO: 38494 - DNA, 21 bp, Artificial sequence
  SiRNA target sequence
cggaaagtatgggaagcgcca

SEQ ID NO: 38495 - DNA, 21 bp, Artificial sequence
  SiRNA target sequence
ggaaagtatgggaagcgccat

SEQ ID NO: 38496 - DNA, 21 bp, Artificial sequence
  SiRNA target sequence
gaaagtatgggaagcgccatt

SEQ ID NO: 38497 - DNA, 21 bp, Artificial sequence
  SiRNA target sequence
aaagtatgggaagcgccattg

SEQ ID NO: 38498 - DNA, 21 bp, Artificial sequence
  SiRNA target sequence
aagtatgggaagcgccattgt

SEQ ID NO: 38499 - DNA, 21 bp, Artificial sequence
  SiRNA target sequence
agtatgggaagcgccattgtg

SEQ ID NO: 38500 - DNA, 21 bp, Artificial sequence
  SiRNA target sequence
gtatgggaagcgccattgtgt

SEQ ID NO: 38501 - DNA, 21 bp, Artificial sequence
  SiRNA target sequence
tatgggaagcgccattgtgta

SEQ ID NO: 38502 - DNA, 21 bp, Artificial sequence
  SiRNA target sequence
atgggaagcgccattgtgtat

SEQ ID NO: 38503 - DNA, 21 bp, Artificial sequence
  SiRNA target sequence
tgggaagcgccattgtgtatg

SEQ ID NO: 38504 - DNA, 21 bp, Artificial sequence
  SiRNA target sequence
gggaagcgccattgtgtatgg

SEQ ID NO: 38505 - DNA, 21 bp, Artificial sequence
  SiRNA target sequence
ggaagcgccattgtgtatgga

SEQ ID NO: 38506 - DNA, 21 bp, Artificial sequence
  SiRNA target sequence
gaagcgccattgtgtatggac

SEQ ID NO: 38507 - DNA, 21 bp, Artificial sequence
  SiRNA target sequence
aagcgccattgtgtatggaca

SEQ ID NO: 38508 - DNA, 21 bp, Artificial sequence
  SiRNA target sequence
agcgccattgtgtatggacac

SEQ ID NO: 38509 - DNA, 21 bp, Artificial sequence
  SiRNA target sequence
gcgccattgtgtatggacaca

SEQ ID NO: 38510 - DNA, 21 bp, Artificial sequence
  SiRNA target sequence
cgccattgtgtatggacacaa

SEQ ID NO: 38511 - DNA, 21 bp, Artificial sequence
  SiRNA target sequence
gccattgtgtatggacacaat

SEQ ID NO: 38512 - DNA, 21 bp, Artificial sequence
  SiRNA target sequence
ccattgtgtatggacacaata

SEQ ID NO: 38513 - DNA, 21 bp, Artificial sequence
  SiRNA target sequence
cattgtgtatggacacaatac

SEQ ID NO: 38514 - DNA, 21 bp, Artificial sequence
  SiRNA target sequence
attgtgtatggacacaatact

SEQ ID NO: 38515 - DNA, 21 bp, Artificial sequence
  SiRNA target sequence
ttgtgtatggacacaatactg

SEQ ID NO: 38516 - DNA, 21 bp, Artificial sequence
  SiRNA target sequence
tgtgtatggacacaatactgg

SEQ ID NO: 38517 - DNA, 21 bp, Artificial sequence
  SiRNA target sequence
gtgtatggacacaatactgga

SEQ ID NO: 38518 - DNA, 21 bp, Artificial sequence
  SiRNA target sequence
tgtatggacacaatactggaa

SEQ ID NO: 38519 - DNA, 21 bp, Artificial sequence
  SiRNA target sequence
gtatggacacaatactggaaa

SEQ ID NO: 38520 - DNA, 21 bp, Artificial sequence
  SiRNA target sequence
tatggacacaatactggaaat

SEQ ID NO: 38521 - DNA, 21 bp, Artificial sequence
  SiRNA target sequence
atggacacaatactggaaatg

SEQ ID NO: 38522 - DNA, 21 bp, Artificial sequence
  SiRNA target sequence
tggacacaatactggaaatgc

SEQ ID NO: 38523 - DNA, 21 bp, Artificial sequence
  SiRNA target sequence
ggacacaatactggaaatgcc

SEQ ID NO: 38524 - DNA, 21 bp, Artificial sequence
  SiRNA target sequence
gacacaatactggaaatgcct

SEQ ID NO: 38525 - DNA, 21 bp, Artificial sequence
  SiRNA target sequence
acacaatactggaaatgccta

SEQ ID NO: 38526 - DNA, 21 bp, Artificial sequence
  SiRNA target sequence
cacaatactggaaatgcctaa

SEQ ID NO: 38527 - DNA, 21 bp, Artificial sequence
  SiRNA target sequence
acaatactggaaatgcctaat

SEQ ID NO: 38528 - DNA, 21 bp, Artificial sequence
  SiRNA target sequence
caatactggaaatgcctaatt

SEQ ID NO: 38529 - DNA, 21 bp, Artificial sequence
  SiRNA target sequence
aatactggaaatgcctaattg

SEQ ID NO: 38530 - DNA, 21 bp, Artificial sequence
  SiRNA target sequence
atactggaaatgcctaattgg

SEQ ID NO: 38531 - DNA, 21 bp, Artificial sequence
  SiRNA target sequence
tactggaaatgcctaattggt

SEQ ID NO: 38532 - DNA, 21 bp, Artificial sequence
  SiRNA target sequence
actggaaatgcctaattggtg

SEQ ID NO: 38533 - DNA, 21 bp, Artificial sequence
  SiRNA target sequence
ctggaaatgcctaattggtgt

SEQ ID NO: 38534 - DNA, 21 bp, Artificial sequence
  SiRNA target sequence
tggaaatgcctaattggtgtc

SEQ ID NO: 38535 - DNA, 21 bp, Artificial sequence
  SiRNA target sequence
ggaaatgcctaattggtgtcg

SEQ ID NO: 38536 - DNA, 21 bp, Artificial sequence
  SiRNA target sequence
gaaatgcctaattggtgtcga

SEQ ID NO: 38537 - DNA, 21 bp, Artificial sequence
  SiRNA target sequence
aaatgcctaattggtgtcgag

SEQ ID NO: 38538 - DNA, 21 bp, Artificial sequence
  SiRNA target sequence
aatgcctaattggtgtcgagg

SEQ ID NO: 38539 - DNA, 21 bp, Artificial sequence
  SiRNA target sequence
atgcctaattggtgtcgagga

SEQ ID NO: 38540 - DNA, 21 bp, Artificial sequence
  SiRNA target sequence
tgcctaattggtgtcgaggaa

SEQ ID NO: 38541 - DNA, 21 bp, Artificial sequence
  SiRNA target sequence
gcctaattggtgtcgaggaag

SEQ ID NO: 38542 - DNA, 21 bp, Artificial sequence
  SiRNA target sequence
cctaattggtgtcgaggaagt

SEQ ID NO: 38543 - DNA, 21 bp, Artificial sequence
  SiRNA target sequence
ctaattggtgtcgaggaagtc

SEQ ID NO: 38544 - DNA, 21 bp, Artificial sequence
  SiRNA target sequence
taattggtgtcgaggaagtct

SEQ ID NO: 38545 - DNA, 21 bp, Artificial sequence
  SiRNA target sequence
aattggtgtcgaggaagtctc

SEQ ID NO: 38546 - DNA, 21 bp, Artificial sequence
  SiRNA target sequence
attggtgtcgaggaagtctcg

SEQ ID NO: 38547 - DNA, 21 bp, Artificial sequence
  SiRNA target sequence
ttggtgtcgaggaagtctcga

SEQ ID NO: 38548 - DNA, 21 bp, Artificial sequence
  SiRNA target sequence
tggtgtcgaggaagtctcgac

SEQ ID NO: 38549 - DNA, 21 bp, Artificial sequence
  SiRNA target sequence
ggtgtcgaggaagtctcgaca

SEQ ID NO: 38550 - DNA, 21 bp, Artificial sequence
  SiRNA target sequence
gtgtcgaggaagtctcgacat

SEQ ID NO: 38551 - DNA, 21 bp, Artificial sequence
  SiRNA target sequence
tgtcgaggaagtctcgacatt

SEQ ID NO: 38552 - DNA, 21 bp, Artificial sequence
  SiRNA target sequence
gtcgaggaagtctcgacattc

SEQ ID NO: 38553 - DNA, 21 bp, Artificial sequence
  SiRNA target sequence
tcgaggaagtctcgacattca

SEQ ID NO: 38554 - DNA, 21 bp, Artificial sequence
  SiRNA target sequence
cgaggaagtctcgacattcaa

SEQ ID NO: 38555 - DNA, 21 bp, Artificial sequence
  SiRNA target sequence
gaggaagtctcgacattcaag

SEQ ID NO: 38556 - DNA, 21 bp, Artificial sequence
  SiRNA target sequence
aggaagtctcgacattcaaga

SEQ ID NO: 38557 - DNA, 21 bp, Artificial sequence
  SiRNA target sequence
ggaagtctcgacattcaagaa

SEQ ID NO: 38558 - DNA, 21 bp, Artificial sequence
  SiRNA target sequence
gaagtctcgacattcaagaag

SEQ ID NO: 38559 - DNA, 21 bp, Artificial sequence
  SiRNA target sequence
aagtctcgacattcaagaagg

SEQ ID NO: 38560 - DNA, 21 bp, Artificial sequence
  SiRNA target sequence
agtctcgacattcaagaagga

SEQ ID NO: 38561 - DNA, 21 bp, Artificial sequence
  SiRNA target sequence
gtctcgacattcaagaaggaa

SEQ ID NO: 38562 - DNA, 21 bp, Artificial sequence
  SiRNA target sequence
tctcgacattcaagaaggaac

SEQ ID NO: 38563 - DNA, 21 bp, Artificial sequence
  SiRNA target sequence
ctcgacattcaagaaggaact

SEQ ID NO: 38564 - DNA, 21 bp, Artificial sequence
  SiRNA target sequence
tcgacattcaagaaggaacta

SEQ ID NO: 38565 - DNA, 21 bp, Artificial sequence
  SiRNA target sequence
cgacattcaagaaggaactaa

SEQ ID NO: 38566 - DNA, 21 bp, Artificial sequence
  SiRNA target sequence
gacattcaagaaggaactaaa

SEQ ID NO: 38567 - DNA, 21 bp, Artificial sequence
  SiRNA target sequence
acattcaagaaggaactaaag

SEQ ID NO: 38568 - DNA, 21 bp, Artificial sequence
  SiRNA target sequence
cattcaagaaggaactaaagt

SEQ ID NO: 38569 - DNA, 21 bp, Artificial sequence
  SiRNA target sequence
attcaagaaggaactaaagtt

SEQ ID NO: 38570 - DNA, 21 bp, Artificial sequence
  SiRNA target sequence
ttcaagaaggaactaaagtta

SEQ ID NO: 38571 - DNA, 21 bp, Artificial sequence
  SiRNA target sequence
tcaagaaggaactaaagttaa

SEQ ID NO: 38572 - DNA, 21 bp, Artificial sequence
  SiRNA target sequence
caagaaggaactaaagttaat

SEQ ID NO: 38573 - DNA, 21 bp, Artificial sequence
  SiRNA target sequence
aagaaggaactaaagttaatt

SEQ ID NO: 38574 - DNA, 21 bp, Artificial sequence
  SiRNA target sequence
agaaggaactaaagttaattg

SEQ ID NO: 38575 - DNA, 21 bp, Artificial sequence
  SiRNA target sequence
gaaggaactaaagttaattgt

SEQ ID NO: 38576 - DNA, 21 bp, Artificial sequence
  SiRNA target sequence
aaggaactaaagttaattgtg

SEQ ID NO: 38577 - DNA, 21 bp, Artificial sequence
  SiRNA target sequence
aggaactaaagttaattgtga

SEQ ID NO: 38578 - DNA, 21 bp, Artificial sequence
  SiRNA target sequence
ggaactaaagttaattgtgaa

SEQ ID NO: 38579 - DNA, 21 bp, Artificial sequence
  SiRNA target sequence
gaactaaagttaattgtgaaa

SEQ ID NO: 38580 - DNA, 21 bp, Artificial sequence
  SiRNA target sequence
aactaaagttaattgtgaaaa

SEQ ID NO: 38581 - DNA, 21 bp, Artificial sequence
  SiRNA target sequence
actaaagttaattgtgaaaat

SEQ ID NO: 38582 - DNA, 21 bp, Artificial sequence
  SiRNA target sequence
ctaaagttaattgtgaaaatg

SEQ ID NO: 38583 - DNA, 21 bp, Artificial sequence
  SiRNA target sequence
taaagttaattgtgaaaatgc

SEQ ID NO: 38584 - DNA, 21 bp, Artificial sequence
  SiRNA target sequence
aaagttaattgtgaaaatgca

SEQ ID NO: 38585 - DNA, 21 bp, Artificial sequence
  SiRNA target sequence
aagttaattgtgaaaatgcaa

SEQ ID NO: 38586 - DNA, 21 bp, Artificial sequence
  SiRNA target sequence
agttaattgtgaaaatgcaat

SEQ ID NO: 38587 - DNA, 21 bp, Artificial sequence
  SiRNA target sequence
gttaattgtgaaaatgcaatt

SEQ ID NO: 38588 - DNA, 21 bp, Artificial sequence
  SiRNA target sequence
ttaattgtgaaaatgcaatta

SEQ ID NO: 38589 - DNA, 21 bp, Artificial sequence
  SiRNA target sequence
taattgtgaaaatgcaattat

SEQ ID NO: 38590 - DNA, 21 bp, Artificial sequence
  SiRNA target sequence
aattgtgaaaatgcaattatg

SEQ ID NO: 38591 - DNA, 21 bp, Artificial sequence
  SiRNA target sequence
attgtgaaaatgcaattatgg

SEQ ID NO: 38592 - DNA, 21 bp, Artificial sequence
  SiRNA target sequence
ttgtgaaaatgcaattatgga

SEQ ID NO: 38593 - DNA, 21 bp, Artificial sequence
  SiRNA target sequence
tgtgaaaatgcaattatggag

SEQ ID NO: 38594 - DNA, 21 bp, Artificial sequence
  SiRNA target sequence
gtgaaaatgcaattatggagc

SEQ ID NO: 38595 - DNA, 21 bp, Artificial sequence
  SiRNA target sequence
tgaaaatgcaattatggagct

SEQ ID NO: 38596 - DNA, 21 bp, Artificial sequence
  SiRNA target sequence
gaaaatgcaattatggagctt

SEQ ID NO: 38597 - DNA, 21 bp, Artificial sequence
  SiRNA target sequence
aaaatgcaattatggagcttt

SEQ ID NO: 38598 - DNA, 21 bp, Artificial sequence
  SiRNA target sequence
aaatgcaattatggagctttc

SEQ ID NO: 38599 - DNA, 21 bp, Artificial sequence
  SiRNA target sequence
aatgcaattatggagctttct

SEQ ID NO: 38600 - DNA, 21 bp, Artificial sequence
  SiRNA target sequence
atgcaattatggagctttcta

SEQ ID NO: 38601 - DNA, 21 bp, Artificial sequence
  SiRNA target sequence
tgcaattatggagctttctat

SEQ ID NO: 38602 - DNA, 21 bp, Artificial sequence
  SiRNA target sequence
gcaattatggagctttctatg

SEQ ID NO: 38603 - DNA, 21 bp, Artificial sequence
  SiRNA target sequence
caattatggagctttctatgc

SEQ ID NO: 38604 - DNA, 21 bp, Artificial sequence
  SiRNA target sequence
aattatggagctttctatgca

SEQ ID NO: 38605 - DNA, 21 bp, Artificial sequence
  SiRNA target sequence
attatggagctttctatgcat

SEQ ID NO: 38606 - DNA, 21 bp, Artificial sequence
  SiRNA target sequence
ttatggagctttctatgcatg

SEQ ID NO: 38607 - DNA, 21 bp, Artificial sequence
  SiRNA target sequence
tatggagctttctatgcatga

SEQ ID NO: 38608 - DNA, 21 bp, Artificial sequence
  SiRNA target sequence
atggagctttctatgcatgag

SEQ ID NO: 38609 - DNA, 21 bp, Artificial sequence
  SiRNA target sequence
tggagctttctatgcatgagg

SEQ ID NO: 38610 - DNA, 21 bp, Artificial sequence
  SiRNA target sequence
ggagctttctatgcatgagga

SEQ ID NO: 38611 - DNA, 21 bp, Artificial sequence
  SiRNA target sequence
gagctttctatgcatgaggaa

SEQ ID NO: 38612 - DNA, 21 bp, Artificial sequence
  SiRNA target sequence
agctttctatgcatgaggaat

SEQ ID NO: 38613 - DNA, 21 bp, Artificial sequence
  SiRNA target sequence
gctttctatgcatgaggaata

SEQ ID NO: 38614 - DNA, 21 bp, Artificial sequence
  SiRNA target sequence
ctttctatgcatgaggaatat

SEQ ID NO: 38615 - DNA, 21 bp, Artificial sequence
  SiRNA target sequence
tttctatgcatgaggaatatg

SEQ ID NO: 38616 - DNA, 21 bp, Artificial sequence
  SiRNA target sequence
ttctatgcatgaggaatatgt

SEQ ID NO: 38617 - DNA, 21 bp, Artificial sequence
  SiRNA target sequence
tctatgcatgaggaatatgta

SEQ ID NO: 38618 - DNA, 21 bp, Artificial sequence
  SiRNA target sequence
ctatgcatgaggaatatgtat

SEQ ID NO: 38619 - DNA, 21 bp, Artificial sequence
  SiRNA target sequence
tatgcatgaggaatatgtatt

SEQ ID NO: 38620 - DNA, 21 bp, Artificial sequence
  SiRNA target sequence
atgcatgaggaatatgtattt

SEQ ID NO: 38621 - DNA, 21 bp, Artificial sequence
  SiRNA target sequence
tgcatgaggaatatgtatttg

SEQ ID NO: 38622 - DNA, 21 bp, Artificial sequence
  SiRNA target sequence
gcatgaggaatatgtatttga

SEQ ID NO: 38623 - DNA, 21 bp, Artificial sequence
  SiRNA target sequence
catgaggaatatgtatttgat

SEQ ID NO: 38624 - DNA, 21 bp, Artificial sequence
  SiRNA target sequence
atgaggaatatgtatttgata

SEQ ID NO: 38625 - DNA, 21 bp, Artificial sequence
  SiRNA target sequence
tgaggaatatgtatttgataa

SEQ ID NO: 38626 - DNA, 21 bp, Artificial sequence
  SiRNA target sequence
gaggaatatgtatttgataag

SEQ ID NO: 38627 - DNA, 21 bp, Artificial sequence
  SiRNA target sequence
aggaatatgtatttgataagt

SEQ ID NO: 38628 - DNA, 21 bp, Artificial sequence
  SiRNA target sequence
ggaatatgtatttgataagtg

SEQ ID NO: 38629 - DNA, 21 bp, Artificial sequence
  SiRNA target sequence
gaatatgtatttgataagtgg

SEQ ID NO: 38630 - DNA, 21 bp, Artificial sequence
  SiRNA target sequence
aatatgtatttgataagtggt

SEQ ID NO: 38631 - DNA, 21 bp, Artificial sequence
  SiRNA target sequence
atatgtatttgataagtggtc

SEQ ID NO: 38632 - DNA, 21 bp, Artificial sequence
  SiRNA target sequence
tatgtatttgataagtggtcc

SEQ ID NO: 38633 - DNA, 21 bp, Artificial sequence
  SiRNA target sequence
atgtatttgataagtggtcca

SEQ ID NO: 38634 - DNA, 21 bp, Artificial sequence
  SiRNA target sequence
tgtatttgataagtggtccaa

SEQ ID NO: 38635 - DNA, 21 bp, Artificial sequence
  SiRNA target sequence
gtatttgataagtggtccaaa

SEQ ID NO: 38636 - DNA, 21 bp, Artificial sequence
  SiRNA target sequence
tatttgataagtggtccaaag

SEQ ID NO: 38637 - DNA, 21 bp, Artificial sequence
  SiRNA target sequence
atttgataagtggtccaaagt

SEQ ID NO: 38638 - DNA, 21 bp, Artificial sequence
  SiRNA target sequence
tttgataagtggtccaaagtg

SEQ ID NO: 38639 - DNA, 21 bp, Artificial sequence
  SiRNA target sequence
ttgataagtggtccaaagtga

SEQ ID NO: 38640 - DNA, 21 bp, Artificial sequence
  SiRNA target sequence
tgataagtggtccaaagtgat

SEQ ID NO: 38641 - DNA, 21 bp, Artificial sequence
  SiRNA target sequence
gataagtggtccaaagtgatt

SEQ ID NO: 38642 - DNA, 21 bp, Artificial sequence
  SiRNA target sequence
ataagtggtccaaagtgattt

SEQ ID NO: 38643 - DNA, 21 bp, Artificial sequence
  SiRNA target sequence
taagtggtccaaagtgatttc

SEQ ID NO: 38644 - DNA, 21 bp, Artificial sequence
  SiRNA target sequence
aagtggtccaaagtgatttct

SEQ ID NO: 38645 - DNA, 21 bp, Artificial sequence
  SiRNA target sequence
agtggtccaaagtgatttcta

SEQ ID NO: 38646 - DNA, 21 bp, Artificial sequence
  SiRNA target sequence
gtggtccaaagtgatttctaa

SEQ ID NO: 38647 - DNA, 21 bp, Artificial sequence
  SiRNA target sequence
tggtccaaagtgatttctaag

SEQ ID NO: 38648 - DNA, 21 bp, Artificial sequence
  SiRNA target sequence
ggtccaaagtgatttctaagg

SEQ ID NO: 38649 - DNA, 21 bp, Artificial sequence
  SiRNA target sequence
gtccaaagtgatttctaaggc

SEQ ID NO: 38650 - DNA, 21 bp, Artificial sequence
  SiRNA target sequence
tccaaagtgatttctaaggcc

SEQ ID NO: 38651 - DNA, 21 bp, Artificial sequence
  SiRNA target sequence
ccaaagtgatttctaaggcct

SEQ ID NO: 38652 - DNA, 21 bp, Artificial sequence
  SiRNA target sequence
caaagtgatttctaaggccta

SEQ ID NO: 38653 - DNA, 21 bp, Artificial sequence
  SiRNA target sequence
aaagtgatttctaaggcctat

SEQ ID NO: 38654 - DNA, 21 bp, Artificial sequence
  SiRNA target sequence
aagtgatttctaaggcctatc

SEQ ID NO: 38655 - DNA, 21 bp, Artificial sequence
  SiRNA target sequence
agtgatttctaaggcctatca

SEQ ID NO: 38656 - DNA, 21 bp, Artificial sequence
  SiRNA target sequence
gtgatttctaaggcctatcag

SEQ ID NO: 38657 - DNA, 21 bp, Artificial sequence
  SiRNA target sequence
tgatttctaaggcctatcaga

SEQ ID NO: 38658 - DNA, 21 bp, Artificial sequence
  SiRNA target sequence
gatttctaaggcctatcagaa

SEQ ID NO: 38659 - DNA, 21 bp, Artificial sequence
  SiRNA target sequence
atttctaaggcctatcagaag

SEQ ID NO: 38660 - DNA, 21 bp, Artificial sequence
  SiRNA target sequence
tttctaaggcctatcagaagg

SEQ ID NO: 38661 - DNA, 21 bp, Artificial sequence
  SiRNA target sequence
ttctaaggcctatcagaaggc

SEQ ID NO: 38662 - DNA, 21 bp, Artificial sequence
  SiRNA target sequence
tctaaggcctatcagaaggcc

SEQ ID NO: 38663 - DNA, 21 bp, Artificial sequence
  SiRNA target sequence
ctaaggcctatcagaaggcca

SEQ ID NO: 38664 - DNA, 21 bp, Artificial sequence
  SiRNA target sequence
taaggcctatcagaaggccac

SEQ ID NO: 38665 - DNA, 21 bp, Artificial sequence
  SiRNA target sequence
aaggcctatcagaaggccact

SEQ ID NO: 38666 - DNA, 21 bp, Artificial sequence
  SiRNA target sequence
aggcctatcagaaggccactg

SEQ ID NO: 38667 - DNA, 21 bp, Artificial sequence
  SiRNA target sequence
ggcctatcagaaggccactgg

SEQ ID NO: 38668 - DNA, 21 bp, Artificial sequence
  SiRNA target sequence
gcctatcagaaggccactgga

SEQ ID NO: 38669 - DNA, 21 bp, Artificial sequence
  SiRNA target sequence
cctatcagaaggccactggag

SEQ ID NO: 38670 - DNA, 21 bp, Artificial sequence
  SiRNA target sequence
ctatcagaaggccactggaga

SEQ ID NO: 38671 - DNA, 21 bp, Artificial sequence
  SiRNA target sequence
tatcagaaggccactggagat

SEQ ID NO: 38672 - DNA, 21 bp, Artificial sequence
  SiRNA target sequence
atcagaaggccactggagatt

SEQ ID NO: 38673 - DNA, 21 bp, Artificial sequence
  SiRNA target sequence
tcagaaggccactggagattg

SEQ ID NO: 38674 - DNA, 21 bp, Artificial sequence
  SiRNA target sequence
cagaaggccactggagattgt

SEQ ID NO: 38675 - DNA, 21 bp, Artificial sequence
  SiRNA target sequence
agaaggccactggagattgtt

SEQ ID NO: 38676 - DNA, 21 bp, Artificial sequence
  SiRNA target sequence
gaaggccactggagattgttt

SEQ ID NO: 38677 - DNA, 21 bp, Artificial sequence
  SiRNA target sequence
aaggccactggagattgtttg

SEQ ID NO: 38678 - DNA, 21 bp, Artificial sequence
  SiRNA target sequence
aggccactggagattgtttgg

SEQ ID NO: 38679 - DNA, 21 bp, Artificial sequence
  SiRNA target sequence
ggccactggagattgtttgga

SEQ ID NO: 38680 - DNA, 21 bp, Artificial sequence
  SiRNA target sequence
gccactggagattgtttggat

SEQ ID NO: 38681 - DNA, 21 bp, Artificial sequence
  SiRNA target sequence
ccactggagattgtttggata

SEQ ID NO: 38682 - DNA, 21 bp, Artificial sequence
  SiRNA target sequence
cactggagattgtttggatat

SEQ ID NO: 38683 - DNA, 21 bp, Artificial sequence
  SiRNA target sequence
actggagattgtttggatatc

SEQ ID NO: 38684 - DNA, 21 bp, Artificial sequence
  SiRNA target sequence
ctggagattgtttggatatca

SEQ ID NO: 38685 - DNA, 21 bp, Artificial sequence
  SiRNA target sequence
tggagattgtttggatatcag

SEQ ID NO: 38686 - DNA, 21 bp, Artificial sequence
  SiRNA target sequence
ggagattgtttggatatcagt

SEQ ID NO: 38687 - DNA, 21 bp, Artificial sequence
  SiRNA target sequence
gagattgtttggatatcagta

SEQ ID NO: 38688 - DNA, 21 bp, Artificial sequence
  SiRNA target sequence
agattgtttggatatcagtac

SEQ ID NO: 38689 - DNA, 21 bp, Artificial sequence
  SiRNA target sequence
gattgtttggatatcagtaca

SEQ ID NO: 38690 - DNA, 21 bp, Artificial sequence
  SiRNA target sequence
attgtttggatatcagtacat

SEQ ID NO: 38691 - DNA, 21 bp, Artificial sequence
  SiRNA target sequence
ttgtttggatatcagtacata

SEQ ID NO: 38692 - DNA, 21 bp, Artificial sequence
  SiRNA target sequence
tgtttggatatcagtacatat

SEQ ID NO: 38693 - DNA, 21 bp, Artificial sequence
  SiRNA target sequence
gtttggatatcagtacatata

SEQ ID NO: 38694 - DNA, 21 bp, Artificial sequence
  SiRNA target sequence
tttggatatcagtacatataa

SEQ ID NO: 38695 - DNA, 21 bp, Artificial sequence
  SiRNA target sequence
ttggatatcagtacatataat

SEQ ID NO: 38696 - DNA, 21 bp, Artificial sequence
  SiRNA target sequence
tggatatcagtacatataatg

SEQ ID NO: 38697 - DNA, 21 bp, Artificial sequence
  SiRNA target sequence
ggatatcagtacatataatgg

SEQ ID NO: 38698 - DNA, 21 bp, Artificial sequence
  SiRNA target sequence
gatatcagtacatataatggt

SEQ ID NO: 38699 - DNA, 21 bp, Artificial sequence
  SiRNA target sequence
atatcagtacatataatggtt

SEQ ID NO: 38700 - DNA, 21 bp, Artificial sequence
  SiRNA target sequence
tatcagtacatataatggtta

SEQ ID NO: 38701 - DNA, 21 bp, Artificial sequence
  SiRNA target sequence
atcagtacatataatggttat

SEQ ID NO: 38702 - DNA, 21 bp, Artificial sequence
  SiRNA target sequence
tcagtacatataatggttatg

SEQ ID NO: 38703 - DNA, 21 bp, Artificial sequence
  SiRNA target sequence
cagtacatataatggttatgc

SEQ ID NO: 38704 - DNA, 21 bp, Artificial sequence
  SiRNA target sequence
agtacatataatggttatgct

SEQ ID NO: 38705 - DNA, 21 bp, Artificial sequence
  SiRNA target sequence
gtacatataatggttatgctc

SEQ ID NO: 38706 - DNA, 21 bp, Artificial sequence
  SiRNA target sequence
tacatataatggttatgctca

SEQ ID NO: 38707 - DNA, 21 bp, Artificial sequence
  SiRNA target sequence
acatataatggttatgctcag

SEQ ID NO: 38708 - DNA, 21 bp, Artificial sequence
  SiRNA target sequence
catataatggttatgctcagg

SEQ ID NO: 38709 - DNA, 21 bp, Artificial sequence
  SiRNA target sequence
atataatggttatgctcagga

SEQ ID NO: 38710 - DNA, 21 bp, Artificial sequence
  SiRNA target sequence
tataatggttatgctcaggag

SEQ ID NO: 38711 - DNA, 21 bp, Artificial sequence
  SiRNA target sequence
ataatggttatgctcaggaga

SEQ ID NO: 38712 - DNA, 21 bp, Artificial sequence
  SiRNA target sequence
taatggttatgctcaggagag

SEQ ID NO: 38713 - DNA, 21 bp, Artificial sequence
  SiRNA target sequence
aatggttatgctcaggagaga

SEQ ID NO: 38714 - DNA, 21 bp, Artificial sequence
  SiRNA target sequence
atggttatgctcaggagagat

SEQ ID NO: 38715 - DNA, 21 bp, Artificial sequence
  SiRNA target sequence
tggttatgctcaggagagatt

SEQ ID NO: 38716 - DNA, 21 bp, Artificial sequence
  SiRNA target sequence
ggttatgctcaggagagattc

SEQ ID NO: 38717 - DNA, 21 bp, Artificial sequence
  SiRNA target sequence
gttatgctcaggagagattcc

SEQ ID NO: 38718 - DNA, 21 bp, Artificial sequence
  SiRNA target sequence
ttatgctcaggagagattcct

SEQ ID NO: 38719 - DNA, 21 bp, Artificial sequence
  SiRNA target sequence
tatgctcaggagagattccta

SEQ ID NO: 38720 - DNA, 21 bp, Artificial sequence
  SiRNA target sequence
atgctcaggagagattcctaa

SEQ ID NO: 38721 - DNA, 21 bp, Artificial sequence
  SiRNA target sequence
tgctcaggagagattcctaaa

SEQ ID NO: 38722 - DNA, 21 bp, Artificial sequence
  SiRNA target sequence
gctcaggagagattcctaaat

SEQ ID NO: 38723 - DNA, 21 bp, Artificial sequence
  SiRNA target sequence
ctcaggagagattcctaaatt

SEQ ID NO: 38724 - DNA, 21 bp, Artificial sequence
  SiRNA target sequence
tcaggagagattcctaaatta

SEQ ID NO: 38725 - DNA, 21 bp, Artificial sequence
  SiRNA target sequence
caggagagattcctaaattac

SEQ ID NO: 38726 - DNA, 21 bp, Artificial sequence
  SiRNA target sequence
aggagagattcctaaattact

SEQ ID NO: 38727 - DNA, 21 bp, Artificial sequence
  SiRNA target sequence
ggagagattcctaaattacta

SEQ ID NO: 38728 - DNA, 21 bp, Artificial sequence
  SiRNA target sequence
gagagattcctaaattactac

SEQ ID NO: 38729 - DNA, 21 bp, Artificial sequence
  SiRNA target sequence
agagattcctaaattactact

SEQ ID NO: 38730 - DNA, 21 bp, Artificial sequence
  SiRNA target sequence
gagattcctaaattactactt

SEQ ID NO: 38731 - DNA, 21 bp, Artificial sequence
  SiRNA target sequence
agattcctaaattactacttg

SEQ ID NO: 38732 - DNA, 21 bp, Artificial sequence
  SiRNA target sequence
gattcctaaattactacttgt

SEQ ID NO: 38733 - DNA, 21 bp, Artificial sequence
  SiRNA target sequence
attcctaaattactacttgta

SEQ ID NO: 38734 - DNA, 21 bp, Artificial sequence
  SiRNA target sequence
ttcctaaattactacttgtaa

SEQ ID NO: 38735 - DNA, 21 bp, Artificial sequence
  SiRNA target sequence
tcctaaattactacttgtaat

SEQ ID NO: 38736 - DNA, 21 bp, Artificial sequence
  SiRNA target sequence
cctaaattactacttgtaatt

SEQ ID NO: 38737 - DNA, 21 bp, Artificial sequence
  SiRNA target sequence
ctaaattactacttgtaattt

SEQ ID NO: 38738 - DNA, 21 bp, Artificial sequence
  SiRNA target sequence
taaattactacttgtaatttg

SEQ ID NO: 38739 - DNA, 21 bp, Artificial sequence
  SiRNA target sequence
aaattactacttgtaatttgg

SEQ ID NO: 38740 - DNA, 21 bp, Artificial sequence
  SiRNA target sequence
aattactacttgtaatttggg

SEQ ID NO: 38741 - DNA, 21 bp, Artificial sequence
  SiRNA target sequence
attactacttgtaatttggga

SEQ ID NO: 38742 - DNA, 21 bp, Artificial sequence
  SiRNA target sequence
ttactacttgtaatttgggaa

SEQ ID NO: 38743 - DNA, 21 bp, Artificial sequence
  SiRNA target sequence
tactacttgtaatttgggaat

SEQ ID NO: 38744 - DNA, 21 bp, Artificial sequence
  SiRNA target sequence
actacttgtaatttgggaatc

SEQ ID NO: 38745 - DNA, 21 bp, Artificial sequence
  SiRNA target sequence
ctacttgtaatttgggaatcg

SEQ ID NO: 38746 - DNA, 21 bp, Artificial sequence
  SiRNA target sequence
tacttgtaatttgggaatcgc

SEQ ID NO: 38747 - DNA, 21 bp, Artificial sequence
  SiRNA target sequence
acttgtaatttgggaatcgca

SEQ ID NO: 38748 - DNA, 21 bp, Artificial sequence
  SiRNA target sequence
cttgtaatttgggaatcgcaa

SEQ ID NO: 38749 - DNA, 21 bp, Artificial sequence
  SiRNA target sequence
ttgtaatttgggaatcgcaac

SEQ ID NO: 38750 - DNA, 21 bp, Artificial sequence
  SiRNA target sequence
tgtaatttgggaatcgcaaca

SEQ ID NO: 38751 - DNA, 21 bp, Artificial sequence
  SiRNA target sequence
gtaatttgggaatcgcaacac

SEQ ID NO: 38752 - DNA, 21 bp, Artificial sequence
  SiRNA target sequence
taatttgggaatcgcaacaca

SEQ ID NO: 38753 - DNA, 21 bp, Artificial sequence
  SiRNA target sequence
aatttgggaatcgcaacacaa

SEQ ID NO: 38754 - DNA, 21 bp, Artificial sequence
  SiRNA target sequence
atttgggaatcgcaacacaac

SEQ ID NO: 38755 - DNA, 21 bp, Artificial sequence
  SiRNA target sequence
tttgggaatcgcaacacaaca

SEQ ID NO: 38756 - DNA, 21 bp, Artificial sequence
  SiRNA target sequence
ttgggaatcgcaacacaacat

SEQ ID NO: 38757 - DNA, 21 bp, Artificial sequence
  SiRNA target sequence
tgggaatcgcaacacaacatg

SEQ ID NO: 38758 - DNA, 21 bp, Artificial sequence
  SiRNA target sequence
gggaatcgcaacacaacatgg

SEQ ID NO: 38759 - DNA, 21 bp, Artificial sequence
  SiRNA target sequence
ggaatcgcaacacaacatggt

SEQ ID NO: 38760 - DNA, 21 bp, Artificial sequence
  SiRNA target sequence
gaatcgcaacacaacatggtt

SEQ ID NO: 38761 - DNA, 21 bp, Artificial sequence
  SiRNA target sequence
aatcgcaacacaacatggtta

SEQ ID NO: 38762 - DNA, 21 bp, Artificial sequence
  SiRNA target sequence
atcgcaacacaacatggttac

SEQ ID NO: 38763 - DNA, 21 bp, Artificial sequence
  SiRNA target sequence
tcgcaacacaacatggttacc

SEQ ID NO: 38764 - DNA, 21 bp, Artificial sequence
  SiRNA target sequence
cgcaacacaacatggttaccc

SEQ ID NO: 38765 - DNA, 21 bp, Artificial sequence
  SiRNA target sequence
gcaacacaacatggttaccca

SEQ ID NO: 38766 - DNA, 21 bp, Artificial sequence
  SiRNA target sequence
caacacaacatggttacccat

SEQ ID NO: 38767 - DNA, 21 bp, Artificial sequence
  SiRNA target sequence
aacacaacatggttacccata

SEQ ID NO: 38768 - DNA, 21 bp, Artificial sequence
  SiRNA target sequence
acacaacatggttacccatag

SEQ ID NO: 38769 - DNA, 21 bp, Artificial sequence
  SiRNA target sequence
cacaacatggttacccataga

SEQ ID NO: 38770 - DNA, 21 bp, Artificial sequence
  SiRNA target sequence
acaacatggttacccatagat

SEQ ID NO: 38771 - DNA, 21 bp, Artificial sequence
  SiRNA target sequence
caacatggttacccatagatt

SEQ ID NO: 38772 - DNA, 21 bp, Artificial sequence
  SiRNA target sequence
aacatggttacccatagattg

SEQ ID NO: 38773 - DNA, 21 bp, Artificial sequence
  SiRNA target sequence
acatggttacccatagattga

SEQ ID NO: 38774 - DNA, 21 bp, Artificial sequence
  SiRNA target sequence
catggttacccatagattgag

SEQ ID NO: 38775 - DNA, 21 bp, Artificial sequence
  SiRNA target sequence
atggttacccatagattgagg

SEQ ID NO: 38776 - DNA, 21 bp, Artificial sequence
  SiRNA target sequence
tggttacccatagattgagga

SEQ ID NO: 38777 - DNA, 21 bp, Artificial sequence
  SiRNA target sequence
ggttacccatagattgaggaa

SEQ ID NO: 38778 - DNA, 21 bp, Artificial sequence
  SiRNA target sequence
gttacccatagattgaggaaa

SEQ ID NO: 38779 - DNA, 21 bp, Artificial sequence
  SiRNA target sequence
ttacccatagattgaggaaat

SEQ ID NO: 38780 - DNA, 21 bp, Artificial sequence
  SiRNA target sequence
tacccatagattgaggaaatt

SEQ ID NO: 38781 - DNA, 21 bp, Artificial sequence
  SiRNA target sequence
acccatagattgaggaaattt

SEQ ID NO: 38782 - DNA, 21 bp, Artificial sequence
  SiRNA target sequence
cccatagattgaggaaatttc

SEQ ID NO: 38783 - DNA, 21 bp, Artificial sequence
  SiRNA target sequence
ccatagattgaggaaatttcc

SEQ ID NO: 38784 - DNA, 21 bp, Artificial sequence
  SiRNA target sequence
catagattgaggaaatttcca

SEQ ID NO: 38785 - DNA, 21 bp, Artificial sequence
  SiRNA target sequence
atagattgaggaaatttccaa

SEQ ID NO: 38786 - DNA, 21 bp, Artificial sequence
  SiRNA target sequence
tagattgaggaaatttccaat

SEQ ID NO: 38787 - DNA, 21 bp, Artificial sequence
  SiRNA target sequence
agattgaggaaatttccaata

SEQ ID NO: 38788 - DNA, 21 bp, Artificial sequence
  SiRNA target sequence
gattgaggaaatttccaataa

SEQ ID NO: 38789 - DNA, 21 bp, Artificial sequence
  SiRNA target sequence
attgaggaaatttccaataaa

SEQ ID NO: 38790 - DNA, 21 bp, Artificial sequence
  SiRNA target sequence
ttgaggaaatttccaataaac

SEQ ID NO: 38791 - DNA, 21 bp, Artificial sequence
  SiRNA target sequence
tgaggaaatttccaataaact

SEQ ID NO: 38792 - DNA, 21 bp, Artificial sequence
  SiRNA target sequence
gaggaaatttccaataaactc

SEQ ID NO: 38793 - DNA, 21 bp, Artificial sequence
  SiRNA target sequence
aggaaatttccaataaactca

SEQ ID NO: 38794 - DNA, 21 bp, Artificial sequence
  SiRNA target sequence
ggaaatttccaataaactcag

SEQ ID NO: 38795 - DNA, 21 bp, Artificial sequence
  SiRNA target sequence
gaaatttccaataaactcagt

SEQ ID NO: 38796 - DNA, 21 bp, Artificial sequence
  SiRNA target sequence
aaatttccaataaactcagta

SEQ ID NO: 38797 - DNA, 21 bp, Artificial sequence
  SiRNA target sequence
aatttccaataaactcagtat

SEQ ID NO: 38798 - DNA, 21 bp, Artificial sequence
  SiRNA target sequence
atttccaataaactcagtatt

SEQ ID NO: 38799 - DNA, 21 bp, Artificial sequence
  SiRNA target sequence
tttccaataaactcagtatta

SEQ ID NO: 38800 - DNA, 21 bp, Artificial sequence
  SiRNA target sequence
ttccaataaactcagtattaa

SEQ ID NO: 38801 - DNA, 21 bp, Artificial sequence
  SiRNA target sequence
tccaataaactcagtattaag

SEQ ID NO: 38802 - DNA, 21 bp, Artificial sequence
  SiRNA target sequence
ccaataaactcagtattaagg

SEQ ID NO: 38803 - DNA, 21 bp, Artificial sequence
  SiRNA target sequence
caataaactcagtattaaggc

SEQ ID NO: 38804 - DNA, 21 bp, Artificial sequence
  SiRNA target sequence
aataaactcagtattaaggct

SEQ ID NO: 38805 - DNA, 21 bp, Artificial sequence
  SiRNA target sequence
ataaactcagtattaaggctt

SEQ ID NO: 38806 - DNA, 21 bp, Artificial sequence
  SiRNA target sequence
taaactcagtattaaggcttg

SEQ ID NO: 38807 - DNA, 21 bp, Artificial sequence
  SiRNA target sequence
aaactcagtattaaggcttgt

SEQ ID NO: 38808 - DNA, 21 bp, Artificial sequence
  SiRNA target sequence
aactcagtattaaggcttgtt

SEQ ID NO: 38809 - DNA, 21 bp, Artificial sequence
  SiRNA target sequence
actcagtattaaggcttgttg

SEQ ID NO: 38810 - DNA, 21 bp, Artificial sequence
  SiRNA target sequence
ctcagtattaaggcttgttgt

SEQ ID NO: 38811 - DNA, 21 bp, Artificial sequence
  SiRNA target sequence
tcagtattaaggcttgttgtg

SEQ ID NO: 38812 - DNA, 21 bp, Artificial sequence
  SiRNA target sequence
cagtattaaggcttgttgtgt

SEQ ID NO: 38813 - DNA, 21 bp, Artificial sequence
  SiRNA target sequence
agtattaaggcttgttgtgtt

SEQ ID NO: 38814 - DNA, 21 bp, Artificial sequence
  SiRNA target sequence
gtattaaggcttgttgtgttg

SEQ ID NO: 38815 - DNA, 21 bp, Artificial sequence
  SiRNA target sequence
tattaaggcttgttgtgttgg

SEQ ID NO: 38816 - DNA, 21 bp, Artificial sequence
  SiRNA target sequence
attaaggcttgttgtgttgga

SEQ ID NO: 38817 - DNA, 21 bp, Artificial sequence
  SiRNA target sequence
ttaaggcttgttgtgttggac

SEQ ID NO: 38818 - DNA, 21 bp, Artificial sequence
  SiRNA target sequence
taaggcttgttgtgttggaca

SEQ ID NO: 38819 - DNA, 21 bp, Artificial sequence
  SiRNA target sequence
aaggcttgttgtgttggacaa

SEQ ID NO: 38820 - DNA, 21 bp, Artificial sequence
  SiRNA target sequence
aggcttgttgtgttggacaag

SEQ ID NO: 38821 - DNA, 21 bp, Artificial sequence
  SiRNA target sequence
ggcttgttgtgttggacaagg

SEQ ID NO: 38822 - DNA, 21 bp, Artificial sequence
  SiRNA target sequence
gcttgttgtgttggacaaggt

SEQ ID NO: 38823 - DNA, 21 bp, Artificial sequence
  SiRNA target sequence
cttgttgtgttggacaaggtg

SEQ ID NO: 38824 - DNA, 21 bp, Artificial sequence
  SiRNA target sequence
ttgttgtgttggacaaggtgc

SEQ ID NO: 38825 - DNA, 21 bp, Artificial sequence
  SiRNA target sequence
tgttgtgttggacaaggtgcc

SEQ ID NO: 38826 - DNA, 21 bp, Artificial sequence
  SiRNA target sequence
gttgtgttggacaaggtgccc

SEQ ID NO: 38827 - DNA, 21 bp, Artificial sequence
  SiRNA target sequence
ttgtgttggacaaggtgccct

SEQ ID NO: 38828 - DNA, 21 bp, Artificial sequence
  SiRNA target sequence
tgtgttggacaaggtgcccta

SEQ ID NO: 38829 - DNA, 21 bp, Artificial sequence
  SiRNA target sequence
gtgttggacaaggtgccctat

SEQ ID NO: 38830 - DNA, 21 bp, Artificial sequence
  SiRNA target sequence
tgttggacaaggtgccctatt

SEQ ID NO: 38831 - DNA, 21 bp, Artificial sequence
  SiRNA target sequence
gttggacaaggtgccctattt

SEQ ID NO: 38832 - DNA, 21 bp, Artificial sequence
  SiRNA target sequence
ttggacaaggtgccctattta

SEQ ID NO: 38833 - DNA, 21 bp, Artificial sequence
  SiRNA target sequence
tggacaaggtgccctatttag

SEQ ID NO: 38834 - DNA, 21 bp, Artificial sequence
  SiRNA target sequence
ggacaaggtgccctatttagg

SEQ ID NO: 38835 - DNA, 21 bp, Artificial sequence
  SiRNA target sequence
gacaaggtgccctatttaggg

SEQ ID NO: 38836 - DNA, 21 bp, Artificial sequence
  SiRNA target sequence
acaaggtgccctatttagggt

SEQ ID NO: 38837 - DNA, 21 bp, Artificial sequence
  SiRNA target sequence
caaggtgccctatttagggtg

SEQ ID NO: 38838 - DNA, 21 bp, Artificial sequence
  SiRNA target sequence
aaggtgccctatttagggtga

SEQ ID NO: 38839 - DNA, 21 bp, Artificial sequence
  SiRNA target sequence
aggtgccctatttagggtgag

SEQ ID NO: 38840 - DNA, 21 bp, Artificial sequence
  SiRNA target sequence
ggtgccctatttagggtgagg

SEQ ID NO: 38841 - DNA, 21 bp, Artificial sequence
  SiRNA target sequence
gtgccctatttagggtgagga

SEQ ID NO: 38842 - DNA, 21 bp, Artificial sequence
  SiRNA target sequence
tgccctatttagggtgaggag

SEQ ID NO: 38843 - DNA, 21 bp, Artificial sequence
  SiRNA target sequence
gccctatttagggtgaggagc

SEQ ID NO: 38844 - DNA, 21 bp, Artificial sequence
  SiRNA target sequence
ccctatttagggtgaggagcc

SEQ ID NO: 38845 - DNA, 21 bp, Artificial sequence
  SiRNA target sequence
cctatttagggtgaggagcct

SEQ ID NO: 38846 - DNA, 21 bp, Artificial sequence
  SiRNA target sequence
ctatttagggtgaggagcctt

SEQ ID NO: 38847 - DNA, 21 bp, Artificial sequence
  SiRNA target sequence
tatttagggtgaggagcctta

SEQ ID NO: 38848 - DNA, 21 bp, Artificial sequence
  SiRNA target sequence
atttagggtgaggagccttac

SEQ ID NO: 38849 - DNA, 21 bp, Artificial sequence
  SiRNA target sequence
tttagggtgaggagccttact

SEQ ID NO: 38850 - DNA, 21 bp, Artificial sequence
  SiRNA target sequence
ttagggtgaggagccttactg

SEQ ID NO: 38851 - DNA, 21 bp, Artificial sequence
  SiRNA target sequence
tagggtgaggagccttactgg

SEQ ID NO: 38852 - DNA, 21 bp, Artificial sequence
  SiRNA target sequence
agggtgaggagccttactggc

SEQ ID NO: 38853 - DNA, 21 bp, Artificial sequence
  SiRNA target sequence
gggtgaggagccttactggca

SEQ ID NO: 38854 - DNA, 21 bp, Artificial sequence
  SiRNA target sequence
ggtgaggagccttactggcag

SEQ ID NO: 38855 - DNA, 21 bp, Artificial sequence
  SiRNA target sequence
gtgaggagccttactggcagc

SEQ ID NO: 38856 - DNA, 21 bp, Artificial sequence
  SiRNA target sequence
tgaggagccttactggcagcc

SEQ ID NO: 38857 - DNA, 21 bp, Artificial sequence
  SiRNA target sequence
gaggagccttactggcagccc

SEQ ID NO: 38858 - DNA, 21 bp, Artificial sequence
  SiRNA target sequence
aggagccttactggcagcccc

SEQ ID NO: 38859 - DNA, 21 bp, Artificial sequence
  SiRNA target sequence
ggagccttactggcagcccca

SEQ ID NO: 38860 - DNA, 21 bp, Artificial sequence
  SiRNA target sequence
gagccttactggcagccccag

SEQ ID NO: 38861 - DNA, 21 bp, Artificial sequence
  SiRNA target sequence
agccttactggcagccccagt

SEQ ID NO: 38862 - DNA, 21 bp, Artificial sequence
  SiRNA target sequence
gccttactggcagccccagtg

SEQ ID NO: 38863 - DNA, 21 bp, Artificial sequence
  SiRNA target sequence
ccttactggcagccccagtga

SEQ ID NO: 38864 - DNA, 21 bp, Artificial sequence
  SiRNA target sequence
cttactggcagccccagtgaa

SEQ ID NO: 38865 - DNA, 21 bp, Artificial sequence
  SiRNA target sequence
ttactggcagccccagtgaat

SEQ ID NO: 38866 - DNA, 21 bp, Artificial sequence
  SiRNA target sequence
tactggcagccccagtgaatc

SEQ ID NO: 38867 - DNA, 21 bp, Artificial sequence
  SiRNA target sequence
actggcagccccagtgaatcc

SEQ ID NO: 38868 - DNA, 21 bp, Artificial sequence
  SiRNA target sequence
ctggcagccccagtgaatcct

SEQ ID NO: 38869 - DNA, 21 bp, Artificial sequence
  SiRNA target sequence
tggcagccccagtgaatcctc

SEQ ID NO: 38870 - DNA, 21 bp, Artificial sequence
  SiRNA target sequence
ggcagccccagtgaatcctcc

SEQ ID NO: 38871 - DNA, 21 bp, Artificial sequence
  SiRNA target sequence
gcagccccagtgaatcctcca

SEQ ID NO: 38872 - DNA, 21 bp, Artificial sequence
  SiRNA target sequence
cagccccagtgaatcctccat

SEQ ID NO: 38873 - DNA, 21 bp, Artificial sequence
  SiRNA target sequence
agccccagtgaatcctccatt

SEQ ID NO: 38874 - DNA, 21 bp, Artificial sequence
  SiRNA target sequence
gccccagtgaatcctccattg

SEQ ID NO: 38875 - DNA, 21 bp, Artificial sequence
  SiRNA target sequence
ccccagtgaatcctccattgg

SEQ ID NO: 38876 - DNA, 21 bp, Artificial sequence
  SiRNA target sequence
cccagtgaatcctccattgga

SEQ ID NO: 38877 - DNA, 21 bp, Artificial sequence
  SiRNA target sequence
ccagtgaatcctccattggat

SEQ ID NO: 38878 - DNA, 21 bp, Artificial sequence
  SiRNA target sequence
cagtgaatcctccattggata

SEQ ID NO: 38879 - DNA, 21 bp, Artificial sequence
  SiRNA target sequence
agtgaatcctccattggatag

SEQ ID NO: 38880 - DNA, 21 bp, Artificial sequence
  SiRNA target sequence
gtgaatcctccattggatagg

SEQ ID NO: 38881 - DNA, 21 bp, Artificial sequence
  SiRNA target sequence
tgaatcctccattggatagga

SEQ ID NO: 38882 - DNA, 21 bp, Artificial sequence
  SiRNA target sequence
gaatcctccattggataggaa

SEQ ID NO: 38883 - DNA, 21 bp, Artificial sequence
  SiRNA target sequence
aatcctccattggataggaac

SEQ ID NO: 38884 - DNA, 21 bp, Artificial sequence
  SiRNA target sequence
atcctccattggataggaaca

SEQ ID NO: 38885 - DNA, 21 bp, Artificial sequence
  SiRNA target sequence
tcctccattggataggaacag

SEQ ID NO: 38886 - DNA, 21 bp, Artificial sequence
  SiRNA target sequence
cctccattggataggaacagc

SEQ ID NO: 38887 - DNA, 21 bp, Artificial sequence
  SiRNA target sequence
ctccattggataggaacagct

SEQ ID NO: 38888 - DNA, 21 bp, Artificial sequence
  SiRNA target sequence
tccattggataggaacagcta

SEQ ID NO: 38889 - DNA, 21 bp, Artificial sequence
  SiRNA target sequence
ccattggataggaacagctat

SEQ ID NO: 38890 - DNA, 21 bp, Artificial sequence
  SiRNA target sequence
cattggataggaacagctata

SEQ ID NO: 38891 - DNA, 21 bp, Artificial sequence
  SiRNA target sequence
attggataggaacagctatat

SEQ ID NO: 38892 - DNA, 21 bp, Artificial sequence
  SiRNA target sequence
ttggataggaacagctatatt

SEQ ID NO: 38893 - DNA, 21 bp, Artificial sequence
  SiRNA target sequence
tggataggaacagctatattg

SEQ ID NO: 38894 - DNA, 21 bp, Artificial sequence
  SiRNA target sequence
ggataggaacagctatattgg

SEQ ID NO: 38895 - DNA, 21 bp, Artificial sequence
  SiRNA target sequence
gataggaacagctatattggg

SEQ ID NO: 38896 - DNA, 21 bp, Artificial sequence
  SiRNA target sequence
ataggaacagctatattgggt

SEQ ID NO: 38897 - DNA, 21 bp, Artificial sequence
  SiRNA target sequence
taggaacagctatattgggta

SEQ ID NO: 38898 - DNA, 21 bp, Artificial sequence
  SiRNA target sequence
aggaacagctatattgggtag

SEQ ID NO: 38899 - DNA, 21 bp, Artificial sequence
  SiRNA target sequence
ggaacagctatattgggtagt

SEQ ID NO: 38900 - DNA, 21 bp, Artificial sequence
  SiRNA target sequence
gaacagctatattgggtagtt

SEQ ID NO: 38901 - DNA, 21 bp, Artificial sequence
  SiRNA target sequence
aacagctatattgggtagttg

SEQ ID NO: 38902 - DNA, 21 bp, Artificial sequence
  SiRNA target sequence
acagctatattgggtagttgt

SEQ ID NO: 38903 - DNA, 21 bp, Artificial sequence
  SiRNA target sequence
cagctatattgggtagttgta

SEQ ID NO: 38904 - DNA, 21 bp, Artificial sequence
  SiRNA target sequence
agctatattgggtagttgtag

SEQ ID NO: 38905 - DNA, 21 bp, Artificial sequence
  SiRNA target sequence
gctatattgggtagttgtagc

SEQ ID NO: 38906 - DNA, 21 bp, Artificial sequence
  SiRNA target sequence
ctatattgggtagttgtagca

SEQ ID NO: 38907 - DNA, 21 bp, Artificial sequence
  SiRNA target sequence
tatattgggtagttgtagcag

SEQ ID NO: 38908 - DNA, 21 bp, Artificial sequence
  SiRNA target sequence
atattgggtagttgtagcagt

SEQ ID NO: 38909 - DNA, 21 bp, Artificial sequence
  SiRNA target sequence
tattgggtagttgtagcagtt

SEQ ID NO: 38910 - DNA, 21 bp, Artificial sequence
  SiRNA target sequence
attgggtagttgtagcagttg

SEQ ID NO: 38911 - DNA, 21 bp, Artificial sequence
  SiRNA target sequence
ttgggtagttgtagcagttgt

SEQ ID NO: 38912 - DNA, 21 bp, Artificial sequence
  SiRNA target sequence
tgggtagttgtagcagttgta

SEQ ID NO: 38913 - DNA, 21 bp, Artificial sequence
  SiRNA target sequence
gggtagttgtagcagttgtat

SEQ ID NO: 38914 - DNA, 21 bp, Artificial sequence
  SiRNA target sequence
ggtagttgtagcagttgtatt

SEQ ID NO: 38915 - DNA, 21 bp, Artificial sequence
  SiRNA target sequence
gtagttgtagcagttgtattc

SEQ ID NO: 38916 - DNA, 21 bp, Artificial sequence
  SiRNA target sequence
tagttgtagcagttgtattca

SEQ ID NO: 38917 - DNA, 21 bp, Artificial sequence
  SiRNA target sequence
agttgtagcagttgtattcaa

SEQ ID NO: 38918 - DNA, 21 bp, Artificial sequence
  SiRNA target sequence
gttgtagcagttgtattcaaa

SEQ ID NO: 38919 - DNA, 21 bp, Artificial sequence
  SiRNA target sequence
ttgtagcagttgtattcaaat

SEQ ID NO: 38920 - DNA, 21 bp, Artificial sequence
  SiRNA target sequence
tgtagcagttgtattcaaatg

SEQ ID NO: 38921 - DNA, 21 bp, Artificial sequence
  SiRNA target sequence
gtagcagttgtattcaaatga

SEQ ID NO: 38922 - DNA, 21 bp, Artificial sequence
  SiRNA target sequence
tagcagttgtattcaaatgaa

SEQ ID NO: 38923 - DNA, 21 bp, Artificial sequence
  SiRNA target sequence
agcagttgtattcaaatgaat

SEQ ID NO: 38924 - DNA, 21 bp, Artificial sequence
  SiRNA target sequence
gcagttgtattcaaatgaatg

SEQ ID NO: 38925 - DNA, 21 bp, Artificial sequence
  SiRNA target sequence
cagttgtattcaaatgaatgc

SEQ ID NO: 38926 - DNA, 21 bp, Artificial sequence
  SiRNA target sequence
agttgtattcaaatgaatgca

SEQ ID NO: 38927 - DNA, 21 bp, Artificial sequence
  SiRNA target sequence
gttgtattcaaatgaatgcag

SEQ ID NO: 38928 - DNA, 21 bp, Artificial sequence
  SiRNA target sequence
ttgtattcaaatgaatgcagc

SEQ ID NO: 38929 - DNA, 21 bp, Artificial sequence
  SiRNA target sequence
tgtattcaaatgaatgcagcg

SEQ ID NO: 38930 - DNA, 21 bp, Artificial sequence
  SiRNA target sequence
gtattcaaatgaatgcagcgt

SEQ ID NO: 38931 - DNA, 21 bp, Artificial sequence
  SiRNA target sequence
tattcaaatgaatgcagcgtt

SEQ ID NO: 38932 - DNA, 21 bp, Artificial sequence
  SiRNA target sequence
attcaaatgaatgcagcgttc

SEQ ID NO: 38933 - DNA, 21 bp, Artificial sequence
  SiRNA target sequence
ttcaaatgaatgcagcgttcc

SEQ ID NO: 38934 - DNA, 21 bp, Artificial sequence
  SiRNA target sequence
tcaaatgaatgcagcgttccg

SEQ ID NO: 38935 - DNA, 21 bp, Artificial sequence
  SiRNA target sequence
caaatgaatgcagcgttccga

SEQ ID NO: 38936 - DNA, 21 bp, Artificial sequence
  SiRNA target sequence
aaatgaatgcagcgttccgaa

SEQ ID NO: 38937 - DNA, 21 bp, Artificial sequence
  SiRNA target sequence
aatgaatgcagcgttccgaaa

SEQ ID NO: 38938 - DNA, 21 bp, Artificial sequence
  SiRNA target sequence
atgaatgcagcgttccgaaat

SEQ ID NO: 38939 - DNA, 21 bp, Artificial sequence
  SiRNA target sequence
tgaatgcagcgttccgaaata

SEQ ID NO: 38940 - DNA, 21 bp, Artificial sequence
  SiRNA target sequence
gaatgcagcgttccgaaatat

SEQ ID NO: 38941 - DNA, 21 bp, Artificial sequence
  SiRNA target sequence
aatgcagcgttccgaaatatc

SEQ ID NO: 38942 - DNA, 21 bp, Artificial sequence
  SiRNA target sequence
atgcagcgttccgaaatatca

SEQ ID NO: 38943 - DNA, 21 bp, Artificial sequence
  SiRNA target sequence
tgcagcgttccgaaatatcat

SEQ ID NO: 38944 - DNA, 21 bp, Artificial sequence
  SiRNA target sequence
gcagcgttccgaaatatcata

SEQ ID NO: 38945 - DNA, 21 bp, Artificial sequence
  SiRNA target sequence
cagcgttccgaaatatcatac

SEQ ID NO: 38946 - DNA, 21 bp, Artificial sequence
  SiRNA target sequence
agcgttccgaaatatcatacc

SEQ ID NO: 38947 - DNA, 21 bp, Artificial sequence
  SiRNA target sequence
gcgttccgaaatatcatacct

SEQ ID NO: 38948 - DNA, 21 bp, Artificial sequence
  SiRNA target sequence
cgttccgaaatatcatacctg

SEQ ID NO: 38949 - DNA, 21 bp, Artificial sequence
  SiRNA target sequence
gttccgaaatatcatacctgc

SEQ ID NO: 38950 - DNA, 21 bp, Artificial sequence
  SiRNA target sequence
ttccgaaatatcatacctgcc

SEQ ID NO: 38951 - DNA, 21 bp, Artificial sequence
  SiRNA target sequence
tccgaaatatcatacctgccg

SEQ ID NO: 38952 - DNA, 21 bp, Artificial sequence
  SiRNA target sequence
ccgaaatatcatacctgccga

SEQ ID NO: 38953 - DNA, 21 bp, Artificial sequence
  SiRNA target sequence
cgaaatatcatacctgccgat

SEQ ID NO: 38954 - DNA, 21 bp, Artificial sequence
  SiRNA target sequence
gaaatatcatacctgccgatc

SEQ ID NO: 38955 - DNA, 21 bp, Artificial sequence
  SiRNA target sequence
aaatatcatacctgccgatca

SEQ ID NO: 38956 - DNA, 21 bp, Artificial sequence
  SiRNA target sequence
aatatcatacctgccgatcaa

SEQ ID NO: 38957 - DNA, 21 bp, Artificial sequence
  SiRNA target sequence
atatcatacctgccgatcaag

SEQ ID NO: 38958 - DNA, 21 bp, Artificial sequence
  SiRNA target sequence
tatcatacctgccgatcaaga

SEQ ID NO: 38959 - DNA, 21 bp, Artificial sequence
  SiRNA target sequence
atcatacctgccgatcaagaa

SEQ ID NO: 38960 - DNA, 21 bp, Artificial sequence
  SiRNA target sequence
tcatacctgccgatcaagaaa

SEQ ID NO: 38961 - DNA, 21 bp, Artificial sequence
  SiRNA target sequence
catacctgccgatcaagaaac

SEQ ID NO: 38962 - DNA, 21 bp, Artificial sequence
  SiRNA target sequence
atacctgccgatcaagaaaca

SEQ ID NO: 38963 - DNA, 21 bp, Artificial sequence
  SiRNA target sequence
tacctgccgatcaagaaacaa

SEQ ID NO: 38964 - DNA, 21 bp, Artificial sequence
  SiRNA target sequence
acctgccgatcaagaaacaaa

SEQ ID NO: 38965 - DNA, 21 bp, Artificial sequence
  SiRNA target sequence
cctgccgatcaagaaacaaat

SEQ ID NO: 38966 - DNA, 21 bp, Artificial sequence
  SiRNA target sequence
ctgccgatcaagaaacaaata

SEQ ID NO: 38967 - DNA, 21 bp, Artificial sequence
  SiRNA target sequence
tgccgatcaagaaacaaatac

SEQ ID NO: 38968 - DNA, 21 bp, Artificial sequence
  SiRNA target sequence
gccgatcaagaaacaaatact

SEQ ID NO: 38969 - DNA, 21 bp, Artificial sequence
  SiRNA target sequence
ccgatcaagaaacaaatactt

SEQ ID NO: 38970 - DNA, 21 bp, Artificial sequence
  SiRNA target sequence
cgatcaagaaacaaatacttc

SEQ ID NO: 38971 - DNA, 21 bp, Artificial sequence
  SiRNA target sequence
gatcaagaaacaaatacttcc

SEQ ID NO: 38972 - DNA, 21 bp, Artificial sequence
  SiRNA target sequence
atcaagaaacaaatacttcca

SEQ ID NO: 38973 - DNA, 21 bp, Artificial sequence
  SiRNA target sequence
tcaagaaacaaatacttccaa

SEQ ID NO: 38974 - DNA, 21 bp, Artificial sequence
  SiRNA target sequence
caagaaacaaatacttccaac

SEQ ID NO: 38975 - DNA, 21 bp, Artificial sequence
  SiRNA target sequence
aagaaacaaatacttccaacg

SEQ ID NO: 38976 - DNA, 21 bp, Artificial sequence
  SiRNA target sequence
agaaacaaatacttccaacgt

SEQ ID NO: 38977 - DNA, 21 bp, Artificial sequence
  SiRNA target sequence
gaaacaaatacttccaacgta

SEQ ID NO: 38978 - DNA, 21 bp, Artificial sequence
  SiRNA target sequence
aaacaaatacttccaacgtac

SEQ ID NO: 38979 - DNA, 21 bp, Artificial sequence
  SiRNA target sequence
aacaaatacttccaacgtaca

SEQ ID NO: 38980 - DNA, 21 bp, Artificial sequence
  SiRNA target sequence
acaaatacttccaacgtacat

SEQ ID NO: 38981 - DNA, 21 bp, Artificial sequence
  SiRNA target sequence
caaatacttccaacgtacata

SEQ ID NO: 38982 - DNA, 21 bp, Artificial sequence
  SiRNA target sequence
aaatacttccaacgtacataa

SEQ ID NO: 38983 - DNA, 21 bp, Artificial sequence
  SiRNA target sequence
aatacttccaacgtacataat

SEQ ID NO: 38984 - DNA, 21 bp, Artificial sequence
  SiRNA target sequence
atacttccaacgtacataata

SEQ ID NO: 38985 - DNA, 21 bp, Artificial sequence
  SiRNA target sequence
tacttccaacgtacataatac

SEQ ID NO: 38986 - DNA, 21 bp, Artificial sequence
  SiRNA target sequence
acttccaacgtacataatacg

SEQ ID NO: 38987 - DNA, 21 bp, Artificial sequence
  SiRNA target sequence
cttccaacgtacataatacgc

SEQ ID NO: 38988 - DNA, 21 bp, Artificial sequence
  SiRNA target sequence
ttccaacgtacataatacgca

SEQ ID NO: 38989 - DNA, 21 bp, Artificial sequence
  SiRNA target sequence
tccaacgtacataatacgcaa

SEQ ID NO: 38990 - DNA, 21 bp, Artificial sequence
  SiRNA target sequence
ccaacgtacataatacgcaac

SEQ ID NO: 38991 - DNA, 21 bp, Artificial sequence
  SiRNA target sequence
caacgtacataatacgcaact

SEQ ID NO: 38992 - DNA, 21 bp, Artificial sequence
  SiRNA target sequence
aacgtacataatacgcaactc

SEQ ID NO: 38993 - DNA, 21 bp, Artificial sequence
  SiRNA target sequence
acgtacataatacgcaactcg

SEQ ID NO: 38994 - DNA, 21 bp, Artificial sequence
  SiRNA target sequence
cgtacataatacgcaactcgc

SEQ ID NO: 38995 - DNA, 21 bp, Artificial sequence
  SiRNA target sequence
gtacataatacgcaactcgcg

SEQ ID NO: 38996 - DNA, 21 bp, Artificial sequence
  SiRNA target sequence
tacataatacgcaactcgcgt

SEQ ID NO: 38997 - DNA, 21 bp, Artificial sequence
  SiRNA target sequence
acataatacgcaactcgcgtc

SEQ ID NO: 38998 - DNA, 21 bp, Artificial sequence
  SiRNA target sequence
cataatacgcaactcgcgtcg

SEQ ID NO: 38999 - DNA, 21 bp, Artificial sequence
  SiRNA target sequence
ataatacgcaactcgcgtcga

SEQ ID NO: 39000 - DNA, 21 bp, Artificial sequence
  SiRNA target sequence
taatacgcaactcgcgtcgac

SEQ ID NO: 39001 - DNA, 21 bp, Artificial sequence
  SiRNA target sequence
aatacgcaactcgcgtcgacc

SEQ ID NO: 39002 - DNA, 21 bp, Artificial sequence
  SiRNA target sequence
atacgcaactcgcgtcgacct

SEQ ID NO: 39003 - DNA, 21 bp, Artificial sequence
  SiRNA target sequence
tacgcaactcgcgtcgacctc

SEQ ID NO: 39004 - DNA, 21 bp, Artificial sequence
  SiRNA target sequence
acgcaactcgcgtcgacctct

SEQ ID NO: 39005 - DNA, 21 bp, Artificial sequence
  SiRNA target sequence
cgcaactcgcgtcgacctctg

SEQ ID NO: 39006 - DNA, 21 bp, Artificial sequence
  SiRNA target sequence
gcaactcgcgtcgacctctga

SEQ ID NO: 39007 - DNA, 21 bp, Artificial sequence
  SiRNA target sequence
caactcgcgtcgacctctgaa

SEQ ID NO: 39008 - DNA, 21 bp, Artificial sequence
  SiRNA target sequence
aactcgcgtcgacctctgaag

SEQ ID NO: 39009 - DNA, 21 bp, Artificial sequence
  SiRNA target sequence
actcgcgtcgacctctgaaga

SEQ ID NO: 39010 - DNA, 21 bp, Artificial sequence
  SiRNA target sequence
ctcgcgtcgacctctgaagaa

SEQ ID NO: 39011 - DNA, 21 bp, Artificial sequence
  SiRNA target sequence
tcgcgtcgacctctgaagaaa

SEQ ID NO: 39012 - DNA, 21 bp, Artificial sequence
  SiRNA target sequence
cgcgtcgacctctgaagaaaa

SEQ ID NO: 39013 - DNA, 21 bp, Artificial sequence
  SiRNA target sequence
gcgtcgacctctgaagaaaac

SEQ ID NO: 39014 - DNA, 21 bp, Artificial sequence
  SiRNA target sequence
cgtcgacctctgaagaaaact

SEQ ID NO: 39015 - DNA, 21 bp, Artificial sequence
  SiRNA target sequence
gtcgacctctgaagaaaactc

SEQ ID NO: 39016 - DNA, 21 bp, Artificial sequence
  SiRNA target sequence
tcgacctctgaagaaaactca

SEQ ID NO: 39017 - DNA, 21 bp, Artificial sequence
  SiRNA target sequence
cgacctctgaagaaaactcag

SEQ ID NO: 39018 - DNA, 21 bp, Artificial sequence
  SiRNA target sequence
gacctctgaagaaaactcagt

SEQ ID NO: 39019 - DNA, 21 bp, Artificial sequence
  SiRNA target sequence
acctctgaagaaaactcagtt

SEQ ID NO: 39020 - DNA, 21 bp, Artificial sequence
  SiRNA target sequence
cctctgaagaaaactcagttg

SEQ ID NO: 39021 - DNA, 21 bp, Artificial sequence
  SiRNA target sequence
ctctgaagaaaactcagttga

SEQ ID NO: 39022 - DNA, 21 bp, Artificial sequence
  SiRNA target sequence
tctgaagaaaactcagttgaa

SEQ ID NO: 39023 - DNA, 21 bp, Artificial sequence
  SiRNA target sequence
ctgaagaaaactcagttgaaa

SEQ ID NO: 39024 - DNA, 21 bp, Artificial sequence
  SiRNA target sequence
tgaagaaaactcagttgaaac

SEQ ID NO: 39025 - DNA, 21 bp, Artificial sequence
  SiRNA target sequence
gaagaaaactcagttgaaacg

SEQ ID NO: 39026 - DNA, 21 bp, Artificial sequence
  SiRNA target sequence
aagaaaactcagttgaaacgg

SEQ ID NO: 39027 - DNA, 21 bp, Artificial sequence
  SiRNA target sequence
agaaaactcagttgaaacgga

SEQ ID NO: 39028 - DNA, 21 bp, Artificial sequence
  SiRNA target sequence
gaaaactcagttgaaacggaa

SEQ ID NO: 39029 - DNA, 21 bp, Artificial sequence
  SiRNA target sequence
aaaactcagttgaaacggaac

SEQ ID NO: 39030 - DNA, 21 bp, Artificial sequence
  SiRNA target sequence
aaactcagttgaaacggaaca

SEQ ID NO: 39031 - DNA, 21 bp, Artificial sequence
  SiRNA target sequence
aactcagttgaaacggaacaa

SEQ ID NO: 39032 - DNA, 21 bp, Artificial sequence
  SiRNA target sequence
actcagttgaaacggaacaaa

SEQ ID NO: 39033 - DNA, 21 bp, Artificial sequence
  SiRNA target sequence
ctcagttgaaacggaacaaat

SEQ ID NO: 39034 - DNA, 21 bp, Artificial sequence
  SiRNA target sequence
tcagttgaaacggaacaaatc

SEQ ID NO: 39035 - DNA, 21 bp, Artificial sequence
  SiRNA target sequence
cagttgaaacggaacaaatca

SEQ ID NO: 39036 - DNA, 21 bp, Artificial sequence
  SiRNA target sequence
agttgaaacggaacaaatcac

SEQ ID NO: 39037 - DNA, 21 bp, Artificial sequence
  SiRNA target sequence
gttgaaacggaacaaatcacc

SEQ ID NO: 39038 - DNA, 21 bp, Artificial sequence
  SiRNA target sequence
ttgaaacggaacaaatcacca

SEQ ID NO: 39039 - DNA, 21 bp, Artificial sequence
  SiRNA target sequence
tgaaacggaacaaatcaccac

SEQ ID NO: 39040 - DNA, 21 bp, Artificial sequence
  SiRNA target sequence
gaaacggaacaaatcaccacc

SEQ ID NO: 39041 - DNA, 21 bp, Artificial sequence
  SiRNA target sequence
aaacggaacaaatcaccacct

SEQ ID NO: 39042 - DNA, 21 bp, Artificial sequence
  SiRNA target sequence
aacggaacaaatcaccacctt

SEQ ID NO: 39043 - DNA, 21 bp, Artificial sequence
  SiRNA target sequence
acggaacaaatcaccaccttt

SEQ ID NO: 39044 - DNA, 21 bp, Artificial sequence
  SiRNA target sequence
cggaacaaatcaccacctttc

SEQ ID NO: 39045 - DNA, 21 bp, Artificial sequence
  SiRNA target sequence
ggaacaaatcaccacctttca

SEQ ID NO: 39046 - DNA, 21 bp, Artificial sequence
  SiRNA target sequence
gaacaaatcaccacctttcat

SEQ ID NO: 39047 - DNA, 21 bp, Artificial sequence
  SiRNA target sequence
aacaaatcaccacctttcatg

SEQ ID NO: 39048 - DNA, 21 bp, Artificial sequence
  SiRNA target sequence
acaaatcaccacctttcatga

SEQ ID NO: 39049 - DNA, 21 bp, Artificial sequence
  SiRNA target sequence
caaatcaccacctttcatgat

SEQ ID NO: 39050 - DNA, 21 bp, Artificial sequence
  SiRNA target sequence
aaatcaccacctttcatgatg

SEQ ID NO: 39051 - DNA, 21 bp, Artificial sequence
  SiRNA target sequence
aatcaccacctttcatgatgt

SEQ ID NO: 39052 - DNA, 21 bp, Artificial sequence
  SiRNA target sequence
atcaccacctttcatgatgtg

SEQ ID NO: 39053 - DNA, 21 bp, Artificial sequence
  SiRNA target sequence
tcaccacctttcatgatgtgg

SEQ ID NO: 39054 - DNA, 21 bp, Artificial sequence
  SiRNA target sequence
caccacctttcatgatgtgga

SEQ ID NO: 39055 - DNA, 21 bp, Artificial sequence
  SiRNA target sequence
accacctttcatgatgtggaa

SEQ ID NO: 39056 - DNA, 21 bp, Artificial sequence
  SiRNA target sequence
ccacctttcatgatgtggaaa

SEQ ID NO: 39057 - DNA, 21 bp, Artificial sequence
  SiRNA target sequence
cacctttcatgatgtggaaac

SEQ ID NO: 39058 - DNA, 21 bp, Artificial sequence
  SiRNA target sequence
acctttcatgatgtggaaact

SEQ ID NO: 39059 - DNA, 21 bp, Artificial sequence
  SiRNA target sequence
cctttcatgatgtggaaactc

SEQ ID NO: 39060 - DNA, 21 bp, Artificial sequence
  SiRNA target sequence
ctttcatgatgtggaaactcc

SEQ ID NO: 39061 - DNA, 21 bp, Artificial sequence
  SiRNA target sequence
tttcatgatgtggaaactcca

SEQ ID NO: 39062 - DNA, 21 bp, Artificial sequence
  SiRNA target sequence
ttcatgatgtggaaactccaa

SEQ ID NO: 39063 - DNA, 21 bp, Artificial sequence
  SiRNA target sequence
tcatgatgtggaaactccaaa

SEQ ID NO: 39064 - DNA, 21 bp, Artificial sequence
  SiRNA target sequence
catgatgtggaaactccaaat

SEQ ID NO: 39065 - DNA, 21 bp, Artificial sequence
  SiRNA target sequence
atgatgtggaaactccaaata

SEQ ID NO: 39066 - DNA, 21 bp, Artificial sequence
  SiRNA target sequence
tgatgtggaaactccaaatag

SEQ ID NO: 39067 - DNA, 21 bp, Artificial sequence
  SiRNA target sequence
gatgtggaaactccaaatagg

SEQ ID NO: 39068 - DNA, 21 bp, Artificial sequence
  SiRNA target sequence
atgtggaaactccaaatagga

SEQ ID NO: 39069 - DNA, 21 bp, Artificial sequence
  SiRNA target sequence
tgtggaaactccaaataggat

SEQ ID NO: 39070 - DNA, 21 bp, Artificial sequence
  SiRNA target sequence
gtggaaactccaaataggatc

SEQ ID NO: 39071 - DNA, 21 bp, Artificial sequence
  SiRNA target sequence
tggaaactccaaataggatca

SEQ ID NO: 39072 - DNA, 21 bp, Artificial sequence
  SiRNA target sequence
ggaaactccaaataggatcaa

SEQ ID NO: 39073 - DNA, 21 bp, Artificial sequence
  SiRNA target sequence
gaaactccaaataggatcaat

SEQ ID NO: 39074 - DNA, 21 bp, Artificial sequence
  SiRNA target sequence
aaactccaaataggatcaata

SEQ ID NO: 39075 - DNA, 21 bp, Artificial sequence
  SiRNA target sequence
aactccaaataggatcaatac

SEQ ID NO: 39076 - DNA, 21 bp, Artificial sequence
  SiRNA target sequence
actccaaataggatcaatacc

SEQ ID NO: 39077 - DNA, 21 bp, Artificial sequence
  SiRNA target sequence
ctccaaataggatcaataccc

SEQ ID NO: 39078 - DNA, 21 bp, Artificial sequence
  SiRNA target sequence
tccaaataggatcaatacccc

SEQ ID NO: 39079 - DNA, 21 bp, Artificial sequence
  SiRNA target sequence
ccaaataggatcaataccccc

SEQ ID NO: 39080 - DNA, 21 bp, Artificial sequence
  SiRNA target sequence
caaataggatcaataccccca

SEQ ID NO: 39081 - DNA, 21 bp, Artificial sequence
  SiRNA target sequence
aaataggatcaatacccccat

SEQ ID NO: 39082 - DNA, 21 bp, Artificial sequence
  SiRNA target sequence
aataggatcaatacccccatg

SEQ ID NO: 39083 - DNA, 21 bp, Artificial sequence
  SiRNA target sequence
ataggatcaatacccccatgg

SEQ ID NO: 39084 - DNA, 21 bp, Artificial sequence
  SiRNA target sequence
taggatcaatacccccatggc

SEQ ID NO: 39085 - DNA, 21 bp, Artificial sequence
  SiRNA target sequence
aggatcaatacccccatggct

SEQ ID NO: 39086 - DNA, 21 bp, Artificial sequence
  SiRNA target sequence
ggatcaatacccccatggctc

SEQ ID NO: 39087 - DNA, 21 bp, Artificial sequence
  SiRNA target sequence
gatcaatacccccatggctca

SEQ ID NO: 39088 - DNA, 21 bp, Artificial sequence
  SiRNA target sequence
atcaatacccccatggctcaa

SEQ ID NO: 39089 - DNA, 21 bp, Artificial sequence
  SiRNA target sequence
tcaatacccccatggctcaag

SEQ ID NO: 39090 - DNA, 21 bp, Artificial sequence
  SiRNA target sequence
caatacccccatggctcaaga

SEQ ID NO: 39091 - DNA, 21 bp, Artificial sequence
  SiRNA target sequence
aatacccccatggctcaagac

SEQ ID NO: 39092 - DNA, 21 bp, Artificial sequence
  SiRNA target sequence
atacccccatggctcaagaca

SEQ ID NO: 39093 - DNA, 21 bp, Artificial sequence
  SiRNA target sequence
tacccccatggctcaagacac

SEQ ID NO: 39094 - DNA, 21 bp, Artificial sequence
  SiRNA target sequence
acccccatggctcaagacact

SEQ ID NO: 39095 - DNA, 21 bp, Artificial sequence
  SiRNA target sequence
cccccatggctcaagacactt

SEQ ID NO: 39096 - DNA, 21 bp, Artificial sequence
  SiRNA target sequence
ccccatggctcaagacacttc

SEQ ID NO: 39097 - DNA, 21 bp, Artificial sequence
  SiRNA target sequence
cccatggctcaagacacttca

SEQ ID NO: 39098 - DNA, 21 bp, Artificial sequence
  SiRNA target sequence
ccatggctcaagacacttcat

SEQ ID NO: 39099 - DNA, 21 bp, Artificial sequence
  SiRNA target sequence
catggctcaagacacttcatc

SEQ ID NO: 39100 - DNA, 21 bp, Artificial sequence
  SiRNA target sequence
atggctcaagacacttcatcg

SEQ ID NO: 39101 - DNA, 21 bp, Artificial sequence
  SiRNA target sequence
tggctcaagacacttcatcgg

SEQ ID NO: 39102 - DNA, 21 bp, Artificial sequence
  SiRNA target sequence
ggctcaagacacttcatcggc

SEQ ID NO: 39103 - DNA, 21 bp, Artificial sequence
  SiRNA target sequence
gctcaagacacttcatcggct

SEQ ID NO: 39104 - DNA, 21 bp, Artificial sequence
  SiRNA target sequence
ctcaagacacttcatcggctc

SEQ ID NO: 39105 - DNA, 21 bp, Artificial sequence
  SiRNA target sequence
tcaagacacttcatcggctcg

SEQ ID NO: 39106 - DNA, 21 bp, Artificial sequence
  SiRNA target sequence
caagacacttcatcggctcgg

SEQ ID NO: 39107 - DNA, 21 bp, Artificial sequence
  SiRNA target sequence
aagacacttcatcggctcgga

SEQ ID NO: 39108 - DNA, 21 bp, Artificial sequence
  SiRNA target sequence
agacacttcatcggctcggag

SEQ ID NO: 39109 - DNA, 21 bp, Artificial sequence
  SiRNA target sequence
gacacttcatcggctcggagc

SEQ ID NO: 39110 - DNA, 21 bp, Artificial sequence
  SiRNA target sequence
acacttcatcggctcggagca

SEQ ID NO: 39111 - DNA, 21 bp, Artificial sequence
  SiRNA target sequence
cacttcatcggctcggagcat

SEQ ID NO: 39112 - DNA, 21 bp, Artificial sequence
  SiRNA target sequence
acttcatcggctcggagcatg

SEQ ID NO: 39113 - DNA, 21 bp, Artificial sequence
  SiRNA target sequence
cttcatcggctcggagcatgg

SEQ ID NO: 39114 - DNA, 21 bp, Artificial sequence
  SiRNA target sequence
ttcatcggctcggagcatgga

SEQ ID NO: 39115 - DNA, 21 bp, Artificial sequence
  SiRNA target sequence
tcatcggctcggagcatggat

SEQ ID NO: 39116 - DNA, 21 bp, Artificial sequence
  SiRNA target sequence
catcggctcggagcatggatg

SEQ ID NO: 39117 - DNA, 21 bp, Artificial sequence
  SiRNA target sequence
atcggctcggagcatggatga

SEQ ID NO: 39118 - DNA, 21 bp, Artificial sequence
  SiRNA target sequence
tcggctcggagcatggatgat

SEQ ID NO: 39119 - DNA, 21 bp, Artificial sequence
  SiRNA target sequence
cggctcggagcatggatgata

SEQ ID NO: 39120 - DNA, 21 bp, Artificial sequence
  SiRNA target sequence
ggctcggagcatggatgatac

SEQ ID NO: 39121 - DNA, 21 bp, Artificial sequence
  SiRNA target sequence
gctcggagcatggatgatacg

SEQ ID NO: 39122 - DNA, 21 bp, Artificial sequence
  SiRNA target sequence
ctcggagcatggatgatacgc

SEQ ID NO: 39123 - DNA, 21 bp, Artificial sequence
  SiRNA target sequence
tcggagcatggatgatacgca

SEQ ID NO: 39124 - DNA, 21 bp, Artificial sequence
  SiRNA target sequence
cggagcatggatgatacgcac

SEQ ID NO: 39125 - DNA, 21 bp, Artificial sequence
  SiRNA target sequence
ggagcatggatgatacgcaca

SEQ ID NO: 39126 - DNA, 21 bp, Artificial sequence
  SiRNA target sequence
gagcatggatgatacgcacag

SEQ ID NO: 39127 - DNA, 21 bp, Artificial sequence
  SiRNA target sequence
agcatggatgatacgcacagt

SEQ ID NO: 39128 - DNA, 21 bp, Artificial sequence
  SiRNA target sequence
gcatggatgatacgcacagta

SEQ ID NO: 39129 - DNA, 21 bp, Artificial sequence
  SiRNA target sequence
catggatgatacgcacagtat

SEQ ID NO: 39130 - DNA, 21 bp, Artificial sequence
  SiRNA target sequence
atggatgatacgcacagtatt

SEQ ID NO: 39131 - DNA, 21 bp, Artificial sequence
  SiRNA target sequence
tggatgatacgcacagtatta

SEQ ID NO: 39132 - DNA, 21 bp, Artificial sequence
  SiRNA target sequence
ggatgatacgcacagtattat

SEQ ID NO: 39133 - DNA, 21 bp, Artificial sequence
  SiRNA target sequence
gatgatacgcacagtattatt

SEQ ID NO: 39134 - DNA, 21 bp, Artificial sequence
  SiRNA target sequence
atgatacgcacagtattattc

SEQ ID NO: 39135 - DNA, 21 bp, Artificial sequence
  SiRNA target sequence
tgatacgcacagtattattca

SEQ ID NO: 39136 - DNA, 21 bp, Artificial sequence
  SiRNA target sequence
gatacgcacagtattattcag

SEQ ID NO: 39137 - DNA, 21 bp, Artificial sequence
  SiRNA target sequence
atacgcacagtattattcagt

SEQ ID NO: 39138 - DNA, 21 bp, Artificial sequence
  SiRNA target sequence
tacgcacagtattattcagtt

SEQ ID NO: 39139 - DNA, 21 bp, Artificial sequence
  SiRNA target sequence
acgcacagtattattcagttt

SEQ ID NO: 39140 - DNA, 21 bp, Artificial sequence
  SiRNA target sequence
cgcacagtattattcagtttt

SEQ ID NO: 39141 - DNA, 21 bp, Artificial sequence
  SiRNA target sequence
gcacagtattattcagttttt

SEQ ID NO: 39142 - DNA, 21 bp, Artificial sequence
  SiRNA target sequence
cacagtattattcagttttta

SEQ ID NO: 39143 - DNA, 21 bp, Artificial sequence
  SiRNA target sequence
acagtattattcagtttttac

SEQ ID NO: 39144 - DNA, 21 bp, Artificial sequence
  SiRNA target sequence
cagtattattcagtttttaca

SEQ ID NO: 39145 - DNA, 21 bp, Artificial sequence
  SiRNA target sequence
agtattattcagtttttacaa

SEQ ID NO: 39146 - DNA, 21 bp, Artificial sequence
  SiRNA target sequence
gtattattcagtttttacaac

SEQ ID NO: 39147 - DNA, 21 bp, Artificial sequence
  SiRNA target sequence
tattattcagtttttacaacg

SEQ ID NO: 39148 - DNA, 21 bp, Artificial sequence
  SiRNA target sequence
attattcagtttttacaacgc

SEQ ID NO: 39149 - DNA, 21 bp, Artificial sequence
  SiRNA target sequence
ttattcagtttttacaacgcc

SEQ ID NO: 39150 - DNA, 21 bp, Artificial sequence
  SiRNA target sequence
tattcagtttttacaacgccc

SEQ ID NO: 39151 - DNA, 21 bp, Artificial sequence
  SiRNA target sequence
attcagtttttacaacgcccc

SEQ ID NO: 39152 - DNA, 21 bp, Artificial sequence
  SiRNA target sequence
ttcagtttttacaacgccccg

SEQ ID NO: 39153 - DNA, 21 bp, Artificial sequence
  SiRNA target sequence
tcagtttttacaacgccccgt

SEQ ID NO: 39154 - DNA, 21 bp, Artificial sequence
  SiRNA target sequence
cagtttttacaacgccccgta

SEQ ID NO: 39155 - DNA, 21 bp, Artificial sequence
  SiRNA target sequence
agtttttacaacgccccgtac

SEQ ID NO: 39156 - DNA, 21 bp, Artificial sequence
  SiRNA target sequence
gtttttacaacgccccgtact

SEQ ID NO: 39157 - DNA, 21 bp, Artificial sequence
  SiRNA target sequence
tttttacaacgccccgtactc

SEQ ID NO: 39158 - DNA, 21 bp, Artificial sequence
  SiRNA target sequence
ttttacaacgccccgtactca

SEQ ID NO: 39159 - DNA, 21 bp, Artificial sequence
  SiRNA target sequence
tttacaacgccccgtactcat

SEQ ID NO: 39160 - DNA, 21 bp, Artificial sequence
  SiRNA target sequence
ttacaacgccccgtactcatt

SEQ ID NO: 39161 - DNA, 21 bp, Artificial sequence
  SiRNA target sequence
tacaacgccccgtactcattg

SEQ ID NO: 39162 - DNA, 21 bp, Artificial sequence
  SiRNA target sequence
acaacgccccgtactcattga

SEQ ID NO: 39163 - DNA, 21 bp, Artificial sequence
  SiRNA target sequence
caacgccccgtactcattgac

SEQ ID NO: 39164 - DNA, 21 bp, Artificial sequence
  SiRNA target sequence
aacgccccgtactcattgacc

SEQ ID NO: 39165 - DNA, 21 bp, Artificial sequence
  SiRNA target sequence
acgccccgtactcattgacca

SEQ ID NO: 39166 - DNA, 21 bp, Artificial sequence
  SiRNA target sequence
cgccccgtactcattgaccac

SEQ ID NO: 39167 - DNA, 21 bp, Artificial sequence
  SiRNA target sequence
gccccgtactcattgaccaca

SEQ ID NO: 39168 - DNA, 21 bp, Artificial sequence
  SiRNA target sequence
ccccgtactcattgaccacat

SEQ ID NO: 39169 - DNA, 21 bp, Artificial sequence
  SiRNA target sequence
cccgtactcattgaccacatt

SEQ ID NO: 39170 - DNA, 21 bp, Artificial sequence
  SiRNA target sequence
ccgtactcattgaccacattg

SEQ ID NO: 39171 - DNA, 21 bp, Artificial sequence
  SiRNA target sequence
cgtactcattgaccacattga

SEQ ID NO: 39172 - DNA, 21 bp, Artificial sequence
  SiRNA target sequence
gtactcattgaccacattgag

SEQ ID NO: 39173 - DNA, 21 bp, Artificial sequence
  SiRNA target sequence
tactcattgaccacattgagg

SEQ ID NO: 39174 - DNA, 21 bp, Artificial sequence
  SiRNA target sequence
actcattgaccacattgaggt

SEQ ID NO: 39175 - DNA, 21 bp, Artificial sequence
  SiRNA target sequence
ctcattgaccacattgaggtc

SEQ ID NO: 39176 - DNA, 21 bp, Artificial sequence
  SiRNA target sequence
tcattgaccacattgaggtca

SEQ ID NO: 39177 - DNA, 21 bp, Artificial sequence
  SiRNA target sequence
cattgaccacattgaggtcat

SEQ ID NO: 39178 - DNA, 21 bp, Artificial sequence
  SiRNA target sequence
attgaccacattgaggtcatt

SEQ ID NO: 39179 - DNA, 21 bp, Artificial sequence
  SiRNA target sequence
ttgaccacattgaggtcattg

SEQ ID NO: 39180 - DNA, 21 bp, Artificial sequence
  SiRNA target sequence
tgaccacattgaggtcattgc

SEQ ID NO: 39181 - DNA, 21 bp, Artificial sequence
  SiRNA target sequence
gaccacattgaggtcattgct

SEQ ID NO: 39182 - DNA, 21 bp, Artificial sequence
  SiRNA target sequence
accacattgaggtcattgctg

SEQ ID NO: 39183 - DNA, 21 bp, Artificial sequence
  SiRNA target sequence
ccacattgaggtcattgctgg

SEQ ID NO: 39184 - DNA, 21 bp, Artificial sequence
  SiRNA target sequence
cacattgaggtcattgctgga

SEQ ID NO: 39185 - DNA, 21 bp, Artificial sequence
  SiRNA target sequence
acattgaggtcattgctggat

SEQ ID NO: 39186 - DNA, 21 bp, Artificial sequence
  SiRNA target sequence
cattgaggtcattgctggatc

SEQ ID NO: 39187 - DNA, 21 bp, Artificial sequence
  SiRNA target sequence
attgaggtcattgctggatca

SEQ ID NO: 39188 - DNA, 21 bp, Artificial sequence
  SiRNA target sequence
ttgaggtcattgctggatcaa

SEQ ID NO: 39189 - DNA, 21 bp, Artificial sequence
  SiRNA target sequence
tgaggtcattgctggatcaac

SEQ ID NO: 39190 - DNA, 21 bp, Artificial sequence
  SiRNA target sequence
gaggtcattgctggatcaaca

SEQ ID NO: 39191 - DNA, 21 bp, Artificial sequence
  SiRNA target sequence
aggtcattgctggatcaacag

SEQ ID NO: 39192 - DNA, 21 bp, Artificial sequence
  SiRNA target sequence
ggtcattgctggatcaacagc

SEQ ID NO: 39193 - DNA, 21 bp, Artificial sequence
  SiRNA target sequence
gtcattgctggatcaacagca

SEQ ID NO: 39194 - DNA, 21 bp, Artificial sequence
  SiRNA target sequence
tcattgctggatcaacagcag

SEQ ID NO: 39195 - DNA, 21 bp, Artificial sequence
  SiRNA target sequence
cattgctggatcaacagcaga

SEQ ID NO: 39196 - DNA, 21 bp, Artificial sequence
  SiRNA target sequence
attgctggatcaacagcagat

SEQ ID NO: 39197 - DNA, 21 bp, Artificial sequence
  SiRNA target sequence
ttgctggatcaacagcagatg

SEQ ID NO: 39198 - DNA, 21 bp, Artificial sequence
  SiRNA target sequence
tgctggatcaacagcagatga

SEQ ID NO: 39199 - DNA, 21 bp, Artificial sequence
  SiRNA target sequence
gctggatcaacagcagatgat

SEQ ID NO: 39200 - DNA, 21 bp, Artificial sequence
  SiRNA target sequence
ctggatcaacagcagatgata

SEQ ID NO: 39201 - DNA, 21 bp, Artificial sequence
  SiRNA target sequence
tggatcaacagcagatgataa

SEQ ID NO: 39202 - DNA, 21 bp, Artificial sequence
  SiRNA target sequence
ggatcaacagcagatgataac

SEQ ID NO: 39203 - DNA, 21 bp, Artificial sequence
  SiRNA target sequence
gatcaacagcagatgataaca

SEQ ID NO: 39204 - DNA, 21 bp, Artificial sequence
  SiRNA target sequence
atcaacagcagatgataacaa

SEQ ID NO: 39205 - DNA, 21 bp, Artificial sequence
  SiRNA target sequence
tcaacagcagatgataacaaa

SEQ ID NO: 39206 - DNA, 21 bp, Artificial sequence
  SiRNA target sequence
caacagcagatgataacaaac

SEQ ID NO: 39207 - DNA, 21 bp, Artificial sequence
  SiRNA target sequence
aacagcagatgataacaaacc

SEQ ID NO: 39208 - DNA, 21 bp, Artificial sequence
  SiRNA target sequence
acagcagatgataacaaaccc

SEQ ID NO: 39209 - DNA, 21 bp, Artificial sequence
  SiRNA target sequence
cagcagatgataacaaacccc

SEQ ID NO: 39210 - DNA, 21 bp, Artificial sequence
  SiRNA target sequence
agcagatgataacaaacccct

SEQ ID NO: 39211 - DNA, 21 bp, Artificial sequence
  SiRNA target sequence
gcagatgataacaaacccctc

SEQ ID NO: 39212 - DNA, 21 bp, Artificial sequence
  SiRNA target sequence
cagatgataacaaacccctca

SEQ ID NO: 39213 - DNA, 21 bp, Artificial sequence
  SiRNA target sequence
agatgataacaaacccctcaa

SEQ ID NO: 39214 - DNA, 21 bp, Artificial sequence
  SiRNA target sequence
gatgataacaaacccctcaat

SEQ ID NO: 39215 - DNA, 21 bp, Artificial sequence
  SiRNA target sequence
atgataacaaacccctcaata

SEQ ID NO: 39216 - DNA, 21 bp, Artificial sequence
  SiRNA target sequence
tgataacaaacccctcaatag

SEQ ID NO: 39217 - DNA, 21 bp, Artificial sequence
  SiRNA target sequence
gataacaaacccctcaataga

SEQ ID NO: 39218 - DNA, 21 bp, Artificial sequence
  SiRNA target sequence
ataacaaacccctcaatagat

SEQ ID NO: 39219 - DNA, 21 bp, Artificial sequence
  SiRNA target sequence
taacaaacccctcaatagata

SEQ ID NO: 39220 - DNA, 21 bp, Artificial sequence
  SiRNA target sequence
aacaaacccctcaatagatat

SEQ ID NO: 39221 - DNA, 21 bp, Artificial sequence
  SiRNA target sequence
acaaacccctcaatagatatg

SEQ ID NO: 39222 - DNA, 21 bp, Artificial sequence
  SiRNA target sequence
caaacccctcaatagatatgt

SEQ ID NO: 39223 - DNA, 21 bp, Artificial sequence
  SiRNA target sequence
aaacccctcaatagatatgtg

SEQ ID NO: 39224 - DNA, 21 bp, Artificial sequence
  SiRNA target sequence
aacccctcaatagatatgtgt

SEQ ID NO: 39225 - DNA, 21 bp, Artificial sequence
  SiRNA target sequence
acccctcaatagatatgtgtt

SEQ ID NO: 39226 - DNA, 21 bp, Artificial sequence
  SiRNA target sequence
cccctcaatagatatgtgtta

SEQ ID NO: 39227 - DNA, 21 bp, Artificial sequence
  SiRNA target sequence
ccctcaatagatatgtgttaa

SEQ ID NO: 39228 - DNA, 21 bp, Artificial sequence
  SiRNA target sequence
cctcaatagatatgtgttaaa

SEQ ID NO: 39229 - DNA, 21 bp, Artificial sequence
  SiRNA target sequence
ctcaatagatatgtgttaaat

SEQ ID NO: 39230 - DNA, 21 bp, Artificial sequence
  SiRNA target sequence
tcaatagatatgtgttaaatc

SEQ ID NO: 39231 - DNA, 21 bp, Artificial sequence
  SiRNA target sequence
caatagatatgtgttaaatcg

SEQ ID NO: 39232 - DNA, 21 bp, Artificial sequence
  SiRNA target sequence
aatagatatgtgttaaatcga

SEQ ID NO: 39233 - DNA, 21 bp, Artificial sequence
  SiRNA target sequence
atagatatgtgttaaatcgac

SEQ ID NO: 39234 - DNA, 21 bp, Artificial sequence
  SiRNA target sequence
tagatatgtgttaaatcgaca

SEQ ID NO: 39235 - DNA, 21 bp, Artificial sequence
  SiRNA target sequence
agatatgtgttaaatcgacag

SEQ ID NO: 39236 - DNA, 21 bp, Artificial sequence
  SiRNA target sequence
gatatgtgttaaatcgacaga

SEQ ID NO: 39237 - DNA, 21 bp, Artificial sequence
  SiRNA target sequence
atatgtgttaaatcgacagaa

SEQ ID NO: 39238 - DNA, 21 bp, Artificial sequence
  SiRNA target sequence
tatgtgttaaatcgacagaat

SEQ ID NO: 39239 - DNA, 21 bp, Artificial sequence
  SiRNA target sequence
atgtgttaaatcgacagaatc

SEQ ID NO: 39240 - DNA, 21 bp, Artificial sequence
  SiRNA target sequence
tgtgttaaatcgacagaatcc

SEQ ID NO: 39241 - DNA, 21 bp, Artificial sequence
  SiRNA target sequence
gtgttaaatcgacagaatcca

SEQ ID NO: 39242 - DNA, 21 bp, Artificial sequence
  SiRNA target sequence
tgttaaatcgacagaatccac

SEQ ID NO: 39243 - DNA, 21 bp, Artificial sequence
  SiRNA target sequence
gttaaatcgacagaatccaca

SEQ ID NO: 39244 - DNA, 21 bp, Artificial sequence
  SiRNA target sequence
ttaaatcgacagaatccacaa

SEQ ID NO: 39245 - DNA, 21 bp, Artificial sequence
  SiRNA target sequence
taaatcgacagaatccacaac

SEQ ID NO: 39246 - DNA, 21 bp, Artificial sequence
  SiRNA target sequence
aaatcgacagaatccacaacc

SEQ ID NO: 39247 - DNA, 21 bp, Artificial sequence
  SiRNA target sequence
aatcgacagaatccacaacca

SEQ ID NO: 39248 - DNA, 21 bp, Artificial sequence
  SiRNA target sequence
atcgacagaatccacaaccat

SEQ ID NO: 39249 - DNA, 21 bp, Artificial sequence
  SiRNA target sequence
tcgacagaatccacaaccatt

SEQ ID NO: 39250 - DNA, 21 bp, Artificial sequence
  SiRNA target sequence
cgacagaatccacaaccattt

SEQ ID NO: 39251 - DNA, 21 bp, Artificial sequence
  SiRNA target sequence
gacagaatccacaaccatttg

SEQ ID NO: 39252 - DNA, 21 bp, Artificial sequence
  SiRNA target sequence
acagaatccacaaccatttgt

SEQ ID NO: 39253 - DNA, 21 bp, Artificial sequence
  SiRNA target sequence
cagaatccacaaccatttgtt

SEQ ID NO: 39254 - DNA, 21 bp, Artificial sequence
  SiRNA target sequence
agaatccacaaccatttgtta

SEQ ID NO: 39255 - DNA, 21 bp, Artificial sequence
  SiRNA target sequence
gaatccacaaccatttgttaa

SEQ ID NO: 39256 - DNA, 21 bp, Artificial sequence
  SiRNA target sequence
aatccacaaccatttgttaaa

SEQ ID NO: 39257 - DNA, 21 bp, Artificial sequence
  SiRNA target sequence
atccacaaccatttgttaaat

SEQ ID NO: 39258 - DNA, 21 bp, Artificial sequence
  SiRNA target sequence
tccacaaccatttgttaaatc

SEQ ID NO: 39259 - DNA, 21 bp, Artificial sequence
  SiRNA target sequence
ccacaaccatttgttaaatct

SEQ ID NO: 39260 - DNA, 21 bp, Artificial sequence
  SiRNA target sequence
cacaaccatttgttaaatctt

SEQ ID NO: 39261 - DNA, 21 bp, Artificial sequence
  SiRNA target sequence
acaaccatttgttaaatcttg

SEQ ID NO: 39262 - DNA, 21 bp, Artificial sequence
  SiRNA target sequence
caaccatttgttaaatcttgg

SEQ ID NO: 39263 - DNA, 21 bp, Artificial sequence
  SiRNA target sequence
aaccatttgttaaatcttgga

SEQ ID NO: 39264 - DNA, 21 bp, Artificial sequence
  SiRNA target sequence
accatttgttaaatcttggac

SEQ ID NO: 39265 - DNA, 21 bp, Artificial sequence
  SiRNA target sequence
ccatttgttaaatcttggaca

SEQ ID NO: 39266 - DNA, 21 bp, Artificial sequence
  SiRNA target sequence
catttgttaaatcttggacat

SEQ ID NO: 39267 - DNA, 21 bp, Artificial sequence
  SiRNA target sequence
atttgttaaatcttggacatt

SEQ ID NO: 39268 - DNA, 21 bp, Artificial sequence
  SiRNA target sequence
tttgttaaatcttggacattg

SEQ ID NO: 39269 - DNA, 21 bp, Artificial sequence
  SiRNA target sequence
ttgttaaatcttggacattgc

SEQ ID NO: 39270 - DNA, 21 bp, Artificial sequence
  SiRNA target sequence
tgttaaatcttggacattgcc

SEQ ID NO: 39271 - DNA, 21 bp, Artificial sequence
  SiRNA target sequence
gttaaatcttggacattgcct

SEQ ID NO: 39272 - DNA, 21 bp, Artificial sequence
  SiRNA target sequence
ttaaatcttggacattgcctt

SEQ ID NO: 39273 - DNA, 21 bp, Artificial sequence
  SiRNA target sequence
taaatcttggacattgccttc

SEQ ID NO: 39274 - DNA, 21 bp, Artificial sequence
  SiRNA target sequence
aaatcttggacattgccttca

SEQ ID NO: 39275 - DNA, 21 bp, Artificial sequence
  SiRNA target sequence
aatcttggacattgccttcag

SEQ ID NO: 39276 - DNA, 21 bp, Artificial sequence
  SiRNA target sequence
atcttggacattgccttcagt

SEQ ID NO: 39277 - DNA, 21 bp, Artificial sequence
  SiRNA target sequence
tcttggacattgccttcagta

SEQ ID NO: 39278 - DNA, 21 bp, Artificial sequence
  SiRNA target sequence
cttggacattgccttcagtag

SEQ ID NO: 39279 - DNA, 21 bp, Artificial sequence
  SiRNA target sequence
ttggacattgccttcagtagt

SEQ ID NO: 39280 - DNA, 21 bp, Artificial sequence
  SiRNA target sequence
tggacattgccttcagtagtt

SEQ ID NO: 39281 - DNA, 21 bp, Artificial sequence
  SiRNA target sequence
ggacattgccttcagtagttt

SEQ ID NO: 39282 - DNA, 21 bp, Artificial sequence
  SiRNA target sequence
gacattgccttcagtagtttt

SEQ ID NO: 39283 - DNA, 21 bp, Artificial sequence
  SiRNA target sequence
acattgccttcagtagtttta

SEQ ID NO: 39284 - DNA, 21 bp, Artificial sequence
  SiRNA target sequence
cattgccttcagtagttttaa

SEQ ID NO: 39285 - DNA, 21 bp, Artificial sequence
  SiRNA target sequence
attgccttcagtagttttaag

SEQ ID NO: 39286 - DNA, 21 bp, Artificial sequence
  SiRNA target sequence
ttgccttcagtagttttaagt

SEQ ID NO: 39287 - DNA, 21 bp, Artificial sequence
  SiRNA target sequence
tgccttcagtagttttaagtg

SEQ ID NO: 39288 - DNA, 21 bp, Artificial sequence
  SiRNA target sequence
gccttcagtagttttaagtgc

SEQ ID NO: 39289 - DNA, 21 bp, Artificial sequence
  SiRNA target sequence
ccttcagtagttttaagtgct

SEQ ID NO: 39290 - DNA, 21 bp, Artificial sequence
  SiRNA target sequence
cttcagtagttttaagtgctg

SEQ ID NO: 39291 - DNA, 21 bp, Artificial sequence
  SiRNA target sequence
ttcagtagttttaagtgctgg

SEQ ID NO: 39292 - DNA, 21 bp, Artificial sequence
  SiRNA target sequence
tcagtagttttaagtgctgga

SEQ ID NO: 39293 - DNA, 21 bp, Artificial sequence
  SiRNA target sequence
cagtagttttaagtgctggag

SEQ ID NO: 39294 - DNA, 21 bp, Artificial sequence
  SiRNA target sequence
agtagttttaagtgctggagg

SEQ ID NO: 39295 - DNA, 21 bp, Artificial sequence
  SiRNA target sequence
gtagttttaagtgctggaggt

SEQ ID NO: 39296 - DNA, 21 bp, Artificial sequence
  SiRNA target sequence
tagttttaagtgctggaggta

SEQ ID NO: 39297 - DNA, 21 bp, Artificial sequence
  SiRNA target sequence
agttttaagtgctggaggtaa

SEQ ID NO: 39298 - DNA, 21 bp, Artificial sequence
  SiRNA target sequence
gttttaagtgctggaggtaag

SEQ ID NO: 39299 - DNA, 21 bp, Artificial sequence
  SiRNA target sequence
ttttaagtgctggaggtaagg

SEQ ID NO: 39300 - DNA, 21 bp, Artificial sequence
  SiRNA target sequence
tttaagtgctggaggtaaggg

SEQ ID NO: 39301 - DNA, 21 bp, Artificial sequence
  SiRNA target sequence
ttaagtgctggaggtaaggga

SEQ ID NO: 39302 - DNA, 21 bp, Artificial sequence
  SiRNA target sequence
taagtgctggaggtaagggac

SEQ ID NO: 39303 - DNA, 21 bp, Artificial sequence
  SiRNA target sequence
aagtgctggaggtaagggaca

SEQ ID NO: 39304 - DNA, 21 bp, Artificial sequence
  SiRNA target sequence
agtgctggaggtaagggacaa

SEQ ID NO: 39305 - DNA, 21 bp, Artificial sequence
  SiRNA target sequence
gtgctggaggtaagggacaaa

SEQ ID NO: 39306 - DNA, 21 bp, Artificial sequence
  SiRNA target sequence
tgctggaggtaagggacaaaa

SEQ ID NO: 39307 - DNA, 21 bp, Artificial sequence
  SiRNA target sequence
gctggaggtaagggacaaaaa

SEQ ID NO: 39308 - DNA, 21 bp, Artificial sequence
  SiRNA target sequence
ctggaggtaagggacaaaaat

SEQ ID NO: 39309 - DNA, 21 bp, Artificial sequence
  SiRNA target sequence
tggaggtaagggacaaaaatt

SEQ ID NO: 39310 - DNA, 21 bp, Artificial sequence
  SiRNA target sequence
ggaggtaagggacaaaaatta

SEQ ID NO: 39311 - DNA, 21 bp, Artificial sequence
  SiRNA target sequence
gaggtaagggacaaaaattag

SEQ ID NO: 39312 - DNA, 21 bp, Artificial sequence
  SiRNA target sequence
aggtaagggacaaaaattagc

SEQ ID NO: 39313 - DNA, 21 bp, Artificial sequence
  SiRNA target sequence
ggtaagggacaaaaattagct

SEQ ID NO: 39314 - DNA, 21 bp, Artificial sequence
  SiRNA target sequence
gtaagggacaaaaattagcta

SEQ ID NO: 39315 - DNA, 21 bp, Artificial sequence
  SiRNA target sequence
taagggacaaaaattagctaa

SEQ ID NO: 39316 - DNA, 21 bp, Artificial sequence
  SiRNA target sequence
aagggacaaaaattagctaat

SEQ ID NO: 39317 - DNA, 21 bp, Artificial sequence
  SiRNA target sequence
agggacaaaaattagctaatt

SEQ ID NO: 39318 - DNA, 21 bp, Artificial sequence
  SiRNA target sequence
gggacaaaaattagctaattt

SEQ ID NO: 39319 - DNA, 21 bp, Artificial sequence
  SiRNA target sequence
ggacaaaaattagctaatttt

SEQ ID NO: 39320 - DNA, 21 bp, Artificial sequence
  SiRNA target sequence
gacaaaaattagctaatttta

SEQ ID NO: 39321 - DNA, 21 bp, Artificial sequence
  SiRNA target sequence
acaaaaattagctaattttaa

SEQ ID NO: 39322 - DNA, 21 bp, Artificial sequence
  SiRNA target sequence
caaaaattagctaattttaaa

SEQ ID NO: 39323 - DNA, 21 bp, Artificial sequence
  SiRNA target sequence
aaaaattagctaattttaaat

SEQ ID NO: 39324 - DNA, 21 bp, Artificial sequence
  SiRNA target sequence
aaaattagctaattttaaata

SEQ ID NO: 39325 - DNA, 21 bp, Artificial sequence
  SiRNA target sequence
aaattagctaattttaaatat

SEQ ID NO: 39326 - DNA, 21 bp, Artificial sequence
  SiRNA target sequence
aattagctaattttaaatatt

SEQ ID NO: 39327 - DNA, 21 bp, Artificial sequence
  SiRNA target sequence
attagctaattttaaatattt

SEQ ID NO: 39328 - DNA, 21 bp, Artificial sequence
  SiRNA target sequence
ttagctaattttaaatattta

SEQ ID NO: 39329 - DNA, 21 bp, Artificial sequence
  SiRNA target sequence
tagctaattttaaatatttac

SEQ ID NO: 39330 - DNA, 21 bp, Artificial sequence
  SiRNA target sequence
agctaattttaaatatttacg

SEQ ID NO: 39331 - DNA, 21 bp, Artificial sequence
  SiRNA target sequence
gctaattttaaatatttacga

SEQ ID NO: 39332 - DNA, 21 bp, Artificial sequence
  SiRNA target sequence
ctaattttaaatatttacgat

SEQ ID NO: 39333 - DNA, 21 bp, Artificial sequence
  SiRNA target sequence
taattttaaatatttacgatg

SEQ ID NO: 39334 - DNA, 21 bp, Artificial sequence
  SiRNA target sequence
aattttaaatatttacgatgt

SEQ ID NO: 39335 - DNA, 21 bp, Artificial sequence
  SiRNA target sequence
attttaaatatttacgatgtg

SEQ ID NO: 39336 - DNA, 21 bp, Artificial sequence
  SiRNA target sequence
ttttaaatatttacgatgtga

SEQ ID NO: 39337 - DNA, 21 bp, Artificial sequence
  SiRNA target sequence
tttaaatatttacgatgtgat

SEQ ID NO: 39338 - DNA, 21 bp, Artificial sequence
  SiRNA target sequence
ttaaatatttacgatgtgatg

SEQ ID NO: 39339 - DNA, 21 bp, Artificial sequence
  SiRNA target sequence
taaatatttacgatgtgatgt

SEQ ID NO: 39340 - DNA, 21 bp, Artificial sequence
  SiRNA target sequence
aaatatttacgatgtgatgtt

SEQ ID NO: 39341 - DNA, 21 bp, Artificial sequence
  SiRNA target sequence
aatatttacgatgtgatgtta

SEQ ID NO: 39342 - DNA, 21 bp, Artificial sequence
  SiRNA target sequence
atatttacgatgtgatgttaa

SEQ ID NO: 39343 - DNA, 21 bp, Artificial sequence
  SiRNA target sequence
tatttacgatgtgatgttaaa

SEQ ID NO: 39344 - DNA, 21 bp, Artificial sequence
  SiRNA target sequence
atttacgatgtgatgttaaag

SEQ ID NO: 39345 - DNA, 21 bp, Artificial sequence
  SiRNA target sequence
tttacgatgtgatgttaaagt

SEQ ID NO: 39346 - DNA, 21 bp, Artificial sequence
  SiRNA target sequence
ttacgatgtgatgttaaagtc

SEQ ID NO: 39347 - DNA, 21 bp, Artificial sequence
  SiRNA target sequence
tacgatgtgatgttaaagtca

SEQ ID NO: 39348 - DNA, 21 bp, Artificial sequence
  SiRNA target sequence
acgatgtgatgttaaagtcaa

SEQ ID NO: 39349 - DNA, 21 bp, Artificial sequence
  SiRNA target sequence
cgatgtgatgttaaagtcaaa

SEQ ID NO: 39350 - DNA, 21 bp, Artificial sequence
  SiRNA target sequence
gatgtgatgttaaagtcaaaa

SEQ ID NO: 39351 - DNA, 21 bp, Artificial sequence
  SiRNA target sequence
atgtgatgttaaagtcaaaat

SEQ ID NO: 39352 - DNA, 21 bp, Artificial sequence
  SiRNA target sequence
tgtgatgttaaagtcaaaatt

SEQ ID NO: 39353 - DNA, 21 bp, Artificial sequence
  SiRNA target sequence
gtgatgttaaagtcaaaattg

SEQ ID NO: 39354 - DNA, 21 bp, Artificial sequence
  SiRNA target sequence
tgatgttaaagtcaaaattgt

SEQ ID NO: 39355 - DNA, 21 bp, Artificial sequence
  SiRNA target sequence
gatgttaaagtcaaaattgtt

SEQ ID NO: 39356 - DNA, 21 bp, Artificial sequence
  SiRNA target sequence
atgttaaagtcaaaattgttc

SEQ ID NO: 39357 - DNA, 21 bp, Artificial sequence
  SiRNA target sequence
tgttaaagtcaaaattgttct

SEQ ID NO: 39358 - DNA, 21 bp, Artificial sequence
  SiRNA target sequence
gttaaagtcaaaattgttcta

SEQ ID NO: 39359 - DNA, 21 bp, Artificial sequence
  SiRNA target sequence
ttaaagtcaaaattgttctaa

SEQ ID NO: 39360 - DNA, 21 bp, Artificial sequence
  SiRNA target sequence
taaagtcaaaattgttctaaa

SEQ ID NO: 39361 - DNA, 21 bp, Artificial sequence
  SiRNA target sequence
aaagtcaaaattgttctaaac

SEQ ID NO: 39362 - DNA, 21 bp, Artificial sequence
  SiRNA target sequence
aagtcaaaattgttctaaacg

SEQ ID NO: 39363 - DNA, 21 bp, Artificial sequence
  SiRNA target sequence
agtcaaaattgttctaaacgc

SEQ ID NO: 39364 - DNA, 21 bp, Artificial sequence
  SiRNA target sequence
gtcaaaattgttctaaacgca

SEQ ID NO: 39365 - DNA, 21 bp, Artificial sequence
  SiRNA target sequence
tcaaaattgttctaaacgcaa

SEQ ID NO: 39366 - DNA, 21 bp, Artificial sequence
  SiRNA target sequence
caaaattgttctaaacgcaaa

SEQ ID NO: 39367 - DNA, 21 bp, Artificial sequence
  SiRNA target sequence
aaaattgttctaaacgcaaat

SEQ ID NO: 39368 - DNA, 21 bp, Artificial sequence
  SiRNA target sequence
aaattgttctaaacgcaaatc

SEQ ID NO: 39369 - DNA, 21 bp, Artificial sequence
  SiRNA target sequence
aattgttctaaacgcaaatcc

SEQ ID NO: 39370 - DNA, 21 bp, Artificial sequence
  SiRNA target sequence
attgttctaaacgcaaatcct

SEQ ID NO: 39371 - DNA, 21 bp, Artificial sequence
  SiRNA target sequence
ttgttctaaacgcaaatcctt

SEQ ID NO: 39372 - DNA, 21 bp, Artificial sequence
  SiRNA target sequence
tgttctaaacgcaaatccttt

SEQ ID NO: 39373 - DNA, 21 bp, Artificial sequence
  SiRNA target sequence
gttctaaacgcaaatcctttc

SEQ ID NO: 39374 - DNA, 21 bp, Artificial sequence
  SiRNA target sequence
ttctaaacgcaaatcctttca

SEQ ID NO: 39375 - DNA, 21 bp, Artificial sequence
  SiRNA target sequence
tctaaacgcaaatcctttcat

SEQ ID NO: 39376 - DNA, 21 bp, Artificial sequence
  SiRNA target sequence
ctaaacgcaaatcctttcata

SEQ ID NO: 39377 - DNA, 21 bp, Artificial sequence
  SiRNA target sequence
taaacgcaaatcctttcatag

SEQ ID NO: 39378 - DNA, 21 bp, Artificial sequence
  SiRNA target sequence
aaacgcaaatcctttcatagc

SEQ ID NO: 39379 - DNA, 21 bp, Artificial sequence
  SiRNA target sequence
aacgcaaatcctttcatagct

SEQ ID NO: 39380 - DNA, 21 bp, Artificial sequence
  SiRNA target sequence
acgcaaatcctttcatagctg

SEQ ID NO: 39381 - DNA, 21 bp, Artificial sequence
  SiRNA target sequence
cgcaaatcctttcatagctgg

SEQ ID NO: 39382 - DNA, 21 bp, Artificial sequence
  SiRNA target sequence
gcaaatcctttcatagctgga

SEQ ID NO: 39383 - DNA, 21 bp, Artificial sequence
  SiRNA target sequence
caaatcctttcatagctggaa

SEQ ID NO: 39384 - DNA, 21 bp, Artificial sequence
  SiRNA target sequence
aaatcctttcatagctggaag

SEQ ID NO: 39385 - DNA, 21 bp, Artificial sequence
  SiRNA target sequence
aatcctttcatagctggaaga

SEQ ID NO: 39386 - DNA, 21 bp, Artificial sequence
  SiRNA target sequence
atcctttcatagctggaagat

SEQ ID NO: 39387 - DNA, 21 bp, Artificial sequence
  SiRNA target sequence
tcctttcatagctggaagatt

SEQ ID NO: 39388 - DNA, 21 bp, Artificial sequence
  SiRNA target sequence
cctttcatagctggaagatta

SEQ ID NO: 39389 - DNA, 21 bp, Artificial sequence
  SiRNA target sequence
ctttcatagctggaagattat

SEQ ID NO: 39390 - DNA, 21 bp, Artificial sequence
  SiRNA target sequence
tttcatagctggaagattata

SEQ ID NO: 39391 - DNA, 21 bp, Artificial sequence
  SiRNA target sequence
ttcatagctggaagattatac

SEQ ID NO: 39392 - DNA, 21 bp, Artificial sequence
  SiRNA target sequence
tcatagctggaagattatact

SEQ ID NO: 39393 - DNA, 21 bp, Artificial sequence
  SiRNA target sequence
catagctggaagattatactt

SEQ ID NO: 39394 - DNA, 21 bp, Artificial sequence
  SiRNA target sequence
atagctggaagattatactta

SEQ ID NO: 39395 - DNA, 21 bp, Artificial sequence
  SiRNA target sequence
tagctggaagattatacttag

SEQ ID NO: 39396 - DNA, 21 bp, Artificial sequence
  SiRNA target sequence
agctggaagattatacttagc

SEQ ID NO: 39397 - DNA, 21 bp, Artificial sequence
  SiRNA target sequence
gctggaagattatacttagca

SEQ ID NO: 39398 - DNA, 21 bp, Artificial sequence
  SiRNA target sequence
ctggaagattatacttagcat

SEQ ID NO: 39399 - DNA, 21 bp, Artificial sequence
  SiRNA target sequence
tggaagattatacttagcata

SEQ ID NO: 39400 - DNA, 21 bp, Artificial sequence
  SiRNA target sequence
ggaagattatacttagcatat

SEQ ID NO: 39401 - DNA, 21 bp, Artificial sequence
  SiRNA target sequence
gaagattatacttagcatatt

SEQ ID NO: 39402 - DNA, 21 bp, Artificial sequence
  SiRNA target sequence
aagattatacttagcatattc

SEQ ID NO: 39403 - DNA, 21 bp, Artificial sequence
  SiRNA target sequence
agattatacttagcatattca

SEQ ID NO: 39404 - DNA, 21 bp, Artificial sequence
  SiRNA target sequence
gattatacttagcatattcac

SEQ ID NO: 39405 - DNA, 21 bp, Artificial sequence
  SiRNA target sequence
attatacttagcatattcacc

SEQ ID NO: 39406 - DNA, 21 bp, Artificial sequence
  SiRNA target sequence
ttatacttagcatattcacct

SEQ ID NO: 39407 - DNA, 21 bp, Artificial sequence
  SiRNA target sequence
tatacttagcatattcacctt

SEQ ID NO: 39408 - DNA, 21 bp, Artificial sequence
  SiRNA target sequence
atacttagcatattcacctta

SEQ ID NO: 39409 - DNA, 21 bp, Artificial sequence
  SiRNA target sequence
tacttagcatattcaccttat

SEQ ID NO: 39410 - DNA, 21 bp, Artificial sequence
  SiRNA target sequence
acttagcatattcaccttatg

SEQ ID NO: 39411 - DNA, 21 bp, Artificial sequence
  SiRNA target sequence
cttagcatattcaccttatga

SEQ ID NO: 39412 - DNA, 21 bp, Artificial sequence
  SiRNA target sequence
ttagcatattcaccttatgat

SEQ ID NO: 39413 - DNA, 21 bp, Artificial sequence
  SiRNA target sequence
tagcatattcaccttatgatg

SEQ ID NO: 39414 - DNA, 21 bp, Artificial sequence
  SiRNA target sequence
agcatattcaccttatgatga

SEQ ID NO: 39415 - DNA, 21 bp, Artificial sequence
  SiRNA target sequence
gcatattcaccttatgatgac

SEQ ID NO: 39416 - DNA, 21 bp, Artificial sequence
  SiRNA target sequence
catattcaccttatgatgacc

SEQ ID NO: 39417 - DNA, 21 bp, Artificial sequence
  SiRNA target sequence
atattcaccttatgatgaccg

SEQ ID NO: 39418 - DNA, 21 bp, Artificial sequence
  SiRNA target sequence
tattcaccttatgatgaccga

SEQ ID NO: 39419 - DNA, 21 bp, Artificial sequence
  SiRNA target sequence
attcaccttatgatgaccgag

SEQ ID NO: 39420 - DNA, 21 bp, Artificial sequence
  SiRNA target sequence
ttcaccttatgatgaccgagt

SEQ ID NO: 39421 - DNA, 21 bp, Artificial sequence
  SiRNA target sequence
tcaccttatgatgaccgagtg

SEQ ID NO: 39422 - DNA, 21 bp, Artificial sequence
  SiRNA target sequence
caccttatgatgaccgagtgg

SEQ ID NO: 39423 - DNA, 21 bp, Artificial sequence
  SiRNA target sequence
accttatgatgaccgagtgga

SEQ ID NO: 39424 - DNA, 21 bp, Artificial sequence
  SiRNA target sequence
ccttatgatgaccgagtggac

SEQ ID NO: 39425 - DNA, 21 bp, Artificial sequence
  SiRNA target sequence
cttatgatgaccgagtggacc

SEQ ID NO: 39426 - DNA, 21 bp, Artificial sequence
  SiRNA target sequence
ttatgatgaccgagtggaccc

SEQ ID NO: 39427 - DNA, 21 bp, Artificial sequence
  SiRNA target sequence
tatgatgaccgagtggaccca

SEQ ID NO: 39428 - DNA, 21 bp, Artificial sequence
  SiRNA target sequence
atgatgaccgagtggacccag

SEQ ID NO: 39429 - DNA, 21 bp, Artificial sequence
  SiRNA target sequence
tgatgaccgagtggacccagc

SEQ ID NO: 39430 - DNA, 21 bp, Artificial sequence
  SiRNA target sequence
gatgaccgagtggacccagcg

SEQ ID NO: 39431 - DNA, 21 bp, Artificial sequence
  SiRNA target sequence
atgaccgagtggacccagcgc

SEQ ID NO: 39432 - DNA, 21 bp, Artificial sequence
  SiRNA target sequence
tgaccgagtggacccagcgcg

SEQ ID NO: 39433 - DNA, 21 bp, Artificial sequence
  SiRNA target sequence
gaccgagtggacccagcgcgt

SEQ ID NO: 39434 - DNA, 21 bp, Artificial sequence
  SiRNA target sequence
accgagtggacccagcgcgtt

SEQ ID NO: 39435 - DNA, 21 bp, Artificial sequence
  SiRNA target sequence
ccgagtggacccagcgcgttc

SEQ ID NO: 39436 - DNA, 21 bp, Artificial sequence
  SiRNA target sequence
cgagtggacccagcgcgttca

SEQ ID NO: 39437 - DNA, 21 bp, Artificial sequence
  SiRNA target sequence
gagtggacccagcgcgttcaa

SEQ ID NO: 39438 - DNA, 21 bp, Artificial sequence
  SiRNA target sequence
agtggacccagcgcgttcaat

SEQ ID NO: 39439 - DNA, 21 bp, Artificial sequence
  SiRNA target sequence
gtggacccagcgcgttcaatt

SEQ ID NO: 39440 - DNA, 21 bp, Artificial sequence
  SiRNA target sequence
tggacccagcgcgttcaattt

SEQ ID NO: 39441 - DNA, 21 bp, Artificial sequence
  SiRNA target sequence
ggacccagcgcgttcaatttt

SEQ ID NO: 39442 - DNA, 21 bp, Artificial sequence
  SiRNA target sequence
gacccagcgcgttcaatttta

SEQ ID NO: 39443 - DNA, 21 bp, Artificial sequence
  SiRNA target sequence
acccagcgcgttcaattttaa

SEQ ID NO: 39444 - DNA, 21 bp, Artificial sequence
  SiRNA target sequence
cccagcgcgttcaattttaaa

SEQ ID NO: 39445 - DNA, 21 bp, Artificial sequence
  SiRNA target sequence
ccagcgcgttcaattttaaac

SEQ ID NO: 39446 - DNA, 21 bp, Artificial sequence
  SiRNA target sequence
cagcgcgttcaattttaaaca

SEQ ID NO: 39447 - DNA, 21 bp, Artificial sequence
  SiRNA target sequence
agcgcgttcaattttaaacac

SEQ ID NO: 39448 - DNA, 21 bp, Artificial sequence
  SiRNA target sequence
gcgcgttcaattttaaacacc

SEQ ID NO: 39449 - DNA, 21 bp, Artificial sequence
  SiRNA target sequence
cgcgttcaattttaaacacct

SEQ ID NO: 39450 - DNA, 21 bp, Artificial sequence
  SiRNA target sequence
gcgttcaattttaaacacctc

SEQ ID NO: 39451 - DNA, 21 bp, Artificial sequence
  SiRNA target sequence
cgttcaattttaaacacctca

SEQ ID NO: 39452 - DNA, 21 bp, Artificial sequence
  SiRNA target sequence
gttcaattttaaacacctcac

SEQ ID NO: 39453 - DNA, 21 bp, Artificial sequence
  SiRNA target sequence
ttcaattttaaacacctcacg

SEQ ID NO: 39454 - DNA, 21 bp, Artificial sequence
  SiRNA target sequence
tcaattttaaacacctcacga

SEQ ID NO: 39455 - DNA, 21 bp, Artificial sequence
  SiRNA target sequence
caattttaaacacctcacgag

SEQ ID NO: 39456 - DNA, 21 bp, Artificial sequence
  SiRNA target sequence
aattttaaacacctcacgagc

SEQ ID NO: 39457 - DNA, 21 bp, Artificial sequence
  SiRNA target sequence
attttaaacacctcacgagct

SEQ ID NO: 39458 - DNA, 21 bp, Artificial sequence
  SiRNA target sequence
ttttaaacacctcacgagctg

SEQ ID NO: 39459 - DNA, 21 bp, Artificial sequence
  SiRNA target sequence
tttaaacacctcacgagctgg

SEQ ID NO: 39460 - DNA, 21 bp, Artificial sequence
  SiRNA target sequence
ttaaacacctcacgagctgga

SEQ ID NO: 39461 - DNA, 21 bp, Artificial sequence
  SiRNA target sequence
taaacacctcacgagctggag

SEQ ID NO: 39462 - DNA, 21 bp, Artificial sequence
  SiRNA target sequence
aaacacctcacgagctggagt

SEQ ID NO: 39463 - DNA, 21 bp, Artificial sequence
  SiRNA target sequence
aacacctcacgagctggagtt

SEQ ID NO: 39464 - DNA, 21 bp, Artificial sequence
  SiRNA target sequence
acacctcacgagctggagtta

SEQ ID NO: 39465 - DNA, 21 bp, Artificial sequence
  SiRNA target sequence
cacctcacgagctggagttac

SEQ ID NO: 39466 - DNA, 21 bp, Artificial sequence
  SiRNA target sequence
acctcacgagctggagttacg

SEQ ID NO: 39467 - DNA, 21 bp, Artificial sequence
  SiRNA target sequence
cctcacgagctggagttacgg

SEQ ID NO: 39468 - DNA, 21 bp, Artificial sequence
  SiRNA target sequence
ctcacgagctggagttacggg

SEQ ID NO: 39469 - DNA, 21 bp, Artificial sequence
  SiRNA target sequence
tcacgagctggagttacggga

SEQ ID NO: 39470 - DNA, 21 bp, Artificial sequence
  SiRNA target sequence
cacgagctggagttacgggat

SEQ ID NO: 39471 - DNA, 21 bp, Artificial sequence
  SiRNA target sequence
acgagctggagttacgggata

SEQ ID NO: 39472 - DNA, 21 bp, Artificial sequence
  SiRNA target sequence
cgagctggagttacgggatac

SEQ ID NO: 39473 - DNA, 21 bp, Artificial sequence
  SiRNA target sequence
gagctggagttacgggatacc

SEQ ID NO: 39474 - DNA, 21 bp, Artificial sequence
  SiRNA target sequence
agctggagttacgggataccc

SEQ ID NO: 39475 - DNA, 21 bp, Artificial sequence
  SiRNA target sequence
gctggagttacgggataccct

SEQ ID NO: 39476 - DNA, 21 bp, Artificial sequence
  SiRNA target sequence
ctggagttacgggataccctg

SEQ ID NO: 39477 - DNA, 21 bp, Artificial sequence
  SiRNA target sequence
tggagttacgggataccctgg

SEQ ID NO: 39478 - DNA, 21 bp, Artificial sequence
  SiRNA target sequence
ggagttacgggataccctgga

SEQ ID NO: 39479 - DNA, 21 bp, Artificial sequence
  SiRNA target sequence
gagttacgggataccctggaa

SEQ ID NO: 39480 - DNA, 21 bp, Artificial sequence
  SiRNA target sequence
agttacgggataccctggaat

SEQ ID NO: 39481 - DNA, 21 bp, Artificial sequence
  SiRNA target sequence
gttacgggataccctggaata

SEQ ID NO: 39482 - DNA, 21 bp, Artificial sequence
  SiRNA target sequence
ttacgggataccctggaatag

SEQ ID NO: 39483 - DNA, 21 bp, Artificial sequence
  SiRNA target sequence
tacgggataccctggaataga

SEQ ID NO: 39484 - DNA, 21 bp, Artificial sequence
  SiRNA target sequence
acgggataccctggaatagag

SEQ ID NO: 39485 - DNA, 21 bp, Artificial sequence
  SiRNA target sequence
cgggataccctggaatagaga

SEQ ID NO: 39486 - DNA, 21 bp, Artificial sequence
  SiRNA target sequence
gggataccctggaatagagat

SEQ ID NO: 39487 - DNA, 21 bp, Artificial sequence
  SiRNA target sequence
ggataccctggaatagagatt

SEQ ID NO: 39488 - DNA, 21 bp, Artificial sequence
  SiRNA target sequence
gataccctggaatagagattg

SEQ ID NO: 39489 - DNA, 21 bp, Artificial sequence
  SiRNA target sequence
ataccctggaatagagattga

SEQ ID NO: 39490 - DNA, 21 bp, Artificial sequence
  SiRNA target sequence
taccctggaatagagattgat

SEQ ID NO: 39491 - DNA, 21 bp, Artificial sequence
  SiRNA target sequence
accctggaatagagattgatt

SEQ ID NO: 39492 - DNA, 21 bp, Artificial sequence
  SiRNA target sequence
ccctggaatagagattgattt

SEQ ID NO: 39493 - DNA, 21 bp, Artificial sequence
  SiRNA target sequence
cctggaatagagattgatttt

SEQ ID NO: 39494 - DNA, 21 bp, Artificial sequence
  SiRNA target sequence
ctggaatagagattgattttc

SEQ ID NO: 39495 - DNA, 21 bp, Artificial sequence
  SiRNA target sequence
tggaatagagattgattttca

SEQ ID NO: 39496 - DNA, 21 bp, Artificial sequence
  SiRNA target sequence
ggaatagagattgattttcaa

SEQ ID NO: 39497 - DNA, 21 bp, Artificial sequence
  SiRNA target sequence
gaatagagattgattttcaat

SEQ ID NO: 39498 - DNA, 21 bp, Artificial sequence
  SiRNA target sequence
aatagagattgattttcaatt

SEQ ID NO: 39499 - DNA, 21 bp, Artificial sequence
  SiRNA target sequence
atagagattgattttcaatta

SEQ ID NO: 39500 - DNA, 21 bp, Artificial sequence
  SiRNA target sequence
tagagattgattttcaattag

SEQ ID NO: 39501 - DNA, 21 bp, Artificial sequence
  SiRNA target sequence
agagattgattttcaattaga

SEQ ID NO: 39502 - DNA, 21 bp, Artificial sequence
  SiRNA target sequence
gagattgattttcaattagat

SEQ ID NO: 39503 - DNA, 21 bp, Artificial sequence
  SiRNA target sequence
agattgattttcaattagata

SEQ ID NO: 39504 - DNA, 21 bp, Artificial sequence
  SiRNA target sequence
gattgattttcaattagataa

SEQ ID NO: 39505 - DNA, 21 bp, Artificial sequence
  SiRNA target sequence
attgattttcaattagataat

SEQ ID NO: 39506 - DNA, 21 bp, Artificial sequence
  SiRNA target sequence
ttgattttcaattagataatt

SEQ ID NO: 39507 - DNA, 21 bp, Artificial sequence
  SiRNA target sequence
tgattttcaattagataattc

SEQ ID NO: 39508 - DNA, 21 bp, Artificial sequence
  SiRNA target sequence
gattttcaattagataattcc

SEQ ID NO: 39509 - DNA, 21 bp, Artificial sequence
  SiRNA target sequence
attttcaattagataattccg

SEQ ID NO: 39510 - DNA, 21 bp, Artificial sequence
  SiRNA target sequence
ttttcaattagataattccgt

SEQ ID NO: 39511 - DNA, 21 bp, Artificial sequence
  SiRNA target sequence
tttcaattagataattccgta

SEQ ID NO: 39512 - DNA, 21 bp, Artificial sequence
  SiRNA target sequence
ttcaattagataattccgtag

SEQ ID NO: 39513 - DNA, 21 bp, Artificial sequence
  SiRNA target sequence
tcaattagataattccgtaga

SEQ ID NO: 39514 - DNA, 21 bp, Artificial sequence
  SiRNA target sequence
caattagataattccgtagaa

SEQ ID NO: 39515 - DNA, 21 bp, Artificial sequence
  SiRNA target sequence
aattagataattccgtagaaa

SEQ ID NO: 39516 - DNA, 21 bp, Artificial sequence
  SiRNA target sequence
attagataattccgtagaaat

SEQ ID NO: 39517 - DNA, 21 bp, Artificial sequence
  SiRNA target sequence
ttagataattccgtagaaatg

SEQ ID NO: 39518 - DNA, 21 bp, Artificial sequence
  SiRNA target sequence
tagataattccgtagaaatga

SEQ ID NO: 39519 - DNA, 21 bp, Artificial sequence
  SiRNA target sequence
agataattccgtagaaatgac

SEQ ID NO: 39520 - DNA, 21 bp, Artificial sequence
  SiRNA target sequence
gataattccgtagaaatgacc

SEQ ID NO: 39521 - DNA, 21 bp, Artificial sequence
  SiRNA target sequence
ataattccgtagaaatgacca

SEQ ID NO: 39522 - DNA, 21 bp, Artificial sequence
  SiRNA target sequence
taattccgtagaaatgaccat

SEQ ID NO: 39523 - DNA, 21 bp, Artificial sequence
  SiRNA target sequence
aattccgtagaaatgaccata

SEQ ID NO: 39524 - DNA, 21 bp, Artificial sequence
  SiRNA target sequence
attccgtagaaatgaccatac

SEQ ID NO: 39525 - DNA, 21 bp, Artificial sequence
  SiRNA target sequence
ttccgtagaaatgaccatacc

SEQ ID NO: 39526 - DNA, 21 bp, Artificial sequence
  SiRNA target sequence
tccgtagaaatgaccatacca

SEQ ID NO: 39527 - DNA, 21 bp, Artificial sequence
  SiRNA target sequence
ccgtagaaatgaccataccat

SEQ ID NO: 39528 - DNA, 21 bp, Artificial sequence
  SiRNA target sequence
cgtagaaatgaccataccata

SEQ ID NO: 39529 - DNA, 21 bp, Artificial sequence
  SiRNA target sequence
gtagaaatgaccataccatac

SEQ ID NO: 39530 - DNA, 21 bp, Artificial sequence
  SiRNA target sequence
tagaaatgaccataccatacg

SEQ ID NO: 39531 - DNA, 21 bp, Artificial sequence
  SiRNA target sequence
agaaatgaccataccatacgc

SEQ ID NO: 39532 - DNA, 21 bp, Artificial sequence
  SiRNA target sequence
gaaatgaccataccatacgct

SEQ ID NO: 39533 - DNA, 21 bp, Artificial sequence
  SiRNA target sequence
aaatgaccataccatacgctt

SEQ ID NO: 39534 - DNA, 21 bp, Artificial sequence
  SiRNA target sequence
aatgaccataccatacgcttc

SEQ ID NO: 39535 - DNA, 21 bp, Artificial sequence
  SiRNA target sequence
atgaccataccatacgcttct

SEQ ID NO: 39536 - DNA, 21 bp, Artificial sequence
  SiRNA target sequence
tgaccataccatacgcttctt

SEQ ID NO: 39537 - DNA, 21 bp, Artificial sequence
  SiRNA target sequence
gaccataccatacgcttcttt

SEQ ID NO: 39538 - DNA, 21 bp, Artificial sequence
  SiRNA target sequence
accataccatacgcttctttt

SEQ ID NO: 39539 - DNA, 21 bp, Artificial sequence
  SiRNA target sequence
ccataccatacgcttcttttc

SEQ ID NO: 39540 - DNA, 21 bp, Artificial sequence
  SiRNA target sequence
cataccatacgcttcttttca

SEQ ID NO: 39541 - DNA, 21 bp, Artificial sequence
  SiRNA target sequence
ataccatacgcttcttttcaa

SEQ ID NO: 39542 - DNA, 21 bp, Artificial sequence
  SiRNA target sequence
taccatacgcttcttttcaag

SEQ ID NO: 39543 - DNA, 21 bp, Artificial sequence
  SiRNA target sequence
accatacgcttcttttcaaga

SEQ ID NO: 39544 - DNA, 21 bp, Artificial sequence
  SiRNA target sequence
ccatacgcttcttttcaagaa

SEQ ID NO: 39545 - DNA, 21 bp, Artificial sequence
  SiRNA target sequence
catacgcttcttttcaagaag

SEQ ID NO: 39546 - DNA, 21 bp, Artificial sequence
  SiRNA target sequence
atacgcttcttttcaagaagc

SEQ ID NO: 39547 - DNA, 21 bp, Artificial sequence
  SiRNA target sequence
tacgcttcttttcaagaagca

SEQ ID NO: 39548 - DNA, 21 bp, Artificial sequence
  SiRNA target sequence
acgcttcttttcaagaagcat

SEQ ID NO: 39549 - DNA, 21 bp, Artificial sequence
  SiRNA target sequence
cgcttcttttcaagaagcata

SEQ ID NO: 39550 - DNA, 21 bp, Artificial sequence
  SiRNA target sequence
gcttcttttcaagaagcatat

SEQ ID NO: 39551 - DNA, 21 bp, Artificial sequence
  SiRNA target sequence
cttcttttcaagaagcatatg

SEQ ID NO: 39552 - DNA, 21 bp, Artificial sequence
  SiRNA target sequence
ttcttttcaagaagcatatga

SEQ ID NO: 39553 - DNA, 21 bp, Artificial sequence
  SiRNA target sequence
tcttttcaagaagcatatgat

SEQ ID NO: 39554 - DNA, 21 bp, Artificial sequence
  SiRNA target sequence
cttttcaagaagcatatgatt

SEQ ID NO: 39555 - DNA, 21 bp, Artificial sequence
  SiRNA target sequence
ttttcaagaagcatatgattt

SEQ ID NO: 39556 - DNA, 21 bp, Artificial sequence
  SiRNA target sequence
tttcaagaagcatatgattta

SEQ ID NO: 39557 - DNA, 21 bp, Artificial sequence
  SiRNA target sequence
ttcaagaagcatatgatttag

SEQ ID NO: 39558 - DNA, 21 bp, Artificial sequence
  SiRNA target sequence
tcaagaagcatatgatttagt

SEQ ID NO: 39559 - DNA, 21 bp, Artificial sequence
  SiRNA target sequence
caagaagcatatgatttagtc

SEQ ID NO: 39560 - DNA, 21 bp, Artificial sequence
  SiRNA target sequence
aagaagcatatgatttagtca

SEQ ID NO: 39561 - DNA, 21 bp, Artificial sequence
  SiRNA target sequence
agaagcatatgatttagtcac

SEQ ID NO: 39562 - DNA, 21 bp, Artificial sequence
  SiRNA target sequence
gaagcatatgatttagtcaca

SEQ ID NO: 39563 - DNA, 21 bp, Artificial sequence
  SiRNA target sequence
aagcatatgatttagtcacag

SEQ ID NO: 39564 - DNA, 21 bp, Artificial sequence
  SiRNA target sequence
agcatatgatttagtcacagg

SEQ ID NO: 39565 - DNA, 21 bp, Artificial sequence
  SiRNA target sequence
gcatatgatttagtcacaggt

SEQ ID NO: 39566 - DNA, 21 bp, Artificial sequence
  SiRNA target sequence
catatgatttagtcacaggta

SEQ ID NO: 39567 - DNA, 21 bp, Artificial sequence
  SiRNA target sequence
atatgatttagtcacaggtac

SEQ ID NO: 39568 - DNA, 21 bp, Artificial sequence
  SiRNA target sequence
tatgatttagtcacaggtact

SEQ ID NO: 39569 - DNA, 21 bp, Artificial sequence
  SiRNA target sequence
atgatttagtcacaggtactg

SEQ ID NO: 39570 - DNA, 21 bp, Artificial sequence
  SiRNA target sequence
tgatttagtcacaggtactga

SEQ ID NO: 39571 - DNA, 21 bp, Artificial sequence
  SiRNA target sequence
gatttagtcacaggtactgaa

SEQ ID NO: 39572 - DNA, 21 bp, Artificial sequence
  SiRNA target sequence
atttagtcacaggtactgaag

SEQ ID NO: 39573 - DNA, 21 bp, Artificial sequence
  SiRNA target sequence
tttagtcacaggtactgaaga

SEQ ID NO: 39574 - DNA, 21 bp, Artificial sequence
  SiRNA target sequence
ttagtcacaggtactgaagat

SEQ ID NO: 39575 - DNA, 21 bp, Artificial sequence
  SiRNA target sequence
tagtcacaggtactgaagatt

SEQ ID NO: 39576 - DNA, 21 bp, Artificial sequence
  SiRNA target sequence
agtcacaggtactgaagattt

SEQ ID NO: 39577 - DNA, 21 bp, Artificial sequence
  SiRNA target sequence
gtcacaggtactgaagatttt

SEQ ID NO: 39578 - DNA, 21 bp, Artificial sequence
  SiRNA target sequence
tcacaggtactgaagattttg

SEQ ID NO: 39579 - DNA, 21 bp, Artificial sequence
  SiRNA target sequence
cacaggtactgaagattttgt

SEQ ID NO: 39580 - DNA, 21 bp, Artificial sequence
  SiRNA target sequence
acaggtactgaagattttgtc

SEQ ID NO: 39581 - DNA, 21 bp, Artificial sequence
  SiRNA target sequence
caggtactgaagattttgtca

SEQ ID NO: 39582 - DNA, 21 bp, Artificial sequence
  SiRNA target sequence
aggtactgaagattttgtcaa

SEQ ID NO: 39583 - DNA, 21 bp, Artificial sequence
  SiRNA target sequence
ggtactgaagattttgtcaag

SEQ ID NO: 39584 - DNA, 21 bp, Artificial sequence
  SiRNA target sequence
gtactgaagattttgtcaagc

SEQ ID NO: 39585 - DNA, 21 bp, Artificial sequence
  SiRNA target sequence
tactgaagattttgtcaagct

SEQ ID NO: 39586 - DNA, 21 bp, Artificial sequence
  SiRNA target sequence
actgaagattttgtcaagcta

SEQ ID NO: 39587 - DNA, 21 bp, Artificial sequence
  SiRNA target sequence
ctgaagattttgtcaagctat

SEQ ID NO: 39588 - DNA, 21 bp, Artificial sequence
  SiRNA target sequence
tgaagattttgtcaagctata

SEQ ID NO: 39589 - DNA, 21 bp, Artificial sequence
  SiRNA target sequence
gaagattttgtcaagctatat

SEQ ID NO: 39590 - DNA, 21 bp, Artificial sequence
  SiRNA target sequence
aagattttgtcaagctatatc

SEQ ID NO: 39591 - DNA, 21 bp, Artificial sequence
  SiRNA target sequence
agattttgtcaagctatatct

SEQ ID NO: 39592 - DNA, 21 bp, Artificial sequence
  SiRNA target sequence
gattttgtcaagctatatcta

SEQ ID NO: 39593 - DNA, 21 bp, Artificial sequence
  SiRNA target sequence
attttgtcaagctatatctat

SEQ ID NO: 39594 - DNA, 21 bp, Artificial sequence
  SiRNA target sequence
ttttgtcaagctatatctatt

SEQ ID NO: 39595 - DNA, 21 bp, Artificial sequence
  SiRNA target sequence
tttgtcaagctatatctattt

SEQ ID NO: 39596 - DNA, 21 bp, Artificial sequence
  SiRNA target sequence
ttgtcaagctatatctattta

SEQ ID NO: 39597 - DNA, 21 bp, Artificial sequence
  SiRNA target sequence
tgtcaagctatatctatttac

SEQ ID NO: 39598 - DNA, 21 bp, Artificial sequence
  SiRNA target sequence
gtcaagctatatctatttaca

SEQ ID NO: 39599 - DNA, 21 bp, Artificial sequence
  SiRNA target sequence
tcaagctatatctatttacaa

SEQ ID NO: 39600 - DNA, 21 bp, Artificial sequence
  SiRNA target sequence
caagctatatctatttacaat

SEQ ID NO: 39601 - DNA, 21 bp, Artificial sequence
  SiRNA target sequence
aagctatatctatttacaata

SEQ ID NO: 39602 - DNA, 21 bp, Artificial sequence
  SiRNA target sequence
agctatatctatttacaataa

SEQ ID NO: 39603 - DNA, 21 bp, Artificial sequence
  SiRNA target sequence
gctatatctatttacaataac

SEQ ID NO: 39604 - DNA, 21 bp, Artificial sequence
  SiRNA target sequence
ctatatctatttacaataacg

SEQ ID NO: 39605 - DNA, 21 bp, Artificial sequence
  SiRNA target sequence
tatatctatttacaataacgc

SEQ ID NO: 39606 - DNA, 21 bp, Artificial sequence
  SiRNA target sequence
atatctatttacaataacgcc

SEQ ID NO: 39607 - DNA, 21 bp, Artificial sequence
  SiRNA target sequence
tatctatttacaataacgccc

SEQ ID NO: 39608 - DNA, 21 bp, Artificial sequence
  SiRNA target sequence
atctatttacaataacgccca

SEQ ID NO: 39609 - DNA, 21 bp, Artificial sequence
  SiRNA target sequence
tctatttacaataacgcccat

SEQ ID NO: 39610 - DNA, 21 bp, Artificial sequence
  SiRNA target sequence
ctatttacaataacgcccata

SEQ ID NO: 39611 - DNA, 21 bp, Artificial sequence
  SiRNA target sequence
tatttacaataacgcccatat

SEQ ID NO: 39612 - DNA, 21 bp, Artificial sequence
  SiRNA target sequence
atttacaataacgcccatatt

SEQ ID NO: 39613 - DNA, 21 bp, Artificial sequence
  SiRNA target sequence
tttacaataacgcccatatta

SEQ ID NO: 39614 - DNA, 21 bp, Artificial sequence
  SiRNA target sequence
ttacaataacgcccatattat

SEQ ID NO: 39615 - DNA, 21 bp, Artificial sequence
  SiRNA target sequence
tacaataacgcccatattatc

SEQ ID NO: 39616 - DNA, 21 bp, Artificial sequence
  SiRNA target sequence
acaataacgcccatattatcc

SEQ ID NO: 39617 - DNA, 21 bp, Artificial sequence
  SiRNA target sequence
caataacgcccatattatccc

SEQ ID NO: 39618 - DNA, 21 bp, Artificial sequence
  SiRNA target sequence
aataacgcccatattatcccc

SEQ ID NO: 39619 - DNA, 21 bp, Artificial sequence
  SiRNA target sequence
ataacgcccatattatccccg

SEQ ID NO: 39620 - DNA, 21 bp, Artificial sequence
  SiRNA target sequence
taacgcccatattatccccga

SEQ ID NO: 39621 - DNA, 21 bp, Artificial sequence
  SiRNA target sequence
aacgcccatattatccccgac

SEQ ID NO: 39622 - DNA, 21 bp, Artificial sequence
  SiRNA target sequence
acgcccatattatccccgact

SEQ ID NO: 39623 - DNA, 21 bp, Artificial sequence
  SiRNA target sequence
cgcccatattatccccgacta

SEQ ID NO: 39624 - DNA, 21 bp, Artificial sequence
  SiRNA target sequence
gcccatattatccccgactag

SEQ ID NO: 39625 - DNA, 21 bp, Artificial sequence
  SiRNA target sequence
cccatattatccccgactagc

SEQ ID NO: 39626 - DNA, 21 bp, Artificial sequence
  SiRNA target sequence
ccatattatccccgactagca

SEQ ID NO: 39627 - DNA, 21 bp, Artificial sequence
  SiRNA target sequence
catattatccccgactagcac

SEQ ID NO: 39628 - DNA, 21 bp, Artificial sequence
  SiRNA target sequence
atattatccccgactagcaca

SEQ ID NO: 39629 - DNA, 21 bp, Artificial sequence
  SiRNA target sequence
tattatccccgactagcacat

SEQ ID NO: 39630 - DNA, 21 bp, Artificial sequence
  SiRNA target sequence
attatccccgactagcacatc

SEQ ID NO: 39631 - DNA, 21 bp, Artificial sequence
  SiRNA target sequence
ttatccccgactagcacatct

SEQ ID NO: 39632 - DNA, 21 bp, Artificial sequence
  SiRNA target sequence
tatccccgactagcacatctg

SEQ ID NO: 39633 - DNA, 21 bp, Artificial sequence
  SiRNA target sequence
atccccgactagcacatctgc

SEQ ID NO: 39634 - DNA, 21 bp, Artificial sequence
  SiRNA target sequence
tccccgactagcacatctgct

SEQ ID NO: 39635 - DNA, 21 bp, Artificial sequence
  SiRNA target sequence
ccccgactagcacatctgcta

SEQ ID NO: 39636 - DNA, 21 bp, Artificial sequence
  SiRNA target sequence
cccgactagcacatctgctag

SEQ ID NO: 39637 - DNA, 21 bp, Artificial sequence
  SiRNA target sequence
ccgactagcacatctgctagt

SEQ ID NO: 39638 - DNA, 21 bp, Artificial sequence
  SiRNA target sequence
cgactagcacatctgctagtt

SEQ ID NO: 39639 - DNA, 21 bp, Artificial sequence
  SiRNA target sequence
gactagcacatctgctagttc

SEQ ID NO: 39640 - DNA, 21 bp, Artificial sequence
  SiRNA target sequence
actagcacatctgctagttca

SEQ ID NO: 39641 - DNA, 21 bp, Artificial sequence
  SiRNA target sequence
ctagcacatctgctagttcaa

SEQ ID NO: 39642 - DNA, 21 bp, Artificial sequence
  SiRNA target sequence
tagcacatctgctagttcaaa

SEQ ID NO: 39643 - DNA, 21 bp, Artificial sequence
  SiRNA target sequence
agcacatctgctagttcaaag

SEQ ID NO: 39644 - DNA, 21 bp, Artificial sequence
  SiRNA target sequence
gcacatctgctagttcaaagg

SEQ ID NO: 39645 - DNA, 21 bp, Artificial sequence
  SiRNA target sequence
cacatctgctagttcaaaggt

SEQ ID NO: 39646 - DNA, 21 bp, Artificial sequence
  SiRNA target sequence
acatctgctagttcaaaggtg

SEQ ID NO: 39647 - DNA, 21 bp, Artificial sequence
  SiRNA target sequence
catctgctagttcaaaggtgg

SEQ ID NO: 39648 - DNA, 21 bp, Artificial sequence
  SiRNA target sequence
atctgctagttcaaaggtgga

SEQ ID NO: 39649 - DNA, 21 bp, Artificial sequence
  SiRNA target sequence
tctgctagttcaaaggtggac

SEQ ID NO: 39650 - DNA, 21 bp, Artificial sequence
  SiRNA target sequence
ctgctagttcaaaggtggacc

SEQ ID NO: 39651 - DNA, 21 bp, Artificial sequence
  SiRNA target sequence
tgctagttcaaaggtggacct

SEQ ID NO: 39652 - DNA, 21 bp, Artificial sequence
  SiRNA target sequence
gctagttcaaaggtggacctt

SEQ ID NO: 39653 - DNA, 21 bp, Artificial sequence
  SiRNA target sequence
ctagttcaaaggtggaccttt

SEQ ID NO: 39654 - DNA, 21 bp, Artificial sequence
  SiRNA target sequence
tagttcaaaggtggacctttc

SEQ ID NO: 39655 - DNA, 21 bp, Artificial sequence
  SiRNA target sequence
agttcaaaggtggacctttca

SEQ ID NO: 39656 - DNA, 21 bp, Artificial sequence
  SiRNA target sequence
gttcaaaggtggacctttcag

SEQ ID NO: 39657 - DNA, 21 bp, Artificial sequence
  SiRNA target sequence
ttcaaaggtggacctttcagt

SEQ ID NO: 39658 - DNA, 21 bp, Artificial sequence
  SiRNA target sequence
tcaaaggtggacctttcagtt

SEQ ID NO: 39659 - DNA, 21 bp, Artificial sequence
  SiRNA target sequence
caaaggtggacctttcagttt

SEQ ID NO: 39660 - DNA, 21 bp, Artificial sequence
  SiRNA target sequence
aaaggtggacctttcagttta

SEQ ID NO: 39661 - DNA, 21 bp, Artificial sequence
  SiRNA target sequence
aaggtggacctttcagtttat

SEQ ID NO: 39662 - DNA, 21 bp, Artificial sequence
  SiRNA target sequence
aggtggacctttcagtttata

SEQ ID NO: 39663 - DNA, 21 bp, Artificial sequence
  SiRNA target sequence
ggtggacctttcagtttatat

SEQ ID NO: 39664 - DNA, 21 bp, Artificial sequence
  SiRNA target sequence
gtggacctttcagtttatatg

SEQ ID NO: 39665 - DNA, 21 bp, Artificial sequence
  SiRNA target sequence
tggacctttcagtttatatgt

SEQ ID NO: 39666 - DNA, 21 bp, Artificial sequence
  SiRNA target sequence
ggacctttcagtttatatgtg

SEQ ID NO: 39667 - DNA, 21 bp, Artificial sequence
  SiRNA target sequence
gacctttcagtttatatgtgg

SEQ ID NO: 39668 - DNA, 21 bp, Artificial sequence
  SiRNA target sequence
acctttcagtttatatgtggt

SEQ ID NO: 39669 - DNA, 21 bp, Artificial sequence
  SiRNA target sequence
cctttcagtttatatgtggtt

SEQ ID NO: 39670 - DNA, 21 bp, Artificial sequence
  SiRNA target sequence
ctttcagtttatatgtggttg

SEQ ID NO: 39671 - DNA, 21 bp, Artificial sequence
  SiRNA target sequence
tttcagtttatatgtggttgg

SEQ ID NO: 39672 - DNA, 21 bp, Artificial sequence
  SiRNA target sequence
ttcagtttatatgtggttgga

SEQ ID NO: 39673 - DNA, 21 bp, Artificial sequence
  SiRNA target sequence
tcagtttatatgtggttggat

SEQ ID NO: 39674 - DNA, 21 bp, Artificial sequence
  SiRNA target sequence
cagtttatatgtggttggata

SEQ ID NO: 39675 - DNA, 21 bp, Artificial sequence
  SiRNA target sequence
agtttatatgtggttggataa

SEQ ID NO: 39676 - DNA, 21 bp, Artificial sequence
  SiRNA target sequence
gtttatatgtggttggataat

SEQ ID NO: 39677 - DNA, 21 bp, Artificial sequence
  SiRNA target sequence
tttatatgtggttggataata

SEQ ID NO: 39678 - DNA, 21 bp, Artificial sequence
  SiRNA target sequence
ttatatgtggttggataatat

SEQ ID NO: 39679 - DNA, 21 bp, Artificial sequence
  SiRNA target sequence
tatatgtggttggataatatt

SEQ ID NO: 39680 - DNA, 21 bp, Artificial sequence
  SiRNA target sequence
atatgtggttggataatattt

SEQ ID NO: 39681 - DNA, 21 bp, Artificial sequence
  SiRNA target sequence
tatgtggttggataatatttc

SEQ ID NO: 39682 - DNA, 21 bp, Artificial sequence
  SiRNA target sequence
atgtggttggataatatttcc

SEQ ID NO: 39683 - DNA, 21 bp, Artificial sequence
  SiRNA target sequence
tgtggttggataatatttcct

SEQ ID NO: 39684 - DNA, 21 bp, Artificial sequence
  SiRNA target sequence
gtggttggataatatttcctt

SEQ ID NO: 39685 - DNA, 21 bp, Artificial sequence
  SiRNA target sequence
tggttggataatatttcctta

SEQ ID NO: 39686 - DNA, 21 bp, Artificial sequence
  SiRNA target sequence
ggttggataatatttccttag

SEQ ID NO: 39687 - DNA, 21 bp, Artificial sequence
  SiRNA target sequence
gttggataatatttccttagt

SEQ ID NO: 39688 - DNA, 21 bp, Artificial sequence
  SiRNA target sequence
ttggataatatttccttagtc

SEQ ID NO: 39689 - DNA, 21 bp, Artificial sequence
  SiRNA target sequence
tggataatatttccttagtca

SEQ ID NO: 39690 - DNA, 21 bp, Artificial sequence
  SiRNA target sequence
ggataatatttccttagtcat

SEQ ID NO: 39691 - DNA, 21 bp, Artificial sequence
  SiRNA target sequence
gataatatttccttagtcata

SEQ ID NO: 39692 - DNA, 21 bp, Artificial sequence
  SiRNA target sequence
ataatatttccttagtcatac

SEQ ID NO: 39693 - DNA, 21 bp, Artificial sequence
  SiRNA target sequence
taatatttccttagtcatacc

SEQ ID NO: 39694 - DNA, 21 bp, Artificial sequence
  SiRNA target sequence
aatatttccttagtcataccc

SEQ ID NO: 39695 - DNA, 21 bp, Artificial sequence
  SiRNA target sequence
atatttccttagtcataccca

SEQ ID NO: 39696 - DNA, 21 bp, Artificial sequence
  SiRNA target sequence
tatttccttagtcatacccac

SEQ ID NO: 39697 - DNA, 21 bp, Artificial sequence
  SiRNA target sequence
atttccttagtcatacccacg

SEQ ID NO: 39698 - DNA, 21 bp, Artificial sequence
  SiRNA target sequence
tttccttagtcatacccacgt

SEQ ID NO: 39699 - DNA, 21 bp, Artificial sequence
  SiRNA target sequence
ttccttagtcatacccacgta

SEQ ID NO: 39700 - DNA, 21 bp, Artificial sequence
  SiRNA target sequence
tccttagtcatacccacgtat

SEQ ID NO: 39701 - DNA, 21 bp, Artificial sequence
  SiRNA target sequence
ccttagtcatacccacgtatc

SEQ ID NO: 39702 - DNA, 21 bp, Artificial sequence
  SiRNA target sequence
cttagtcatacccacgtatcg

SEQ ID NO: 39703 - DNA, 21 bp, Artificial sequence
  SiRNA target sequence
ttagtcatacccacgtatcgc

SEQ ID NO: 39704 - DNA, 21 bp, Artificial sequence
  SiRNA target sequence
tagtcatacccacgtatcgcg

SEQ ID NO: 39705 - DNA, 21 bp, Artificial sequence
  SiRNA target sequence
agtcatacccacgtatcgcgt

SEQ ID NO: 39706 - DNA, 21 bp, Artificial sequence
  SiRNA target sequence
gtcatacccacgtatcgcgtt

SEQ ID NO: 39707 - DNA, 21 bp, Artificial sequence
  SiRNA target sequence
tcatacccacgtatcgcgtta

SEQ ID NO: 39708 - DNA, 21 bp, Artificial sequence
  SiRNA target sequence
catacccacgtatcgcgttaa

SEQ ID NO: 39709 - DNA, 21 bp, Artificial sequence
  SiRNA target sequence
atacccacgtatcgcgttaac

SEQ ID NO: 39710 - DNA, 21 bp, Artificial sequence
  SiRNA target sequence
tacccacgtatcgcgttaaca

SEQ ID NO: 39711 - DNA, 21 bp, Artificial sequence
  SiRNA target sequence
acccacgtatcgcgttaacac

SEQ ID NO: 39712 - DNA, 21 bp, Artificial sequence
  SiRNA target sequence
cccacgtatcgcgttaacacg

SEQ ID NO: 39713 - DNA, 21 bp, Artificial sequence
  SiRNA target sequence
ccacgtatcgcgttaacacga

SEQ ID NO: 39714 - DNA, 21 bp, Artificial sequence
  SiRNA target sequence
cacgtatcgcgttaacacgag

SEQ ID NO: 39715 - DNA, 21 bp, Artificial sequence
  SiRNA target sequence
acgtatcgcgttaacacgagc

SEQ ID NO: 39716 - DNA, 21 bp, Artificial sequence
  SiRNA target sequence
cgtatcgcgttaacacgagca

SEQ ID NO: 39717 - DNA, 21 bp, Artificial sequence
  SiRNA target sequence
gtatcgcgttaacacgagcat

SEQ ID NO: 39718 - DNA, 21 bp, Artificial sequence
  SiRNA target sequence
tatcgcgttaacacgagcatc

SEQ ID NO: 39719 - DNA, 21 bp, Artificial sequence
  SiRNA target sequence
atcgcgttaacacgagcatcg

SEQ ID NO: 39720 - DNA, 21 bp, Artificial sequence
  SiRNA target sequence
tcgcgttaacacgagcatcgt

SEQ ID NO: 39721 - DNA, 21 bp, Artificial sequence
  SiRNA target sequence
cgcgttaacacgagcatcgta

SEQ ID NO: 39722 - DNA, 21 bp, Artificial sequence
  SiRNA target sequence
gcgttaacacgagcatcgtac

SEQ ID NO: 39723 - DNA, 21 bp, Artificial sequence
  SiRNA target sequence
cgttaacacgagcatcgtacc

SEQ ID NO: 39724 - DNA, 21 bp, Artificial sequence
  SiRNA target sequence
gttaacacgagcatcgtacca

SEQ ID NO: 39725 - DNA, 21 bp, Artificial sequence
  SiRNA target sequence
ttaacacgagcatcgtaccaa

SEQ ID NO: 39726 - DNA, 21 bp, Artificial sequence
  SiRNA target sequence
taacacgagcatcgtaccaaa

SEQ ID NO: 39727 - DNA, 21 bp, Artificial sequence
  SiRNA target sequence
aacacgagcatcgtaccaaat

SEQ ID NO: 39728 - DNA, 21 bp, Artificial sequence
  SiRNA target sequence
acacgagcatcgtaccaaatg

SEQ ID NO: 39729 - DNA, 21 bp, Artificial sequence
  SiRNA target sequence
cacgagcatcgtaccaaatgt

SEQ ID NO: 39730 - DNA, 21 bp, Artificial sequence
  SiRNA target sequence
acgagcatcgtaccaaatgtg

SEQ ID NO: 39731 - DNA, 21 bp, Artificial sequence
  SiRNA target sequence
cgagcatcgtaccaaatgtgg

SEQ ID NO: 39732 - DNA, 21 bp, Artificial sequence
  SiRNA target sequence
gagcatcgtaccaaatgtggg

SEQ ID NO: 39733 - DNA, 21 bp, Artificial sequence
  SiRNA target sequence
agcatcgtaccaaatgtgggg

SEQ ID NO: 39734 - DNA, 21 bp, Artificial sequence
  SiRNA target sequence
gcatcgtaccaaatgtgggga

SEQ ID NO: 39735 - DNA, 21 bp, Artificial sequence
  SiRNA target sequence
catcgtaccaaatgtggggac

SEQ ID NO: 39736 - DNA, 21 bp, Artificial sequence
  SiRNA target sequence
atcgtaccaaatgtggggact

SEQ ID NO: 39737 - DNA, 21 bp, Artificial sequence
  SiRNA target sequence
tcgtaccaaatgtggggactg

SEQ ID NO: 39738 - DNA, 21 bp, Artificial sequence
  SiRNA target sequence
cgtaccaaatgtggggactgt

SEQ ID NO: 39739 - DNA, 21 bp, Artificial sequence
  SiRNA target sequence
gtaccaaatgtggggactgtt

SEQ ID NO: 39740 - DNA, 21 bp, Artificial sequence
  SiRNA target sequence
taccaaatgtggggactgttg

SEQ ID NO: 39741 - DNA, 21 bp, Artificial sequence
  SiRNA target sequence
accaaatgtggggactgttgt

SEQ ID NO: 39742 - DNA, 21 bp, Artificial sequence
  SiRNA target sequence
ccaaatgtggggactgttgtt

SEQ ID NO: 39743 - DNA, 21 bp, Artificial sequence
  SiRNA target sequence
caaatgtggggactgttgttc

SEQ ID NO: 39744 - DNA, 21 bp, Artificial sequence
  SiRNA target sequence
aaatgtggggactgttgttca

SEQ ID NO: 39745 - DNA, 21 bp, Artificial sequence
  SiRNA target sequence
aatgtggggactgttgttcag

SEQ ID NO: 39746 - DNA, 21 bp, Artificial sequence
  SiRNA target sequence
atgtggggactgttgttcaga

SEQ ID NO: 39747 - DNA, 21 bp, Artificial sequence
  SiRNA target sequence
tgtggggactgttgttcagac

SEQ ID NO: 39748 - DNA, 21 bp, Artificial sequence
  SiRNA target sequence
gtggggactgttgttcagaca

SEQ ID NO: 39749 - DNA, 21 bp, Artificial sequence
  SiRNA target sequence
tggggactgttgttcagacag

SEQ ID NO: 39750 - DNA, 21 bp, Artificial sequence
  SiRNA target sequence
ggggactgttgttcagacagt

SEQ ID NO: 39751 - DNA, 21 bp, Artificial sequence
  SiRNA target sequence
gggactgttgttcagacagta

SEQ ID NO: 39752 - DNA, 21 bp, Artificial sequence
  SiRNA target sequence
ggactgttgttcagacagtac

SEQ ID NO: 39753 - DNA, 21 bp, Artificial sequence
  SiRNA target sequence
gactgttgttcagacagtaca

SEQ ID NO: 39754 - DNA, 21 bp, Artificial sequence
  SiRNA target sequence
actgttgttcagacagtacaa

SEQ ID NO: 39755 - DNA, 21 bp, Artificial sequence
  SiRNA target sequence
ctgttgttcagacagtacaaa

SEQ ID NO: 39756 - DNA, 21 bp, Artificial sequence
  SiRNA target sequence
tgttgttcagacagtacaaaa

SEQ ID NO: 39757 - DNA, 21 bp, Artificial sequence
  SiRNA target sequence
gttgttcagacagtacaaaat

SEQ ID NO: 39758 - DNA, 21 bp, Artificial sequence
  SiRNA target sequence
ttgttcagacagtacaaaata

SEQ ID NO: 39759 - DNA, 21 bp, Artificial sequence
  SiRNA target sequence
tgttcagacagtacaaaatat

SEQ ID NO: 39760 - DNA, 21 bp, Artificial sequence
  SiRNA target sequence
gttcagacagtacaaaatatg

SEQ ID NO: 39761 - DNA, 21 bp, Artificial sequence
  SiRNA target sequence
ttcagacagtacaaaatatga

SEQ ID NO: 39762 - DNA, 21 bp, Artificial sequence
  SiRNA target sequence
tcagacagtacaaaatatgac

SEQ ID NO: 39763 - DNA, 21 bp, Artificial sequence
  SiRNA target sequence
cagacagtacaaaatatgact

SEQ ID NO: 39764 - DNA, 21 bp, Artificial sequence
  SiRNA target sequence
agacagtacaaaatatgacta

SEQ ID NO: 39765 - DNA, 21 bp, Artificial sequence
  SiRNA target sequence
gacagtacaaaatatgactac

SEQ ID NO: 39766 - DNA, 21 bp, Artificial sequence
  SiRNA target sequence
acagtacaaaatatgactaca

SEQ ID NO: 39767 - DNA, 21 bp, Artificial sequence
  SiRNA target sequence
cagtacaaaatatgactacac

SEQ ID NO: 39768 - DNA, 21 bp, Artificial sequence
  SiRNA target sequence
agtacaaaatatgactacacg

SEQ ID NO: 39769 - DNA, 21 bp, Artificial sequence
  SiRNA target sequence
gtacaaaatatgactacacga

SEQ ID NO: 39770 - DNA, 21 bp, Artificial sequence
  SiRNA target sequence
tacaaaatatgactacacgag

SEQ ID NO: 39771 - DNA, 21 bp, Artificial sequence
  SiRNA target sequence
acaaaatatgactacacgaga

SEQ ID NO: 39772 - DNA, 21 bp, Artificial sequence
  SiRNA target sequence
caaaatatgactacacgagac

SEQ ID NO: 39773 - DNA, 21 bp, Artificial sequence
  SiRNA target sequence
aaaatatgactacacgagaca

SEQ ID NO: 39774 - DNA, 21 bp, Artificial sequence
  SiRNA target sequence
aaatatgactacacgagacag

SEQ ID NO: 39775 - DNA, 21 bp, Artificial sequence
  SiRNA target sequence
aatatgactacacgagacagt

SEQ ID NO: 39776 - DNA, 21 bp, Artificial sequence
  SiRNA target sequence
atatgactacacgagacagtg

SEQ ID NO: 39777 - DNA, 21 bp, Artificial sequence
  SiRNA target sequence
tatgactacacgagacagtga

SEQ ID NO: 39778 - DNA, 21 bp, Artificial sequence
  SiRNA target sequence
atgactacacgagacagtgaa

SEQ ID NO: 39779 - DNA, 21 bp, Artificial sequence
  SiRNA target sequence
tgactacacgagacagtgaaa

SEQ ID NO: 39780 - DNA, 21 bp, Artificial sequence
  SiRNA target sequence
gactacacgagacagtgaaac

SEQ ID NO: 39781 - DNA, 21 bp, Artificial sequence
  SiRNA target sequence
actacacgagacagtgaaaca

SEQ ID NO: 39782 - DNA, 21 bp, Artificial sequence
  SiRNA target sequence
ctacacgagacagtgaaacaa

SEQ ID NO: 39783 - DNA, 21 bp, Artificial sequence
  SiRNA target sequence
tacacgagacagtgaaacaat

SEQ ID NO: 39784 - DNA, 21 bp, Artificial sequence
  SiRNA target sequence
acacgagacagtgaaacaatt

SEQ ID NO: 39785 - DNA, 21 bp, Artificial sequence
  SiRNA target sequence
cacgagacagtgaaacaatta

SEQ ID NO: 39786 - DNA, 21 bp, Artificial sequence
  SiRNA target sequence
acgagacagtgaaacaattag

SEQ ID NO: 39787 - DNA, 21 bp, Artificial sequence
  SiRNA target sequence
cgagacagtgaaacaattagg

SEQ ID NO: 39788 - DNA, 21 bp, Artificial sequence
  SiRNA target sequence
gagacagtgaaacaattagga

SEQ ID NO: 39789 - DNA, 21 bp, Artificial sequence
  SiRNA target sequence
agacagtgaaacaattaggaa

SEQ ID NO: 39790 - DNA, 21 bp, Artificial sequence
  SiRNA target sequence
gacagtgaaacaattaggaaa

SEQ ID NO: 39791 - DNA, 21 bp, Artificial sequence
  SiRNA target sequence
acagtgaaacaattaggaaag

SEQ ID NO: 39792 - DNA, 21 bp, Artificial sequence
  SiRNA target sequence
cagtgaaacaattaggaaagc

SEQ ID NO: 39793 - DNA, 21 bp, Artificial sequence
  SiRNA target sequence
agtgaaacaattaggaaagca

SEQ ID NO: 39794 - DNA, 21 bp, Artificial sequence
  SiRNA target sequence
gtgaaacaattaggaaagcaa

SEQ ID NO: 39795 - DNA, 21 bp, Artificial sequence
  SiRNA target sequence
tgaaacaattaggaaagcaat

SEQ ID NO: 39796 - DNA, 21 bp, Artificial sequence
  SiRNA target sequence
gaaacaattaggaaagcaatg

SEQ ID NO: 39797 - DNA, 21 bp, Artificial sequence
  SiRNA target sequence
aaacaattaggaaagcaatgg

SEQ ID NO: 39798 - DNA, 21 bp, Artificial sequence
  SiRNA target sequence
aacaattaggaaagcaatggt

SEQ ID NO: 39799 - DNA, 21 bp, Artificial sequence
  SiRNA target sequence
acaattaggaaagcaatggtt

SEQ ID NO: 39800 - DNA, 21 bp, Artificial sequence
  SiRNA target sequence
caattaggaaagcaatggttg

SEQ ID NO: 39801 - DNA, 21 bp, Artificial sequence
  SiRNA target sequence
aattaggaaagcaatggttgc

SEQ ID NO: 39802 - DNA, 21 bp, Artificial sequence
  SiRNA target sequence
attaggaaagcaatggttgca

SEQ ID NO: 39803 - DNA, 21 bp, Artificial sequence
  SiRNA target sequence
ttaggaaagcaatggttgcat

SEQ ID NO: 39804 - DNA, 21 bp, Artificial sequence
  SiRNA target sequence
taggaaagcaatggttgcatt

SEQ ID NO: 39805 - DNA, 21 bp, Artificial sequence
  SiRNA target sequence
aggaaagcaatggttgcatta

SEQ ID NO: 39806 - DNA, 21 bp, Artificial sequence
  SiRNA target sequence
ggaaagcaatggttgcattaa

SEQ ID NO: 39807 - DNA, 21 bp, Artificial sequence
  SiRNA target sequence
gaaagcaatggttgcattaag

SEQ ID NO: 39808 - DNA, 21 bp, Artificial sequence
  SiRNA target sequence
aaagcaatggttgcattaagg

SEQ ID NO: 39809 - DNA, 21 bp, Artificial sequence
  SiRNA target sequence
aagcaatggttgcattaagga

SEQ ID NO: 39810 - DNA, 21 bp, Artificial sequence
  SiRNA target sequence
agcaatggttgcattaaggaa

SEQ ID NO: 39811 - DNA, 21 bp, Artificial sequence
  SiRNA target sequence
gcaatggttgcattaaggaaa

SEQ ID NO: 39812 - DNA, 21 bp, Artificial sequence
  SiRNA target sequence
caatggttgcattaaggaaaa

SEQ ID NO: 39813 - DNA, 21 bp, Artificial sequence
  SiRNA target sequence
aatggttgcattaaggaaaaa

SEQ ID NO: 39814 - DNA, 21 bp, Artificial sequence
  SiRNA target sequence
atggttgcattaaggaaaaat

SEQ ID NO: 39815 - DNA, 21 bp, Artificial sequence
  SiRNA target sequence
tggttgcattaaggaaaaata

SEQ ID NO: 39816 - DNA, 21 bp, Artificial sequence
  SiRNA target sequence
ggttgcattaaggaaaaataa

SEQ ID NO: 39817 - DNA, 21 bp, Artificial sequence
  SiRNA target sequence
gttgcattaaggaaaaataat

SEQ ID NO: 39818 - DNA, 21 bp, Artificial sequence
  SiRNA target sequence
ttgcattaaggaaaaataata

SEQ ID NO: 39819 - DNA, 21 bp, Artificial sequence
  SiRNA target sequence
tgcattaaggaaaaataataa

SEQ ID NO: 39820 - DNA, 21 bp, Artificial sequence
  SiRNA target sequence
gcattaaggaaaaataataaa

SEQ ID NO: 39821 - DNA, 21 bp, Artificial sequence
  SiRNA target sequence
cattaaggaaaaataataaat

SEQ ID NO: 39822 - DNA, 21 bp, Artificial sequence
  SiRNA target sequence
attaaggaaaaataataaatc

SEQ ID NO: 39823 - DNA, 21 bp, Artificial sequence
  SiRNA target sequence
ttaaggaaaaataataaatca

SEQ ID NO: 39824 - DNA, 21 bp, Artificial sequence
  SiRNA target sequence
taaggaaaaataataaatcaa

SEQ ID NO: 39825 - DNA, 21 bp, Artificial sequence
  SiRNA target sequence
aaggaaaaataataaatcaac

SEQ ID NO: 39826 - DNA, 21 bp, Artificial sequence
  SiRNA target sequence
aggaaaaataataaatcaact

SEQ ID NO: 39827 - DNA, 21 bp, Artificial sequence
  SiRNA target sequence
ggaaaaataataaatcaactt

SEQ ID NO: 39828 - DNA, 21 bp, Artificial sequence
  SiRNA target sequence
gaaaaataataaatcaactta

SEQ ID NO: 39829 - DNA, 21 bp, Artificial sequence
  SiRNA target sequence
aaaaataataaatcaacttac

SEQ ID NO: 39830 - DNA, 21 bp, Artificial sequence
  SiRNA target sequence
aaaataataaatcaacttacg

SEQ ID NO: 39831 - DNA, 21 bp, Artificial sequence
  SiRNA target sequence
aaataataaatcaacttacga

SEQ ID NO: 39832 - DNA, 21 bp, Artificial sequence
  SiRNA target sequence
aataataaatcaacttacgac

SEQ ID NO: 39833 - DNA, 21 bp, Artificial sequence
  SiRNA target sequence
ataataaatcaacttacgact

SEQ ID NO: 39834 - DNA, 21 bp, Artificial sequence
  SiRNA target sequence
taataaatcaacttacgacta

SEQ ID NO: 39835 - DNA, 21 bp, Artificial sequence
  SiRNA target sequence
aataaatcaacttacgactat

SEQ ID NO: 39836 - DNA, 21 bp, Artificial sequence
  SiRNA target sequence
ataaatcaacttacgactata

SEQ ID NO: 39837 - DNA, 21 bp, Artificial sequence
  SiRNA target sequence
taaatcaacttacgactatat

SEQ ID NO: 39838 - DNA, 21 bp, Artificial sequence
  SiRNA target sequence
aaatcaacttacgactatata

SEQ ID NO: 39839 - DNA, 21 bp, Artificial sequence
  SiRNA target sequence
aatcaacttacgactatatag

SEQ ID NO: 39840 - DNA, 21 bp, Artificial sequence
  SiRNA target sequence
atcaacttacgactatatagt

SEQ ID NO: 39841 - DNA, 21 bp, Artificial sequence
  SiRNA target sequence
tcaacttacgactatatagtg

SEQ ID NO: 39842 - DNA, 21 bp, Artificial sequence
  SiRNA target sequence
caacttacgactatatagtgc

SEQ ID NO: 39843 - DNA, 21 bp, Artificial sequence
  SiRNA target sequence
aacttacgactatatagtgca

SEQ ID NO: 39844 - DNA, 21 bp, Artificial sequence
  SiRNA target sequence
acttacgactatatagtgcaa

SEQ ID NO: 39845 - DNA, 21 bp, Artificial sequence
  SiRNA target sequence
cttacgactatatagtgcaag

SEQ ID NO: 39846 - DNA, 21 bp, Artificial sequence
  SiRNA target sequence
ttacgactatatagtgcaagc

SEQ ID NO: 39847 - DNA, 21 bp, Artificial sequence
  SiRNA target sequence
tacgactatatagtgcaagct

SEQ ID NO: 39848 - DNA, 21 bp, Artificial sequence
  SiRNA target sequence
acgactatatagtgcaagctt

SEQ ID NO: 39849 - DNA, 21 bp, Artificial sequence
  SiRNA target sequence
cgactatatagtgcaagcttt

SEQ ID NO: 39850 - DNA, 21 bp, Artificial sequence
  SiRNA target sequence
gactatatagtgcaagcttta

SEQ ID NO: 39851 - DNA, 21 bp, Artificial sequence
  SiRNA target sequence
actatatagtgcaagctttat

SEQ ID NO: 39852 - DNA, 21 bp, Artificial sequence
  SiRNA target sequence
ctatatagtgcaagctttatc

SEQ ID NO: 39853 - DNA, 21 bp, Artificial sequence
  SiRNA target sequence
tatatagtgcaagctttatct

SEQ ID NO: 39854 - DNA, 21 bp, Artificial sequence
  SiRNA target sequence
atatagtgcaagctttatctt

SEQ ID NO: 39855 - DNA, 21 bp, Artificial sequence
  SiRNA target sequence
tatagtgcaagctttatcttc

SEQ ID NO: 39856 - DNA, 21 bp, Artificial sequence
  SiRNA target sequence
atagtgcaagctttatcttct

SEQ ID NO: 39857 - DNA, 21 bp, Artificial sequence
  SiRNA target sequence
tagtgcaagctttatcttctg

SEQ ID NO: 39858 - DNA, 21 bp, Artificial sequence
  SiRNA target sequence
agtgcaagctttatcttctgc

SEQ ID NO: 39859 - DNA, 21 bp, Artificial sequence
  SiRNA target sequence
gtgcaagctttatcttctgca

SEQ ID NO: 39860 - DNA, 21 bp, Artificial sequence
  SiRNA target sequence
tgcaagctttatcttctgcag

SEQ ID NO: 39861 - DNA, 21 bp, Artificial sequence
  SiRNA target sequence
gcaagctttatcttctgcagt

SEQ ID NO: 39862 - DNA, 21 bp, Artificial sequence
  SiRNA target sequence
caagctttatcttctgcagtt

SEQ ID NO: 39863 - DNA, 21 bp, Artificial sequence
  SiRNA target sequence
aagctttatcttctgcagttc

SEQ ID NO: 39864 - DNA, 21 bp, Artificial sequence
  SiRNA target sequence
agctttatcttctgcagttcc

SEQ ID NO: 39865 - DNA, 21 bp, Artificial sequence
  SiRNA target sequence
gctttatcttctgcagttcca

SEQ ID NO: 39866 - DNA, 21 bp, Artificial sequence
  SiRNA target sequence
ctttatcttctgcagttccag

SEQ ID NO: 39867 - DNA, 21 bp, Artificial sequence
  SiRNA target sequence
tttatcttctgcagttccaga

SEQ ID NO: 39868 - DNA, 21 bp, Artificial sequence
  SiRNA target sequence
ttatcttctgcagttccagaa

SEQ ID NO: 39869 - DNA, 21 bp, Artificial sequence
  SiRNA target sequence
tatcttctgcagttccagaag

SEQ ID NO: 39870 - DNA, 21 bp, Artificial sequence
  SiRNA target sequence
atcttctgcagttccagaagt

SEQ ID NO: 39871 - DNA, 21 bp, Artificial sequence
  SiRNA target sequence
tcttctgcagttccagaagtt

SEQ ID NO: 39872 - DNA, 21 bp, Artificial sequence
  SiRNA target sequence
cttctgcagttccagaagtta

SEQ ID NO: 39873 - DNA, 21 bp, Artificial sequence
  SiRNA target sequence
ttctgcagttccagaagttaa

SEQ ID NO: 39874 - DNA, 21 bp, Artificial sequence
  SiRNA target sequence
tctgcagttccagaagttaag

SEQ ID NO: 39875 - DNA, 21 bp, Artificial sequence
  SiRNA target sequence
ctgcagttccagaagttaaga

SEQ ID NO: 39876 - DNA, 21 bp, Artificial sequence
  SiRNA target sequence
tgcagttccagaagttaagaa

SEQ ID NO: 39877 - DNA, 21 bp, Artificial sequence
  SiRNA target sequence
gcagttccagaagttaagaat

SEQ ID NO: 39878 - DNA, 21 bp, Artificial sequence
  SiRNA target sequence
cagttccagaagttaagaatg

SEQ ID NO: 39879 - DNA, 21 bp, Artificial sequence
  SiRNA target sequence
agttccagaagttaagaatgt

SEQ ID NO: 39880 - DNA, 21 bp, Artificial sequence
  SiRNA target sequence
gttccagaagttaagaatgta

SEQ ID NO: 39881 - DNA, 21 bp, Artificial sequence
  SiRNA target sequence
ttccagaagttaagaatgtaa

SEQ ID NO: 39882 - DNA, 21 bp, Artificial sequence
  SiRNA target sequence
tccagaagttaagaatgtaac

SEQ ID NO: 39883 - DNA, 21 bp, Artificial sequence
  SiRNA target sequence
ccagaagttaagaatgtaact

SEQ ID NO: 39884 - DNA, 21 bp, Artificial sequence
  SiRNA target sequence
cagaagttaagaatgtaacta

SEQ ID NO: 39885 - DNA, 21 bp, Artificial sequence
  SiRNA target sequence
agaagttaagaatgtaactat

SEQ ID NO: 39886 - DNA, 21 bp, Artificial sequence
  SiRNA target sequence
gaagttaagaatgtaactatg

SEQ ID NO: 39887 - DNA, 21 bp, Artificial sequence
  SiRNA target sequence
aagttaagaatgtaactatgc

SEQ ID NO: 39888 - DNA, 21 bp, Artificial sequence
  SiRNA target sequence
agttaagaatgtaactatgca

SEQ ID NO: 39889 - DNA, 21 bp, Artificial sequence
  SiRNA target sequence
gttaagaatgtaactatgcag

SEQ ID NO: 39890 - DNA, 21 bp, Artificial sequence
  SiRNA target sequence
ttaagaatgtaactatgcaga

SEQ ID NO: 39891 - DNA, 21 bp, Artificial sequence
  SiRNA target sequence
taagaatgtaactatgcagat

SEQ ID NO: 39892 - DNA, 21 bp, Artificial sequence
  SiRNA target sequence
aagaatgtaactatgcagatc

SEQ ID NO: 39893 - DNA, 21 bp, Artificial sequence
  SiRNA target sequence
agaatgtaactatgcagatca

SEQ ID NO: 39894 - DNA, 21 bp, Artificial sequence
  SiRNA target sequence
gaatgtaactatgcagatcaa

SEQ ID NO: 39895 - DNA, 21 bp, Artificial sequence
  SiRNA target sequence
aatgtaactatgcagatcaat

SEQ ID NO: 39896 - DNA, 21 bp, Artificial sequence
  SiRNA target sequence
atgtaactatgcagatcaatt

SEQ ID NO: 39897 - DNA, 21 bp, Artificial sequence
  SiRNA target sequence
tgtaactatgcagatcaattc

SEQ ID NO: 39898 - DNA, 21 bp, Artificial sequence
  SiRNA target sequence
gtaactatgcagatcaattcc

SEQ ID NO: 39899 - DNA, 21 bp, Artificial sequence
  SiRNA target sequence
taactatgcagatcaattcca

SEQ ID NO: 39900 - DNA, 21 bp, Artificial sequence
  SiRNA target sequence
aactatgcagatcaattccaa

SEQ ID NO: 39901 - DNA, 21 bp, Artificial sequence
  SiRNA target sequence
actatgcagatcaattccaag

SEQ ID NO: 39902 - DNA, 21 bp, Artificial sequence
  SiRNA target sequence
ctatgcagatcaattccaaga

SEQ ID NO: 39903 - DNA, 21 bp, Artificial sequence
  SiRNA target sequence
tatgcagatcaattccaagaa

SEQ ID NO: 39904 - DNA, 21 bp, Artificial sequence
  SiRNA target sequence
atgcagatcaattccaagaaa

SEQ ID NO: 39905 - DNA, 21 bp, Artificial sequence
  SiRNA target sequence
tgcagatcaattccaagaaaa

SEQ ID NO: 39906 - DNA, 21 bp, Artificial sequence
  SiRNA target sequence
gcagatcaattccaagaaaaa

SEQ ID NO: 39907 - DNA, 21 bp, Artificial sequence
  SiRNA target sequence
cagatcaattccaagaaaaat

SEQ ID NO: 39908 - DNA, 21 bp, Artificial sequence
  SiRNA target sequence
agatcaattccaagaaaaata

SEQ ID NO: 39909 - DNA, 21 bp, Artificial sequence
  SiRNA target sequence
gatcaattccaagaaaaataa

SEQ ID NO: 39910 - DNA, 21 bp, Artificial sequence
  SiRNA target sequence
atcaattccaagaaaaataat

SEQ ID NO: 39911 - DNA, 21 bp, Artificial sequence
  SiRNA target sequence
tcaattccaagaaaaataatt

SEQ ID NO: 39912 - DNA, 21 bp, Artificial sequence
  SiRNA target sequence
caattccaagaaaaataattc

SEQ ID NO: 39913 - DNA, 21 bp, Artificial sequence
  SiRNA target sequence
aattccaagaaaaataattcc

SEQ ID NO: 39914 - DNA, 21 bp, Artificial sequence
  SiRNA target sequence
attccaagaaaaataattcca

SEQ ID NO: 39915 - DNA, 21 bp, Artificial sequence
  SiRNA target sequence
ttccaagaaaaataattccaa

SEQ ID NO: 39916 - DNA, 21 bp, Artificial sequence
  SiRNA target sequence
tccaagaaaaataattccaat

SEQ ID NO: 39917 - DNA, 21 bp, Artificial sequence
  SiRNA target sequence
ccaagaaaaataattccaata

SEQ ID NO: 39918 - DNA, 21 bp, Artificial sequence
  SiRNA target sequence
caagaaaaataattccaataa

SEQ ID NO: 39919 - DNA, 21 bp, Artificial sequence
  SiRNA target sequence
aagaaaaataattccaataaa

SEQ ID NO: 39920 - DNA, 21 bp, Artificial sequence
  SiRNA target sequence
agaaaaataattccaataaaa

SEQ ID NO: 39921 - DNA, 21 bp, Artificial sequence
  SiRNA target sequence
gaaaaataattccaataaaat

SEQ ID NO: 39922 - DNA, 21 bp, Artificial sequence
  SiRNA target sequence
aaaaataattccaataaaatg

SEQ ID NO: 39923 - DNA, 21 bp, Artificial sequence
  SiRNA target sequence
aaaataattccaataaaatgg

SEQ ID NO: 39924 - DNA, 21 bp, Artificial sequence
  SiRNA target sequence
aaataattccaataaaatggc

SEQ ID NO: 39925 - DNA, 21 bp, Artificial sequence
  SiRNA target sequence
aataattccaataaaatggca

SEQ ID NO: 39926 - DNA, 21 bp, Artificial sequence
  SiRNA target sequence
ataattccaataaaatggcaa

SEQ ID NO: 39927 - DNA, 21 bp, Artificial sequence
  SiRNA target sequence
taattccaataaaatggcaac

SEQ ID NO: 39928 - DNA, 21 bp, Artificial sequence
  SiRNA target sequence
aattccaataaaatggcaaca

SEQ ID NO: 39929 - DNA, 21 bp, Artificial sequence
  SiRNA target sequence
attccaataaaatggcaacac

SEQ ID NO: 39930 - DNA, 21 bp, Artificial sequence
  SiRNA target sequence
ttccaataaaatggcaacacc

SEQ ID NO: 39931 - DNA, 21 bp, Artificial sequence
  SiRNA target sequence
tccaataaaatggcaacacct

SEQ ID NO: 39932 - DNA, 21 bp, Artificial sequence
  SiRNA target sequence
ccaataaaatggcaacacctg

SEQ ID NO: 39933 - DNA, 21 bp, Artificial sequence
  SiRNA target sequence
caataaaatggcaacacctgt

SEQ ID NO: 39934 - DNA, 21 bp, Artificial sequence
  SiRNA target sequence
aataaaatggcaacacctgtt

SEQ ID NO: 39935 - DNA, 21 bp, Artificial sequence
  SiRNA target sequence
ataaaatggcaacacctgtta

SEQ ID NO: 39936 - DNA, 21 bp, Artificial sequence
  SiRNA target sequence
taaaatggcaacacctgttaa

SEQ ID NO: 39937 - DNA, 21 bp, Artificial sequence
  SiRNA target sequence
aaaatggcaacacctgttaag

SEQ ID NO: 39938 - DNA, 21 bp, Artificial sequence
  SiRNA target sequence
aaatggcaacacctgttaagg

SEQ ID NO: 39939 - DNA, 21 bp, Artificial sequence
  SiRNA target sequence
aatggcaacacctgttaagga

SEQ ID NO: 39940 - DNA, 21 bp, Artificial sequence
  SiRNA target sequence
atggcaacacctgttaaggaa

SEQ ID NO: 39941 - DNA, 21 bp, Artificial sequence
  SiRNA target sequence
tggcaacacctgttaaggaaa

SEQ ID NO: 39942 - DNA, 21 bp, Artificial sequence
  SiRNA target sequence
ggcaacacctgttaaggaaaa

SEQ ID NO: 39943 - DNA, 21 bp, Artificial sequence
  SiRNA target sequence
gcaacacctgttaaggaaaaa

SEQ ID NO: 39944 - DNA, 21 bp, Artificial sequence
  SiRNA target sequence
caacacctgttaaggaaaaaa

SEQ ID NO: 39945 - DNA, 21 bp, Artificial sequence
  SiRNA target sequence
aacacctgttaaggaaaaaac

SEQ ID NO: 39946 - DNA, 21 bp, Artificial sequence
  SiRNA target sequence
acacctgttaaggaaaaaaca

SEQ ID NO: 39947 - DNA, 21 bp, Artificial sequence
  SiRNA target sequence
cacctgttaaggaaaaaacaa

SEQ ID NO: 39948 - DNA, 21 bp, Artificial sequence
  SiRNA target sequence
acctgttaaggaaaaaacaaa

SEQ ID NO: 39949 - DNA, 21 bp, Artificial sequence
  SiRNA target sequence
cctgttaaggaaaaaacaaaa

SEQ ID NO: 39950 - DNA, 21 bp, Artificial sequence
  SiRNA target sequence
ctgttaaggaaaaaacaaaaa

SEQ ID NO: 39951 - DNA, 21 bp, Artificial sequence
  SiRNA target sequence
tgttaaggaaaaaacaaaaaa

SEQ ID NO: 39952 - DNA, 21 bp, Artificial sequence
  SiRNA target sequence
gttaaggaaaaaacaaaaaat

SEQ ID NO: 39953 - DNA, 21 bp, Artificial sequence
  SiRNA target sequence
ttaaggaaaaaacaaaaaata

SEQ ID NO: 39954 - DNA, 21 bp, Artificial sequence
  SiRNA target sequence
taaggaaaaaacaaaaaatat

SEQ ID NO: 39955 - DNA, 21 bp, Artificial sequence
  SiRNA target sequence
aaggaaaaaacaaaaaatata

SEQ ID NO: 39956 - DNA, 21 bp, Artificial sequence
  SiRNA target sequence
aggaaaaaacaaaaaatatac

SEQ ID NO: 39957 - DNA, 21 bp, Artificial sequence
  SiRNA target sequence
ggaaaaaacaaaaaatatacc

SEQ ID NO: 39958 - DNA, 21 bp, Artificial sequence
  SiRNA target sequence
gaaaaaacaaaaaatataccc

SEQ ID NO: 39959 - DNA, 21 bp, Artificial sequence
  SiRNA target sequence
aaaaaacaaaaaatataccca

SEQ ID NO: 39960 - DNA, 21 bp, Artificial sequence
  SiRNA target sequence
aaaaacaaaaaatatacccaa

SEQ ID NO: 39961 - DNA, 21 bp, Artificial sequence
  SiRNA target sequence
aaaacaaaaaatatacccaaa

SEQ ID NO: 39962 - DNA, 21 bp, Artificial sequence
  SiRNA target sequence
aaacaaaaaatatacccaaac

SEQ ID NO: 39963 - DNA, 21 bp, Artificial sequence
  SiRNA target sequence
aacaaaaaatatacccaaacc

SEQ ID NO: 39964 - DNA, 21 bp, Artificial sequence
  SiRNA target sequence
acaaaaaatatacccaaacca

SEQ ID NO: 39965 - DNA, 21 bp, Artificial sequence
  SiRNA target sequence
caaaaaatatacccaaaccaa

SEQ ID NO: 39966 - DNA, 21 bp, Artificial sequence
  SiRNA target sequence
aaaaaatatacccaaaccaaa

SEQ ID NO: 39967 - DNA, 21 bp, Artificial sequence
  SiRNA target sequence
aaaaatatacccaaaccaaag

SEQ ID NO: 39968 - DNA, 21 bp, Artificial sequence
  SiRNA target sequence
aaaatatacccaaaccaaaga

SEQ ID NO: 39969 - DNA, 21 bp, Artificial sequence
  SiRNA target sequence
aaatatacccaaaccaaagac

SEQ ID NO: 39970 - DNA, 21 bp, Artificial sequence
  SiRNA target sequence
aatatacccaaaccaaagact

SEQ ID NO: 39971 - DNA, 21 bp, Artificial sequence
  SiRNA target sequence
atatacccaaaccaaagactg

SEQ ID NO: 39972 - DNA, 21 bp, Artificial sequence
  SiRNA target sequence
tatacccaaaccaaagactga

SEQ ID NO: 39973 - DNA, 21 bp, Artificial sequence
  SiRNA target sequence
atacccaaaccaaagactgaa

SEQ ID NO: 39974 - DNA, 21 bp, Artificial sequence
  SiRNA target sequence
tacccaaaccaaagactgaaa

SEQ ID NO: 39975 - DNA, 21 bp, Artificial sequence
  SiRNA target sequence
acccaaaccaaagactgaaaa

SEQ ID NO: 39976 - DNA, 21 bp, Artificial sequence
  SiRNA target sequence
cccaaaccaaagactgaaaat

SEQ ID NO: 39977 - DNA, 21 bp, Artificial sequence
  SiRNA target sequence
ccaaaccaaagactgaaaatc

SEQ ID NO: 39978 - DNA, 21 bp, Artificial sequence
  SiRNA target sequence
caaaccaaagactgaaaatcc

SEQ ID NO: 39979 - DNA, 21 bp, Artificial sequence
  SiRNA target sequence
aaaccaaagactgaaaatccg

SEQ ID NO: 39980 - DNA, 21 bp, Artificial sequence
  SiRNA target sequence
aaccaaagactgaaaatccga

SEQ ID NO: 39981 - DNA, 21 bp, Artificial sequence
  SiRNA target sequence
accaaagactgaaaatccgaa

SEQ ID NO: 39982 - DNA, 21 bp, Artificial sequence
  SiRNA target sequence
ccaaagactgaaaatccgaag

SEQ ID NO: 39983 - DNA, 21 bp, Artificial sequence
  SiRNA target sequence
caaagactgaaaatccgaaga

SEQ ID NO: 39984 - DNA, 21 bp, Artificial sequence
  SiRNA target sequence
aaagactgaaaatccgaagat

SEQ ID NO: 39985 - DNA, 21 bp, Artificial sequence
  SiRNA target sequence
aagactgaaaatccgaagatt

SEQ ID NO: 39986 - DNA, 21 bp, Artificial sequence
  SiRNA target sequence
agactgaaaatccgaagattg

SEQ ID NO: 39987 - DNA, 21 bp, Artificial sequence
  SiRNA target sequence
gactgaaaatccgaagattgg

SEQ ID NO: 39988 - DNA, 21 bp, Artificial sequence
  SiRNA target sequence
actgaaaatccgaagattgga

SEQ ID NO: 39989 - DNA, 21 bp, Artificial sequence
  SiRNA target sequence
ctgaaaatccgaagattggac

SEQ ID NO: 39990 - DNA, 21 bp, Artificial sequence
  SiRNA target sequence
tgaaaatccgaagattggacc

SEQ ID NO: 39991 - DNA, 21 bp, Artificial sequence
  SiRNA target sequence
gaaaatccgaagattggacca

SEQ ID NO: 39992 - DNA, 21 bp, Artificial sequence
  SiRNA target sequence
aaaatccgaagattggaccaa

SEQ ID NO: 39993 - DNA, 21 bp, Artificial sequence
  SiRNA target sequence
aaatccgaagattggaccaat

SEQ ID NO: 39994 - DNA, 21 bp, Artificial sequence
  SiRNA target sequence
aatccgaagattggaccaata

SEQ ID NO: 39995 - DNA, 21 bp, Artificial sequence
  SiRNA target sequence
atccgaagattggaccaatat

SEQ ID NO: 39996 - DNA, 21 bp, Artificial sequence
  SiRNA target sequence
tccgaagattggaccaatatc

SEQ ID NO: 39997 - DNA, 21 bp, Artificial sequence
  SiRNA target sequence
ccgaagattggaccaatatca

SEQ ID NO: 39998 - DNA, 21 bp, Artificial sequence
  SiRNA target sequence
cgaagattggaccaatatcag

SEQ ID NO: 39999 - DNA, 21 bp, Artificial sequence
  SiRNA target sequence
gaagattggaccaatatcaga

SEQ ID NO: 40000 - DNA, 21 bp, Artificial sequence
  SiRNA target sequence
aagattggaccaatatcagaa

SEQ ID NO: 40001 - DNA, 21 bp, Artificial sequence
  SiRNA target sequence
agattggaccaatatcagaac

SEQ ID NO: 40002 - DNA, 21 bp, Artificial sequence
  SiRNA target sequence
gattggaccaatatcagaact

SEQ ID NO: 40003 - DNA, 21 bp, Artificial sequence
  SiRNA target sequence
attggaccaatatcagaacta

SEQ ID NO: 40004 - DNA, 21 bp, Artificial sequence
  SiRNA target sequence
ttggaccaatatcagaactag

SEQ ID NO: 40005 - DNA, 21 bp, Artificial sequence
  SiRNA target sequence
tggaccaatatcagaactagc

SEQ ID NO: 40006 - DNA, 21 bp, Artificial sequence
  SiRNA target sequence
ggaccaatatcagaactagcc

SEQ ID NO: 40007 - DNA, 21 bp, Artificial sequence
  SiRNA target sequence
gaccaatatcagaactagcca

SEQ ID NO: 40008 - DNA, 21 bp, Artificial sequence
  SiRNA target sequence
accaatatcagaactagccac

SEQ ID NO: 40009 - DNA, 21 bp, Artificial sequence
  SiRNA target sequence
ccaatatcagaactagccaca

SEQ ID NO: 40010 - DNA, 21 bp, Artificial sequence
  SiRNA target sequence
caatatcagaactagccacag

SEQ ID NO: 40011 - DNA, 21 bp, Artificial sequence
  SiRNA target sequence
aatatcagaactagccacagg

SEQ ID NO: 40012 - DNA, 21 bp, Artificial sequence
  SiRNA target sequence
atatcagaactagccacagga

SEQ ID NO: 40013 - DNA, 21 bp, Artificial sequence
  SiRNA target sequence
tatcagaactagccacaggag

SEQ ID NO: 40014 - DNA, 21 bp, Artificial sequence
  SiRNA target sequence
atcagaactagccacaggagt

SEQ ID NO: 40015 - DNA, 21 bp, Artificial sequence
  SiRNA target sequence
tcagaactagccacaggagtc

SEQ ID NO: 40016 - DNA, 21 bp, Artificial sequence
  SiRNA target sequence
cagaactagccacaggagtca

SEQ ID NO: 40017 - DNA, 21 bp, Artificial sequence
  SiRNA target sequence
agaactagccacaggagtcaa

SEQ ID NO: 40018 - DNA, 21 bp, Artificial sequence
  SiRNA target sequence
gaactagccacaggagtcaac

SEQ ID NO: 40019 - DNA, 21 bp, Artificial sequence
  SiRNA target sequence
aactagccacaggagtcaaca

SEQ ID NO: 40020 - DNA, 21 bp, Artificial sequence
  SiRNA target sequence
actagccacaggagtcaacaa

SEQ ID NO: 40021 - DNA, 21 bp, Artificial sequence
  SiRNA target sequence
ctagccacaggagtcaacaag

SEQ ID NO: 40022 - DNA, 21 bp, Artificial sequence
  SiRNA target sequence
tagccacaggagtcaacaagg

SEQ ID NO: 40023 - DNA, 21 bp, Artificial sequence
  SiRNA target sequence
agccacaggagtcaacaaggt

SEQ ID NO: 40024 - DNA, 21 bp, Artificial sequence
  SiRNA target sequence
gccacaggagtcaacaaggtg

SEQ ID NO: 40025 - DNA, 21 bp, Artificial sequence
  SiRNA target sequence
ccacaggagtcaacaaggtgg

SEQ ID NO: 40026 - DNA, 21 bp, Artificial sequence
  SiRNA target sequence
cacaggagtcaacaaggtggc

SEQ ID NO: 40027 - DNA, 21 bp, Artificial sequence
  SiRNA target sequence
acaggagtcaacaaggtggcg

SEQ ID NO: 40028 - DNA, 21 bp, Artificial sequence
  SiRNA target sequence
caggagtcaacaaggtggcga

SEQ ID NO: 40029 - DNA, 21 bp, Artificial sequence
  SiRNA target sequence
aggagtcaacaaggtggcgaa

SEQ ID NO: 40030 - DNA, 21 bp, Artificial sequence
  SiRNA target sequence
ggagtcaacaaggtggcgaat

SEQ ID NO: 40031 - DNA, 21 bp, Artificial sequence
  SiRNA target sequence
gagtcaacaaggtggcgaatg

SEQ ID NO: 40032 - DNA, 21 bp, Artificial sequence
  SiRNA target sequence
agtcaacaaggtggcgaatgg

SEQ ID NO: 40033 - DNA, 21 bp, Artificial sequence
  SiRNA target sequence
gtcaacaaggtggcgaatggt

SEQ ID NO: 40034 - DNA, 21 bp, Artificial sequence
  SiRNA target sequence
tcaacaaggtggcgaatggta

SEQ ID NO: 40035 - DNA, 21 bp, Artificial sequence
  SiRNA target sequence
caacaaggtggcgaatggtat

SEQ ID NO: 40036 - DNA, 21 bp, Artificial sequence
  SiRNA target sequence
aacaaggtggcgaatggtatt

SEQ ID NO: 40037 - DNA, 21 bp, Artificial sequence
  SiRNA target sequence
acaaggtggcgaatggtattg

SEQ ID NO: 40038 - DNA, 21 bp, Artificial sequence
  SiRNA target sequence
caaggtggcgaatggtattga

SEQ ID NO: 40039 - DNA, 21 bp, Artificial sequence
  SiRNA target sequence
aaggtggcgaatggtattgag

SEQ ID NO: 40040 - DNA, 21 bp, Artificial sequence
  SiRNA target sequence
aggtggcgaatggtattgaga

SEQ ID NO: 40041 - DNA, 21 bp, Artificial sequence
  SiRNA target sequence
ggtggcgaatggtattgagag

SEQ ID NO: 40042 - DNA, 21 bp, Artificial sequence
  SiRNA target sequence
gtggcgaatggtattgagaga

SEQ ID NO: 40043 - DNA, 21 bp, Artificial sequence
  SiRNA target sequence
tggcgaatggtattgagagaa

SEQ ID NO: 40044 - DNA, 21 bp, Artificial sequence
  SiRNA target sequence
ggcgaatggtattgagagaat

SEQ ID NO: 40045 - DNA, 21 bp, Artificial sequence
  SiRNA target sequence
gcgaatggtattgagagaata

SEQ ID NO: 40046 - DNA, 21 bp, Artificial sequence
  SiRNA target sequence
cgaatggtattgagagaatac

SEQ ID NO: 40047 - DNA, 21 bp, Artificial sequence
  SiRNA target sequence
gaatggtattgagagaatacc

SEQ ID NO: 40048 - DNA, 21 bp, Artificial sequence
  SiRNA target sequence
aatggtattgagagaatacct

SEQ ID NO: 40049 - DNA, 21 bp, Artificial sequence
  SiRNA target sequence
atggtattgagagaatacctg

SEQ ID NO: 40050 - DNA, 21 bp, Artificial sequence
  SiRNA target sequence
tggtattgagagaatacctgt

SEQ ID NO: 40051 - DNA, 21 bp, Artificial sequence
  SiRNA target sequence
ggtattgagagaatacctgtg

SEQ ID NO: 40052 - DNA, 21 bp, Artificial sequence
  SiRNA target sequence
gtattgagagaatacctgtga

SEQ ID NO: 40053 - DNA, 21 bp, Artificial sequence
  SiRNA target sequence
tattgagagaatacctgtgat

SEQ ID NO: 40054 - DNA, 21 bp, Artificial sequence
  SiRNA target sequence
attgagagaatacctgtgatt

SEQ ID NO: 40055 - DNA, 21 bp, Artificial sequence
  SiRNA target sequence
ttgagagaatacctgtgattg

SEQ ID NO: 40056 - DNA, 21 bp, Artificial sequence
  SiRNA target sequence
tgagagaatacctgtgattgg

SEQ ID NO: 40057 - DNA, 21 bp, Artificial sequence
  SiRNA target sequence
gagagaatacctgtgattgga

SEQ ID NO: 40058 - DNA, 21 bp, Artificial sequence
  SiRNA target sequence
agagaatacctgtgattggag

SEQ ID NO: 40059 - DNA, 21 bp, Artificial sequence
  SiRNA target sequence
gagaatacctgtgattggaga

SEQ ID NO: 40060 - DNA, 21 bp, Artificial sequence
  SiRNA target sequence
agaatacctgtgattggagag

SEQ ID NO: 40061 - DNA, 21 bp, Artificial sequence
  SiRNA target sequence
gaatacctgtgattggagaga

SEQ ID NO: 40062 - DNA, 21 bp, Artificial sequence
  SiRNA target sequence
aatacctgtgattggagagat

SEQ ID NO: 40063 - DNA, 21 bp, Artificial sequence
  SiRNA target sequence
atacctgtgattggagagatg

SEQ ID NO: 40064 - DNA, 21 bp, Artificial sequence
  SiRNA target sequence
tacctgtgattggagagatgg

SEQ ID NO: 40065 - DNA, 21 bp, Artificial sequence
  SiRNA target sequence
acctgtgattggagagatggc

SEQ ID NO: 40066 - DNA, 21 bp, Artificial sequence
  SiRNA target sequence
cctgtgattggagagatggca

SEQ ID NO: 40067 - DNA, 21 bp, Artificial sequence
  SiRNA target sequence
ctgtgattggagagatggcaa

SEQ ID NO: 40068 - DNA, 21 bp, Artificial sequence
  SiRNA target sequence
tgtgattggagagatggcaaa

SEQ ID NO: 40069 - DNA, 21 bp, Artificial sequence
  SiRNA target sequence
gtgattggagagatggcaaaa

SEQ ID NO: 40070 - DNA, 21 bp, Artificial sequence
  SiRNA target sequence
tgattggagagatggcaaaac

SEQ ID NO: 40071 - DNA, 21 bp, Artificial sequence
  SiRNA target sequence
gattggagagatggcaaaacc

SEQ ID NO: 40072 - DNA, 21 bp, Artificial sequence
  SiRNA target sequence
attggagagatggcaaaacct

SEQ ID NO: 40073 - DNA, 21 bp, Artificial sequence
  SiRNA target sequence
ttggagagatggcaaaacctg

SEQ ID NO: 40074 - DNA, 21 bp, Artificial sequence
  SiRNA target sequence
tggagagatggcaaaacctgt

SEQ ID NO: 40075 - DNA, 21 bp, Artificial sequence
  SiRNA target sequence
ggagagatggcaaaacctgta

SEQ ID NO: 40076 - DNA, 21 bp, Artificial sequence
  SiRNA target sequence
gagagatggcaaaacctgtaa

SEQ ID NO: 40077 - DNA, 21 bp, Artificial sequence
  SiRNA target sequence
agagatggcaaaacctgtaac

SEQ ID NO: 40078 - DNA, 21 bp, Artificial sequence
  SiRNA target sequence
gagatggcaaaacctgtaact

SEQ ID NO: 40079 - DNA, 21 bp, Artificial sequence
  SiRNA target sequence
agatggcaaaacctgtaactt

SEQ ID NO: 40080 - DNA, 21 bp, Artificial sequence
  SiRNA target sequence
gatggcaaaacctgtaacttc

SEQ ID NO: 40081 - DNA, 21 bp, Artificial sequence
  SiRNA target sequence
atggcaaaacctgtaacttca

SEQ ID NO: 40082 - DNA, 21 bp, Artificial sequence
  SiRNA target sequence
tggcaaaacctgtaacttcaa

SEQ ID NO: 40083 - DNA, 21 bp, Artificial sequence
  SiRNA target sequence
ggcaaaacctgtaacttcaac

SEQ ID NO: 40084 - DNA, 21 bp, Artificial sequence
  SiRNA target sequence
gcaaaacctgtaacttcaaca

SEQ ID NO: 40085 - DNA, 21 bp, Artificial sequence
  SiRNA target sequence
caaaacctgtaacttcaacaa

SEQ ID NO: 40086 - DNA, 21 bp, Artificial sequence
  SiRNA target sequence
aaaacctgtaacttcaacaat

SEQ ID NO: 40087 - DNA, 21 bp, Artificial sequence
  SiRNA target sequence
aaacctgtaacttcaacaatt

SEQ ID NO: 40088 - DNA, 21 bp, Artificial sequence
  SiRNA target sequence
aacctgtaacttcaacaatta

SEQ ID NO: 40089 - DNA, 21 bp, Artificial sequence
  SiRNA target sequence
acctgtaacttcaacaattaa

SEQ ID NO: 40090 - DNA, 21 bp, Artificial sequence
  SiRNA target sequence
cctgtaacttcaacaattaaa

SEQ ID NO: 40091 - DNA, 21 bp, Artificial sequence
  SiRNA target sequence
ctgtaacttcaacaattaaat

SEQ ID NO: 40092 - DNA, 21 bp, Artificial sequence
  SiRNA target sequence
tgtaacttcaacaattaaatg

SEQ ID NO: 40093 - DNA, 21 bp, Artificial sequence
  SiRNA target sequence
gtaacttcaacaattaaatgg

SEQ ID NO: 40094 - DNA, 21 bp, Artificial sequence
  SiRNA target sequence
taacttcaacaattaaatggg

SEQ ID NO: 40095 - DNA, 21 bp, Artificial sequence
  SiRNA target sequence
aacttcaacaattaaatgggt

SEQ ID NO: 40096 - DNA, 21 bp, Artificial sequence
  SiRNA target sequence
acttcaacaattaaatgggtt

SEQ ID NO: 40097 - DNA, 21 bp, Artificial sequence
  SiRNA target sequence
cttcaacaattaaatgggttg

SEQ ID NO: 40098 - DNA, 21 bp, Artificial sequence
  SiRNA target sequence
ttcaacaattaaatgggttgc

SEQ ID NO: 40099 - DNA, 21 bp, Artificial sequence
  SiRNA target sequence
tcaacaattaaatgggttgct

SEQ ID NO: 40100 - DNA, 21 bp, Artificial sequence
  SiRNA target sequence
caacaattaaatgggttgctg

SEQ ID NO: 40101 - DNA, 21 bp, Artificial sequence
  SiRNA target sequence
aacaattaaatgggttgctga

SEQ ID NO: 40102 - DNA, 21 bp, Artificial sequence
  SiRNA target sequence
acaattaaatgggttgctgac

SEQ ID NO: 40103 - DNA, 21 bp, Artificial sequence
  SiRNA target sequence
caattaaatgggttgctgaca

SEQ ID NO: 40104 - DNA, 21 bp, Artificial sequence
  SiRNA target sequence
aattaaatgggttgctgacaa

SEQ ID NO: 40105 - DNA, 21 bp, Artificial sequence
  SiRNA target sequence
attaaatgggttgctgacaag

SEQ ID NO: 40106 - DNA, 21 bp, Artificial sequence
  SiRNA target sequence
ttaaatgggttgctgacaaga

SEQ ID NO: 40107 - DNA, 21 bp, Artificial sequence
  SiRNA target sequence
taaatgggttgctgacaagat

SEQ ID NO: 40108 - DNA, 21 bp, Artificial sequence
  SiRNA target sequence
aaatgggttgctgacaagatt

SEQ ID NO: 40109 - DNA, 21 bp, Artificial sequence
  SiRNA target sequence
aatgggttgctgacaagattg

SEQ ID NO: 40110 - DNA, 21 bp, Artificial sequence
  SiRNA target sequence
atgggttgctgacaagattgg

SEQ ID NO: 40111 - DNA, 21 bp, Artificial sequence
  SiRNA target sequence
tgggttgctgacaagattgga

SEQ ID NO: 40112 - DNA, 21 bp, Artificial sequence
  SiRNA target sequence
gggttgctgacaagattggat

SEQ ID NO: 40113 - DNA, 21 bp, Artificial sequence
  SiRNA target sequence
ggttgctgacaagattggatc

SEQ ID NO: 40114 - DNA, 21 bp, Artificial sequence
  SiRNA target sequence
gttgctgacaagattggatct

SEQ ID NO: 40115 - DNA, 21 bp, Artificial sequence
  SiRNA target sequence
ttgctgacaagattggatctg

SEQ ID NO: 40116 - DNA, 21 bp, Artificial sequence
  SiRNA target sequence
tgctgacaagattggatctgt

SEQ ID NO: 40117 - DNA, 21 bp, Artificial sequence
  SiRNA target sequence
gctgacaagattggatctgtg

SEQ ID NO: 40118 - DNA, 21 bp, Artificial sequence
  SiRNA target sequence
ctgacaagattggatctgtgg

SEQ ID NO: 40119 - DNA, 21 bp, Artificial sequence
  SiRNA target sequence
tgacaagattggatctgtggc

SEQ ID NO: 40120 - DNA, 21 bp, Artificial sequence
  SiRNA target sequence
gacaagattggatctgtggca

SEQ ID NO: 40121 - DNA, 21 bp, Artificial sequence
  SiRNA target sequence
acaagattggatctgtggcag

SEQ ID NO: 40122 - DNA, 21 bp, Artificial sequence
  SiRNA target sequence
caagattggatctgtggcagc

SEQ ID NO: 40123 - DNA, 21 bp, Artificial sequence
  SiRNA target sequence
aagattggatctgtggcagca

SEQ ID NO: 40124 - DNA, 21 bp, Artificial sequence
  SiRNA target sequence
agattggatctgtggcagcaa

SEQ ID NO: 40125 - DNA, 21 bp, Artificial sequence
  SiRNA target sequence
gattggatctgtggcagcaat

SEQ ID NO: 40126 - DNA, 21 bp, Artificial sequence
  SiRNA target sequence
attggatctgtggcagcaatt

SEQ ID NO: 40127 - DNA, 21 bp, Artificial sequence
  SiRNA target sequence
ttggatctgtggcagcaattt

SEQ ID NO: 40128 - DNA, 21 bp, Artificial sequence
  SiRNA target sequence
tggatctgtggcagcaatttt

SEQ ID NO: 40129 - DNA, 21 bp, Artificial sequence
  SiRNA target sequence
ggatctgtggcagcaattttt

SEQ ID NO: 40130 - DNA, 21 bp, Artificial sequence
  SiRNA target sequence
gatctgtggcagcaatttttg

SEQ ID NO: 40131 - DNA, 21 bp, Artificial sequence
  SiRNA target sequence
atctgtggcagcaatttttgg

SEQ ID NO: 40132 - DNA, 21 bp, Artificial sequence
  SiRNA target sequence
tctgtggcagcaatttttgga

SEQ ID NO: 40133 - DNA, 21 bp, Artificial sequence
  SiRNA target sequence
ctgtggcagcaatttttggat

SEQ ID NO: 40134 - DNA, 21 bp, Artificial sequence
  SiRNA target sequence
tgtggcagcaatttttggatg

SEQ ID NO: 40135 - DNA, 21 bp, Artificial sequence
  SiRNA target sequence
gtggcagcaatttttggatgg

SEQ ID NO: 40136 - DNA, 21 bp, Artificial sequence
  SiRNA target sequence
tggcagcaatttttggatggt

SEQ ID NO: 40137 - DNA, 21 bp, Artificial sequence
  SiRNA target sequence
ggcagcaatttttggatggtc

SEQ ID NO: 40138 - DNA, 21 bp, Artificial sequence
  SiRNA target sequence
gcagcaatttttggatggtcg

SEQ ID NO: 40139 - DNA, 21 bp, Artificial sequence
  SiRNA target sequence
cagcaatttttggatggtcga

SEQ ID NO: 40140 - DNA, 21 bp, Artificial sequence
  SiRNA target sequence
agcaatttttggatggtcgaa

SEQ ID NO: 40141 - DNA, 21 bp, Artificial sequence
  SiRNA target sequence
gcaatttttggatggtcgaaa

SEQ ID NO: 40142 - DNA, 21 bp, Artificial sequence
  SiRNA target sequence
caatttttggatggtcgaaac

SEQ ID NO: 40143 - DNA, 21 bp, Artificial sequence
  SiRNA target sequence
aatttttggatggtcgaaacc

SEQ ID NO: 40144 - DNA, 21 bp, Artificial sequence
  SiRNA target sequence
atttttggatggtcgaaaccc

SEQ ID NO: 40145 - DNA, 21 bp, Artificial sequence
  SiRNA target sequence
tttttggatggtcgaaaccca

SEQ ID NO: 40146 - DNA, 21 bp, Artificial sequence
  SiRNA target sequence
ttttggatggtcgaaacccag

SEQ ID NO: 40147 - DNA, 21 bp, Artificial sequence
  SiRNA target sequence
tttggatggtcgaaacccaga

SEQ ID NO: 40148 - DNA, 21 bp, Artificial sequence
  SiRNA target sequence
ttggatggtcgaaacccagaa

SEQ ID NO: 40149 - DNA, 21 bp, Artificial sequence
  SiRNA target sequence
tggatggtcgaaacccagaaa

SEQ ID NO: 40150 - DNA, 21 bp, Artificial sequence
  SiRNA target sequence
ggatggtcgaaacccagaaat

SEQ ID NO: 40151 - DNA, 21 bp, Artificial sequence
  SiRNA target sequence
gatggtcgaaacccagaaatc

SEQ ID NO: 40152 - DNA, 21 bp, Artificial sequence
  SiRNA target sequence
atggtcgaaacccagaaatct

SEQ ID NO: 40153 - DNA, 21 bp, Artificial sequence
  SiRNA target sequence
tggtcgaaacccagaaatcta

SEQ ID NO: 40154 - DNA, 21 bp, Artificial sequence
  SiRNA target sequence
ggtcgaaacccagaaatctag

SEQ ID NO: 40155 - DNA, 21 bp, Artificial sequence
  SiRNA target sequence
gtcgaaacccagaaatctaga

SEQ ID NO: 40156 - DNA, 21 bp, Artificial sequence
  SiRNA target sequence
tcgaaacccagaaatctagaa

SEQ ID NO: 40157 - DNA, 21 bp, Artificial sequence
  SiRNA target sequence
cgaaacccagaaatctagaac

SEQ ID NO: 40158 - DNA, 21 bp, Artificial sequence
  SiRNA target sequence
gaaacccagaaatctagaaca

SEQ ID NO: 40159 - DNA, 21 bp, Artificial sequence
  SiRNA target sequence
aaacccagaaatctagaacaa

SEQ ID NO: 40160 - DNA, 21 bp, Artificial sequence
  SiRNA target sequence
aacccagaaatctagaacaag

SEQ ID NO: 40161 - DNA, 21 bp, Artificial sequence
  SiRNA target sequence
acccagaaatctagaacaagt

SEQ ID NO: 40162 - DNA, 21 bp, Artificial sequence
  SiRNA target sequence
cccagaaatctagaacaagtt

SEQ ID NO: 40163 - DNA, 21 bp, Artificial sequence
  SiRNA target sequence
ccagaaatctagaacaagtta

SEQ ID NO: 40164 - DNA, 21 bp, Artificial sequence
  SiRNA target sequence
cagaaatctagaacaagttaa

SEQ ID NO: 40165 - DNA, 21 bp, Artificial sequence
  SiRNA target sequence
agaaatctagaacaagttaat

SEQ ID NO: 40166 - DNA, 21 bp, Artificial sequence
  SiRNA target sequence
gaaatctagaacaagttaatt

SEQ ID NO: 40167 - DNA, 21 bp, Artificial sequence
  SiRNA target sequence
aaatctagaacaagttaattt

SEQ ID NO: 40168 - DNA, 21 bp, Artificial sequence
  SiRNA target sequence
aatctagaacaagttaattta

SEQ ID NO: 40169 - DNA, 21 bp, Artificial sequence
  SiRNA target sequence
atctagaacaagttaatttat

SEQ ID NO: 40170 - DNA, 21 bp, Artificial sequence
  SiRNA target sequence
tctagaacaagttaatttata

SEQ ID NO: 40171 - DNA, 21 bp, Artificial sequence
  SiRNA target sequence
ctagaacaagttaatttatat

SEQ ID NO: 40172 - DNA, 21 bp, Artificial sequence
  SiRNA target sequence
tagaacaagttaatttatatc

SEQ ID NO: 40173 - DNA, 21 bp, Artificial sequence
  SiRNA target sequence
agaacaagttaatttatatca

SEQ ID NO: 40174 - DNA, 21 bp, Artificial sequence
  SiRNA target sequence
gaacaagttaatttatatcag

SEQ ID NO: 40175 - DNA, 21 bp, Artificial sequence
  SiRNA target sequence
aacaagttaatttatatcaga

SEQ ID NO: 40176 - DNA, 21 bp, Artificial sequence
  SiRNA target sequence
acaagttaatttatatcagaa

SEQ ID NO: 40177 - DNA, 21 bp, Artificial sequence
  SiRNA target sequence
caagttaatttatatcagaat

SEQ ID NO: 40178 - DNA, 21 bp, Artificial sequence
  SiRNA target sequence
aagttaatttatatcagaatg

SEQ ID NO: 40179 - DNA, 21 bp, Artificial sequence
  SiRNA target sequence
agttaatttatatcagaatgt

SEQ ID NO: 40180 - DNA, 21 bp, Artificial sequence
  SiRNA target sequence
gttaatttatatcagaatgtt

SEQ ID NO: 40181 - DNA, 21 bp, Artificial sequence
  SiRNA target sequence
ttaatttatatcagaatgttc

SEQ ID NO: 40182 - DNA, 21 bp, Artificial sequence
  SiRNA target sequence
taatttatatcagaatgttcc

SEQ ID NO: 40183 - DNA, 21 bp, Artificial sequence
  SiRNA target sequence
aatttatatcagaatgttcct

SEQ ID NO: 40184 - DNA, 21 bp, Artificial sequence
  SiRNA target sequence
atttatatcagaatgttcctg

SEQ ID NO: 40185 - DNA, 21 bp, Artificial sequence
  SiRNA target sequence
tttatatcagaatgttcctgg

SEQ ID NO: 40186 - DNA, 21 bp, Artificial sequence
  SiRNA target sequence
ttatatcagaatgttcctgga

SEQ ID NO: 40187 - DNA, 21 bp, Artificial sequence
  SiRNA target sequence
tatatcagaatgttcctggat

SEQ ID NO: 40188 - DNA, 21 bp, Artificial sequence
  SiRNA target sequence
atatcagaatgttcctggatg

SEQ ID NO: 40189 - DNA, 21 bp, Artificial sequence
  SiRNA target sequence
tatcagaatgttcctggatgg

SEQ ID NO: 40190 - DNA, 21 bp, Artificial sequence
  SiRNA target sequence
atcagaatgttcctggatggg

SEQ ID NO: 40191 - DNA, 21 bp, Artificial sequence
  SiRNA target sequence
tcagaatgttcctggatgggg

SEQ ID NO: 40192 - DNA, 21 bp, Artificial sequence
  SiRNA target sequence
cagaatgttcctggatggggt

SEQ ID NO: 40193 - DNA, 21 bp, Artificial sequence
  SiRNA target sequence
agaatgttcctggatggggtt

SEQ ID NO: 40194 - DNA, 21 bp, Artificial sequence
  SiRNA target sequence
gaatgttcctggatggggtta

SEQ ID NO: 40195 - DNA, 21 bp, Artificial sequence
  SiRNA target sequence
aatgttcctggatggggttat

SEQ ID NO: 40196 - DNA, 21 bp, Artificial sequence
  SiRNA target sequence
atgttcctggatggggttatt

SEQ ID NO: 40197 - DNA, 21 bp, Artificial sequence
  SiRNA target sequence
tgttcctggatggggttattc

SEQ ID NO: 40198 - DNA, 21 bp, Artificial sequence
  SiRNA target sequence
gttcctggatggggttattca

SEQ ID NO: 40199 - DNA, 21 bp, Artificial sequence
  SiRNA target sequence
ttcctggatggggttattcac

SEQ ID NO: 40200 - DNA, 21 bp, Artificial sequence
  SiRNA target sequence
tcctggatggggttattcact

SEQ ID NO: 40201 - DNA, 21 bp, Artificial sequence
  SiRNA target sequence
cctggatggggttattcactc

SEQ ID NO: 40202 - DNA, 21 bp, Artificial sequence
  SiRNA target sequence
ctggatggggttattcactct

SEQ ID NO: 40203 - DNA, 21 bp, Artificial sequence
  SiRNA target sequence
tggatggggttattcactcta

SEQ ID NO: 40204 - DNA, 21 bp, Artificial sequence
  SiRNA target sequence
ggatggggttattcactctat

SEQ ID NO: 40205 - DNA, 21 bp, Artificial sequence
  SiRNA target sequence
gatggggttattcactctata

SEQ ID NO: 40206 - DNA, 21 bp, Artificial sequence
  SiRNA target sequence
atggggttattcactctataa

SEQ ID NO: 40207 - DNA, 21 bp, Artificial sequence
  SiRNA target sequence
tggggttattcactctataag

SEQ ID NO: 40208 - DNA, 21 bp, Artificial sequence
  SiRNA target sequence
ggggttattcactctataagg

SEQ ID NO: 40209 - DNA, 21 bp, Artificial sequence
  SiRNA target sequence
gggttattcactctataaggg

SEQ ID NO: 40210 - DNA, 21 bp, Artificial sequence
  SiRNA target sequence
ggttattcactctataaggga

SEQ ID NO: 40211 - DNA, 21 bp, Artificial sequence
  SiRNA target sequence
gttattcactctataagggaa

SEQ ID NO: 40212 - DNA, 21 bp, Artificial sequence
  SiRNA target sequence
ttattcactctataagggaat

SEQ ID NO: 40213 - DNA, 21 bp, Artificial sequence
  SiRNA target sequence
tattcactctataagggaata

SEQ ID NO: 40214 - DNA, 21 bp, Artificial sequence
  SiRNA target sequence
attcactctataagggaatag

SEQ ID NO: 40215 - DNA, 21 bp, Artificial sequence
  SiRNA target sequence
ttcactctataagggaataga

SEQ ID NO: 40216 - DNA, 21 bp, Artificial sequence
  SiRNA target sequence
tcactctataagggaatagat

SEQ ID NO: 40217 - DNA, 21 bp, Artificial sequence
  SiRNA target sequence
cactctataagggaatagata

SEQ ID NO: 40218 - DNA, 21 bp, Artificial sequence
  SiRNA target sequence
actctataagggaatagataa

SEQ ID NO: 40219 - DNA, 21 bp, Artificial sequence
  SiRNA target sequence
ctctataagggaatagataat

SEQ ID NO: 40220 - DNA, 21 bp, Artificial sequence
  SiRNA target sequence
tctataagggaatagataata

SEQ ID NO: 40221 - DNA, 21 bp, Artificial sequence
  SiRNA target sequence
ctataagggaatagataatag

SEQ ID NO: 40222 - DNA, 21 bp, Artificial sequence
  SiRNA target sequence
tataagggaatagataatagt

SEQ ID NO: 40223 - DNA, 21 bp, Artificial sequence
  SiRNA target sequence
ataagggaatagataatagtg

SEQ ID NO: 40224 - DNA, 21 bp, Artificial sequence
  SiRNA target sequence
taagggaatagataatagtgt

SEQ ID NO: 40225 - DNA, 21 bp, Artificial sequence
  SiRNA target sequence
aagggaatagataatagtgtg

SEQ ID NO: 40226 - DNA, 21 bp, Artificial sequence
  SiRNA target sequence
agggaatagataatagtgtgc

SEQ ID NO: 40227 - DNA, 21 bp, Artificial sequence
  SiRNA target sequence
gggaatagataatagtgtgcc

SEQ ID NO: 40228 - DNA, 21 bp, Artificial sequence
  SiRNA target sequence
ggaatagataatagtgtgcca

SEQ ID NO: 40229 - DNA, 21 bp, Artificial sequence
  SiRNA target sequence
gaatagataatagtgtgccat

SEQ ID NO: 40230 - DNA, 21 bp, Artificial sequence
  SiRNA target sequence
aatagataatagtgtgccatt

SEQ ID NO: 40231 - DNA, 21 bp, Artificial sequence
  SiRNA target sequence
atagataatagtgtgccattg

SEQ ID NO: 40232 - DNA, 21 bp, Artificial sequence
  SiRNA target sequence
tagataatagtgtgccattgg

SEQ ID NO: 40233 - DNA, 21 bp, Artificial sequence
  SiRNA target sequence
agataatagtgtgccattggc

SEQ ID NO: 40234 - DNA, 21 bp, Artificial sequence
  SiRNA target sequence
gataatagtgtgccattggct

SEQ ID NO: 40235 - DNA, 21 bp, Artificial sequence
  SiRNA target sequence
ataatagtgtgccattggctt

SEQ ID NO: 40236 - DNA, 21 bp, Artificial sequence
  SiRNA target sequence
taatagtgtgccattggcttt

SEQ ID NO: 40237 - DNA, 21 bp, Artificial sequence
  SiRNA target sequence
aatagtgtgccattggctttt

SEQ ID NO: 40238 - DNA, 21 bp, Artificial sequence
  SiRNA target sequence
atagtgtgccattggcttttg

SEQ ID NO: 40239 - DNA, 21 bp, Artificial sequence
  SiRNA target sequence
tagtgtgccattggcttttga

SEQ ID NO: 40240 - DNA, 21 bp, Artificial sequence
  SiRNA target sequence
agtgtgccattggcttttgac

SEQ ID NO: 40241 - DNA, 21 bp, Artificial sequence
  SiRNA target sequence
gtgtgccattggcttttgacc

SEQ ID NO: 40242 - DNA, 21 bp, Artificial sequence
  SiRNA target sequence
tgtgccattggcttttgaccc

SEQ ID NO: 40243 - DNA, 21 bp, Artificial sequence
  SiRNA target sequence
gtgccattggcttttgacccc

SEQ ID NO: 40244 - DNA, 21 bp, Artificial sequence
  SiRNA target sequence
tgccattggcttttgacccca

SEQ ID NO: 40245 - DNA, 21 bp, Artificial sequence
  SiRNA target sequence
gccattggcttttgaccccaa

SEQ ID NO: 40246 - DNA, 21 bp, Artificial sequence
  SiRNA target sequence
ccattggcttttgaccccaat

SEQ ID NO: 40247 - DNA, 21 bp, Artificial sequence
  SiRNA target sequence
cattggcttttgaccccaata

SEQ ID NO: 40248 - DNA, 21 bp, Artificial sequence
  SiRNA target sequence
attggcttttgaccccaataa

SEQ ID NO: 40249 - DNA, 21 bp, Artificial sequence
  SiRNA target sequence
ttggcttttgaccccaataac

SEQ ID NO: 40250 - DNA, 21 bp, Artificial sequence
  SiRNA target sequence
tggcttttgaccccaataacg

SEQ ID NO: 40251 - DNA, 21 bp, Artificial sequence
  SiRNA target sequence
ggcttttgaccccaataacga

SEQ ID NO: 40252 - DNA, 21 bp, Artificial sequence
  SiRNA target sequence
gcttttgaccccaataacgaa

SEQ ID NO: 40253 - DNA, 21 bp, Artificial sequence
  SiRNA target sequence
cttttgaccccaataacgaac

SEQ ID NO: 40254 - DNA, 21 bp, Artificial sequence
  SiRNA target sequence
ttttgaccccaataacgaact

SEQ ID NO: 40255 - DNA, 21 bp, Artificial sequence
  SiRNA target sequence
tttgaccccaataacgaacta

SEQ ID NO: 40256 - DNA, 21 bp, Artificial sequence
  SiRNA target sequence
ttgaccccaataacgaactag

SEQ ID NO: 40257 - DNA, 21 bp, Artificial sequence
  SiRNA target sequence
tgaccccaataacgaactagg

SEQ ID NO: 40258 - DNA, 21 bp, Artificial sequence
  SiRNA target sequence
gaccccaataacgaactaggt

SEQ ID NO: 40259 - DNA, 21 bp, Artificial sequence
  SiRNA target sequence
accccaataacgaactaggtg

SEQ ID NO: 40260 - DNA, 21 bp, Artificial sequence
  SiRNA target sequence
ccccaataacgaactaggtga

SEQ ID NO: 40261 - DNA, 21 bp, Artificial sequence
  SiRNA target sequence
cccaataacgaactaggtgat

SEQ ID NO: 40262 - DNA, 21 bp, Artificial sequence
  SiRNA target sequence
ccaataacgaactaggtgatt

SEQ ID NO: 40263 - DNA, 21 bp, Artificial sequence
  SiRNA target sequence
caataacgaactaggtgattt

SEQ ID NO: 40264 - DNA, 21 bp, Artificial sequence
  SiRNA target sequence
aataacgaactaggtgatttg

SEQ ID NO: 40265 - DNA, 21 bp, Artificial sequence
  SiRNA target sequence
ataacgaactaggtgatttga

SEQ ID NO: 40266 - DNA, 21 bp, Artificial sequence
  SiRNA target sequence
taacgaactaggtgatttgag

SEQ ID NO: 40267 - DNA, 21 bp, Artificial sequence
  SiRNA target sequence
aacgaactaggtgatttgaga

SEQ ID NO: 40268 - DNA, 21 bp, Artificial sequence
  SiRNA target sequence
acgaactaggtgatttgagag

SEQ ID NO: 40269 - DNA, 21 bp, Artificial sequence
  SiRNA target sequence
cgaactaggtgatttgagaga

SEQ ID NO: 40270 - DNA, 21 bp, Artificial sequence
  SiRNA target sequence
gaactaggtgatttgagagat

SEQ ID NO: 40271 - DNA, 21 bp, Artificial sequence
  SiRNA target sequence
aactaggtgatttgagagatg

SEQ ID NO: 40272 - DNA, 21 bp, Artificial sequence
  SiRNA target sequence
actaggtgatttgagagatgt

SEQ ID NO: 40273 - DNA, 21 bp, Artificial sequence
  SiRNA target sequence
ctaggtgatttgagagatgta

SEQ ID NO: 40274 - DNA, 21 bp, Artificial sequence
  SiRNA target sequence
taggtgatttgagagatgtat

SEQ ID NO: 40275 - DNA, 21 bp, Artificial sequence
  SiRNA target sequence
aggtgatttgagagatgtatt

SEQ ID NO: 40276 - DNA, 21 bp, Artificial sequence
  SiRNA target sequence
ggtgatttgagagatgtattt

SEQ ID NO: 40277 - DNA, 21 bp, Artificial sequence
  SiRNA target sequence
gtgatttgagagatgtatttc

SEQ ID NO: 40278 - DNA, 21 bp, Artificial sequence
  SiRNA target sequence
tgatttgagagatgtatttcc

SEQ ID NO: 40279 - DNA, 21 bp, Artificial sequence
  SiRNA target sequence
gatttgagagatgtatttcct

SEQ ID NO: 40280 - DNA, 21 bp, Artificial sequence
  SiRNA target sequence
atttgagagatgtatttcctt

SEQ ID NO: 40281 - DNA, 21 bp, Artificial sequence
  SiRNA target sequence
tttgagagatgtatttccttc

SEQ ID NO: 40282 - DNA, 21 bp, Artificial sequence
  SiRNA target sequence
ttgagagatgtatttccttct

SEQ ID NO: 40283 - DNA, 21 bp, Artificial sequence
  SiRNA target sequence
tgagagatgtatttccttctg

SEQ ID NO: 40284 - DNA, 21 bp, Artificial sequence
  SiRNA target sequence
gagagatgtatttccttctgg

SEQ ID NO: 40285 - DNA, 21 bp, Artificial sequence
  SiRNA target sequence
agagatgtatttccttctgga

SEQ ID NO: 40286 - DNA, 21 bp, Artificial sequence
  SiRNA target sequence
gagatgtatttccttctggag

SEQ ID NO: 40287 - DNA, 21 bp, Artificial sequence
  SiRNA target sequence
agatgtatttccttctggagt

SEQ ID NO: 40288 - DNA, 21 bp, Artificial sequence
  SiRNA target sequence
gatgtatttccttctggagtt

SEQ ID NO: 40289 - DNA, 21 bp, Artificial sequence
  SiRNA target sequence
atgtatttccttctggagttg

SEQ ID NO: 40290 - DNA, 21 bp, Artificial sequence
  SiRNA target sequence
tgtatttccttctggagttga

SEQ ID NO: 40291 - DNA, 21 bp, Artificial sequence
  SiRNA target sequence
gtatttccttctggagttgat

SEQ ID NO: 40292 - DNA, 21 bp, Artificial sequence
  SiRNA target sequence
tatttccttctggagttgatg

SEQ ID NO: 40293 - DNA, 21 bp, Artificial sequence
  SiRNA target sequence
atttccttctggagttgatga

SEQ ID NO: 40294 - DNA, 21 bp, Artificial sequence
  SiRNA target sequence
tttccttctggagttgatgaa

SEQ ID NO: 40295 - DNA, 21 bp, Artificial sequence
  SiRNA target sequence
ttccttctggagttgatgaaa

SEQ ID NO: 40296 - DNA, 21 bp, Artificial sequence
  SiRNA target sequence
tccttctggagttgatgaaat

SEQ ID NO: 40297 - DNA, 21 bp, Artificial sequence
  SiRNA target sequence
ccttctggagttgatgaaatg

SEQ ID NO: 40298 - DNA, 21 bp, Artificial sequence
  SiRNA target sequence
cttctggagttgatgaaatgg

SEQ ID NO: 40299 - DNA, 21 bp, Artificial sequence
  SiRNA target sequence
ttctggagttgatgaaatggc

SEQ ID NO: 40300 - DNA, 21 bp, Artificial sequence
  SiRNA target sequence
tctggagttgatgaaatggcg

SEQ ID NO: 40301 - DNA, 21 bp, Artificial sequence
  SiRNA target sequence
ctggagttgatgaaatggcga

SEQ ID NO: 40302 - DNA, 21 bp, Artificial sequence
  SiRNA target sequence
tggagttgatgaaatggcgat

SEQ ID NO: 40303 - DNA, 21 bp, Artificial sequence
  SiRNA target sequence
ggagttgatgaaatggcgata

SEQ ID NO: 40304 - DNA, 21 bp, Artificial sequence
  SiRNA target sequence
gagttgatgaaatggcgatag

SEQ ID NO: 40305 - DNA, 21 bp, Artificial sequence
  SiRNA target sequence
agttgatgaaatggcgatagg

SEQ ID NO: 40306 - DNA, 21 bp, Artificial sequence
  SiRNA target sequence
gttgatgaaatggcgatagga

SEQ ID NO: 40307 - DNA, 21 bp, Artificial sequence
  SiRNA target sequence
ttgatgaaatggcgataggat

SEQ ID NO: 40308 - DNA, 21 bp, Artificial sequence
  SiRNA target sequence
tgatgaaatggcgataggata

SEQ ID NO: 40309 - DNA, 21 bp, Artificial sequence
  SiRNA target sequence
gatgaaatggcgataggatat

SEQ ID NO: 40310 - DNA, 21 bp, Artificial sequence
  SiRNA target sequence
atgaaatggcgataggatatg

SEQ ID NO: 40311 - DNA, 21 bp, Artificial sequence
  SiRNA target sequence
tgaaatggcgataggatatgt

SEQ ID NO: 40312 - DNA, 21 bp, Artificial sequence
  SiRNA target sequence
gaaatggcgataggatatgtt

SEQ ID NO: 40313 - DNA, 21 bp, Artificial sequence
  SiRNA target sequence
aaatggcgataggatatgttt

SEQ ID NO: 40314 - DNA, 21 bp, Artificial sequence
  SiRNA target sequence
aatggcgataggatatgtttg

SEQ ID NO: 40315 - DNA, 21 bp, Artificial sequence
  SiRNA target sequence
atggcgataggatatgtttgt

SEQ ID NO: 40316 - DNA, 21 bp, Artificial sequence
  SiRNA target sequence
tggcgataggatatgtttgtg

SEQ ID NO: 40317 - DNA, 21 bp, Artificial sequence
  SiRNA target sequence
ggcgataggatatgtttgtgg

SEQ ID NO: 40318 - DNA, 21 bp, Artificial sequence
  SiRNA target sequence
gcgataggatatgtttgtggc

SEQ ID NO: 40319 - DNA, 21 bp, Artificial sequence
  SiRNA target sequence
cgataggatatgtttgtggca

SEQ ID NO: 40320 - DNA, 21 bp, Artificial sequence
  SiRNA target sequence
gataggatatgtttgtggcaa

SEQ ID NO: 40321 - DNA, 21 bp, Artificial sequence
  SiRNA target sequence
ataggatatgtttgtggcaat

SEQ ID NO: 40322 - DNA, 21 bp, Artificial sequence
  SiRNA target sequence
taggatatgtttgtggcaatc

SEQ ID NO: 40323 - DNA, 21 bp, Artificial sequence
  SiRNA target sequence
aggatatgtttgtggcaatcc

SEQ ID NO: 40324 - DNA, 21 bp, Artificial sequence
  SiRNA target sequence
ggatatgtttgtggcaatcct

SEQ ID NO: 40325 - DNA, 21 bp, Artificial sequence
  SiRNA target sequence
gatatgtttgtggcaatcctg

SEQ ID NO: 40326 - DNA, 21 bp, Artificial sequence
  SiRNA target sequence
atatgtttgtggcaatcctgc

SEQ ID NO: 40327 - DNA, 21 bp, Artificial sequence
  SiRNA target sequence
tatgtttgtggcaatcctgct

SEQ ID NO: 40328 - DNA, 21 bp, Artificial sequence
  SiRNA target sequence
atgtttgtggcaatcctgctg

SEQ ID NO: 40329 - DNA, 21 bp, Artificial sequence
  SiRNA target sequence
tgtttgtggcaatcctgctgt

SEQ ID NO: 40330 - DNA, 21 bp, Artificial sequence
  SiRNA target sequence
gtttgtggcaatcctgctgtt

SEQ ID NO: 40331 - DNA, 21 bp, Artificial sequence
  SiRNA target sequence
tttgtggcaatcctgctgtta

SEQ ID NO: 40332 - DNA, 21 bp, Artificial sequence
  SiRNA target sequence
ttgtggcaatcctgctgttaa

SEQ ID NO: 40333 - DNA, 21 bp, Artificial sequence
  SiRNA target sequence
tgtggcaatcctgctgttaaa

SEQ ID NO: 40334 - DNA, 21 bp, Artificial sequence
  SiRNA target sequence
gtggcaatcctgctgttaaac

SEQ ID NO: 40335 - DNA, 21 bp, Artificial sequence
  SiRNA target sequence
tggcaatcctgctgttaaaca

SEQ ID NO: 40336 - DNA, 21 bp, Artificial sequence
  SiRNA target sequence
ggcaatcctgctgttaaacat

SEQ ID NO: 40337 - DNA, 21 bp, Artificial sequence
  SiRNA target sequence
gcaatcctgctgttaaacatg

SEQ ID NO: 40338 - DNA, 21 bp, Artificial sequence
  SiRNA target sequence
caatcctgctgttaaacatgt

SEQ ID NO: 40339 - DNA, 21 bp, Artificial sequence
  SiRNA target sequence
aatcctgctgttaaacatgtg

SEQ ID NO: 40340 - DNA, 21 bp, Artificial sequence
  SiRNA target sequence
atcctgctgttaaacatgtgc

SEQ ID NO: 40341 - DNA, 21 bp, Artificial sequence
  SiRNA target sequence
tcctgctgttaaacatgtgct

SEQ ID NO: 40342 - DNA, 21 bp, Artificial sequence
  SiRNA target sequence
cctgctgttaaacatgtgcta

SEQ ID NO: 40343 - DNA, 21 bp, Artificial sequence
  SiRNA target sequence
ctgctgttaaacatgtgctat

SEQ ID NO: 40344 - DNA, 21 bp, Artificial sequence
  SiRNA target sequence
tgctgttaaacatgtgctatc

SEQ ID NO: 40345 - DNA, 21 bp, Artificial sequence
  SiRNA target sequence
gctgttaaacatgtgctatct

SEQ ID NO: 40346 - DNA, 21 bp, Artificial sequence
  SiRNA target sequence
ctgttaaacatgtgctatctt

SEQ ID NO: 40347 - DNA, 21 bp, Artificial sequence
  SiRNA target sequence
tgttaaacatgtgctatcttg

SEQ ID NO: 40348 - DNA, 21 bp, Artificial sequence
  SiRNA target sequence
gttaaacatgtgctatcttgg

SEQ ID NO: 40349 - DNA, 21 bp, Artificial sequence
  SiRNA target sequence
ttaaacatgtgctatcttgga

SEQ ID NO: 40350 - DNA, 21 bp, Artificial sequence
  SiRNA target sequence
taaacatgtgctatcttggaa

SEQ ID NO: 40351 - DNA, 21 bp, Artificial sequence
  SiRNA target sequence
aaacatgtgctatcttggaat

SEQ ID NO: 40352 - DNA, 21 bp, Artificial sequence
  SiRNA target sequence
aacatgtgctatcttggaata

SEQ ID NO: 40353 - DNA, 21 bp, Artificial sequence
  SiRNA target sequence
acatgtgctatcttggaatac

SEQ ID NO: 40354 - DNA, 21 bp, Artificial sequence
  SiRNA target sequence
catgtgctatcttggaatact

SEQ ID NO: 40355 - DNA, 21 bp, Artificial sequence
  SiRNA target sequence
atgtgctatcttggaatacta

SEQ ID NO: 40356 - DNA, 21 bp, Artificial sequence
  SiRNA target sequence
tgtgctatcttggaatactac

SEQ ID NO: 40357 - DNA, 21 bp, Artificial sequence
  SiRNA target sequence
gtgctatcttggaatactacg

SEQ ID NO: 40358 - DNA, 21 bp, Artificial sequence
  SiRNA target sequence
tgctatcttggaatactacgg

SEQ ID NO: 40359 - DNA, 21 bp, Artificial sequence
  SiRNA target sequence
gctatcttggaatactacgga

SEQ ID NO: 40360 - DNA, 21 bp, Artificial sequence
  SiRNA target sequence
ctatcttggaatactacggat

SEQ ID NO: 40361 - DNA, 21 bp, Artificial sequence
  SiRNA target sequence
tatcttggaatactacggata

SEQ ID NO: 40362 - DNA, 21 bp, Artificial sequence
  SiRNA target sequence
atcttggaatactacggataa

SEQ ID NO: 40363 - DNA, 21 bp, Artificial sequence
  SiRNA target sequence
tcttggaatactacggataaa

SEQ ID NO: 40364 - DNA, 21 bp, Artificial sequence
  SiRNA target sequence
cttggaatactacggataaag

SEQ ID NO: 40365 - DNA, 21 bp, Artificial sequence
  SiRNA target sequence
ttggaatactacggataaagt

SEQ ID NO: 40366 - DNA, 21 bp, Artificial sequence
  SiRNA target sequence
tggaatactacggataaagtt

SEQ ID NO: 40367 - DNA, 21 bp, Artificial sequence
  SiRNA target sequence
ggaatactacggataaagttc

SEQ ID NO: 40368 - DNA, 21 bp, Artificial sequence
  SiRNA target sequence
gaatactacggataaagttca

SEQ ID NO: 40369 - DNA, 21 bp, Artificial sequence
  SiRNA target sequence
aatactacggataaagttcaa

SEQ ID NO: 40370 - DNA, 21 bp, Artificial sequence
  SiRNA target sequence
atactacggataaagttcaag

SEQ ID NO: 40371 - DNA, 21 bp, Artificial sequence
  SiRNA target sequence
tactacggataaagttcaagc

SEQ ID NO: 40372 - DNA, 21 bp, Artificial sequence
  SiRNA target sequence
actacggataaagttcaagca

SEQ ID NO: 40373 - DNA, 21 bp, Artificial sequence
  SiRNA target sequence
ctacggataaagttcaagcac

SEQ ID NO: 40374 - DNA, 21 bp, Artificial sequence
  SiRNA target sequence
tacggataaagttcaagcacc

SEQ ID NO: 40375 - DNA, 21 bp, Artificial sequence
  SiRNA target sequence
acggataaagttcaagcacca

SEQ ID NO: 40376 - DNA, 21 bp, Artificial sequence
  SiRNA target sequence
cggataaagttcaagcaccaa

SEQ ID NO: 40377 - DNA, 21 bp, Artificial sequence
  SiRNA target sequence
ggataaagttcaagcaccaat

SEQ ID NO: 40378 - DNA, 21 bp, Artificial sequence
  SiRNA target sequence
gataaagttcaagcaccaata

SEQ ID NO: 40379 - DNA, 21 bp, Artificial sequence
  SiRNA target sequence
ataaagttcaagcaccaataa

SEQ ID NO: 40380 - DNA, 21 bp, Artificial sequence
  SiRNA target sequence
taaagttcaagcaccaataag

SEQ ID NO: 40381 - DNA, 21 bp, Artificial sequence
  SiRNA target sequence
aaagttcaagcaccaataagt

SEQ ID NO: 40382 - DNA, 21 bp, Artificial sequence
  SiRNA target sequence
aagttcaagcaccaataagta

SEQ ID NO: 40383 - DNA, 21 bp, Artificial sequence
  SiRNA target sequence
agttcaagcaccaataagtaa

SEQ ID NO: 40384 - DNA, 21 bp, Artificial sequence
  SiRNA target sequence
gttcaagcaccaataagtaat

SEQ ID NO: 40385 - DNA, 21 bp, Artificial sequence
  SiRNA target sequence
ttcaagcaccaataagtaatg

SEQ ID NO: 40386 - DNA, 21 bp, Artificial sequence
  SiRNA target sequence
tcaagcaccaataagtaatgg

SEQ ID NO: 40387 - DNA, 21 bp, Artificial sequence
  SiRNA target sequence
caagcaccaataagtaatgga

SEQ ID NO: 40388 - DNA, 21 bp, Artificial sequence
  SiRNA target sequence
aagcaccaataagtaatggag

SEQ ID NO: 40389 - DNA, 21 bp, Artificial sequence
  SiRNA target sequence
agcaccaataagtaatggaga

SEQ ID NO: 40390 - DNA, 21 bp, Artificial sequence
  SiRNA target sequence
gcaccaataagtaatggagat

SEQ ID NO: 40391 - DNA, 21 bp, Artificial sequence
  SiRNA target sequence
caccaataagtaatggagatg

SEQ ID NO: 40392 - DNA, 21 bp, Artificial sequence
  SiRNA target sequence
accaataagtaatggagatga

SEQ ID NO: 40393 - DNA, 21 bp, Artificial sequence
  SiRNA target sequence
ccaataagtaatggagatgac

SEQ ID NO: 40394 - DNA, 21 bp, Artificial sequence
  SiRNA target sequence
caataagtaatggagatgact

SEQ ID NO: 40395 - DNA, 21 bp, Artificial sequence
  SiRNA target sequence
aataagtaatggagatgactg

SEQ ID NO: 40396 - DNA, 21 bp, Artificial sequence
  SiRNA target sequence
ataagtaatggagatgactgg

SEQ ID NO: 40397 - DNA, 21 bp, Artificial sequence
  SiRNA target sequence
taagtaatggagatgactggg

SEQ ID NO: 40398 - DNA, 21 bp, Artificial sequence
  SiRNA target sequence
aagtaatggagatgactgggg

SEQ ID NO: 40399 - DNA, 21 bp, Artificial sequence
  SiRNA target sequence
agtaatggagatgactgggga

SEQ ID NO: 40400 - DNA, 21 bp, Artificial sequence
  SiRNA target sequence
gtaatggagatgactggggag

SEQ ID NO: 40401 - DNA, 21 bp, Artificial sequence
  SiRNA target sequence
taatggagatgactggggagg

SEQ ID NO: 40402 - DNA, 21 bp, Artificial sequence
  SiRNA target sequence
aatggagatgactggggagga

SEQ ID NO: 40403 - DNA, 21 bp, Artificial sequence
  SiRNA target sequence
atggagatgactggggaggag

SEQ ID NO: 40404 - DNA, 21 bp, Artificial sequence
  SiRNA target sequence
tggagatgactggggaggagt

SEQ ID NO: 40405 - DNA, 21 bp, Artificial sequence
  SiRNA target sequence
ggagatgactggggaggagtg

SEQ ID NO: 40406 - DNA, 21 bp, Artificial sequence
  SiRNA target sequence
gagatgactggggaggagtga

SEQ ID NO: 40407 - DNA, 21 bp, Artificial sequence
  SiRNA target sequence
agatgactggggaggagtgat

SEQ ID NO: 40408 - DNA, 21 bp, Artificial sequence
  SiRNA target sequence
gatgactggggaggagtgata

SEQ ID NO: 40409 - DNA, 21 bp, Artificial sequence
  SiRNA target sequence
atgactggggaggagtgatac

SEQ ID NO: 40410 - DNA, 21 bp, Artificial sequence
  SiRNA target sequence
tgactggggaggagtgatacc

SEQ ID NO: 40411 - DNA, 21 bp, Artificial sequence
  SiRNA target sequence
gactggggaggagtgatacct

SEQ ID NO: 40412 - DNA, 21 bp, Artificial sequence
  SiRNA target sequence
actggggaggagtgatacctg

SEQ ID NO: 40413 - DNA, 21 bp, Artificial sequence
  SiRNA target sequence
ctggggaggagtgatacctgt

SEQ ID NO: 40414 - DNA, 21 bp, Artificial sequence
  SiRNA target sequence
tggggaggagtgatacctgtt

SEQ ID NO: 40415 - DNA, 21 bp, Artificial sequence
  SiRNA target sequence
ggggaggagtgatacctgttg

SEQ ID NO: 40416 - DNA, 21 bp, Artificial sequence
  SiRNA target sequence
gggaggagtgatacctgttgg

SEQ ID NO: 40417 - DNA, 21 bp, Artificial sequence
  SiRNA target sequence
ggaggagtgatacctgttggt

SEQ ID NO: 40418 - DNA, 21 bp, Artificial sequence
  SiRNA target sequence
gaggagtgatacctgttggta

SEQ ID NO: 40419 - DNA, 21 bp, Artificial sequence
  SiRNA target sequence
aggagtgatacctgttggtat

SEQ ID NO: 40420 - DNA, 21 bp, Artificial sequence
  SiRNA target sequence
ggagtgatacctgttggtatg

SEQ ID NO: 40421 - DNA, 21 bp, Artificial sequence
  SiRNA target sequence
gagtgatacctgttggtatgc

SEQ ID NO: 40422 - DNA, 21 bp, Artificial sequence
  SiRNA target sequence
agtgatacctgttggtatgcc

SEQ ID NO: 40423 - DNA, 21 bp, Artificial sequence
  SiRNA target sequence
gtgatacctgttggtatgcca

SEQ ID NO: 40424 - DNA, 21 bp, Artificial sequence
  SiRNA target sequence
tgatacctgttggtatgccat

SEQ ID NO: 40425 - DNA, 21 bp, Artificial sequence
  SiRNA target sequence
gatacctgttggtatgccatg

SEQ ID NO: 40426 - DNA, 21 bp, Artificial sequence
  SiRNA target sequence
atacctgttggtatgccatgt

SEQ ID NO: 40427 - DNA, 21 bp, Artificial sequence
  SiRNA target sequence
tacctgttggtatgccatgtt

SEQ ID NO: 40428 - DNA, 21 bp, Artificial sequence
  SiRNA target sequence
acctgttggtatgccatgtta

SEQ ID NO: 40429 - DNA, 21 bp, Artificial sequence
  SiRNA target sequence
cctgttggtatgccatgttat

SEQ ID NO: 40430 - DNA, 21 bp, Artificial sequence
  SiRNA target sequence
ctgttggtatgccatgttatt

SEQ ID NO: 40431 - DNA, 21 bp, Artificial sequence
  SiRNA target sequence
tgttggtatgccatgttattc

SEQ ID NO: 40432 - DNA, 21 bp, Artificial sequence
  SiRNA target sequence
gttggtatgccatgttattct

SEQ ID NO: 40433 - DNA, 21 bp, Artificial sequence
  SiRNA target sequence
ttggtatgccatgttattcta

SEQ ID NO: 40434 - DNA, 21 bp, Artificial sequence
  SiRNA target sequence
tggtatgccatgttattctaa

SEQ ID NO: 40435 - DNA, 21 bp, Artificial sequence
  SiRNA target sequence
ggtatgccatgttattctaaa

SEQ ID NO: 40436 - DNA, 21 bp, Artificial sequence
  SiRNA target sequence
gtatgccatgttattctaaaa

SEQ ID NO: 40437 - DNA, 21 bp, Artificial sequence
  SiRNA target sequence
tatgccatgttattctaaaat

SEQ ID NO: 40438 - DNA, 21 bp, Artificial sequence
  SiRNA target sequence
atgccatgttattctaaaatc

SEQ ID NO: 40439 - DNA, 21 bp, Artificial sequence
  SiRNA target sequence
tgccatgttattctaaaatca

SEQ ID NO: 40440 - DNA, 21 bp, Artificial sequence
  SiRNA target sequence
gccatgttattctaaaatcat

SEQ ID NO: 40441 - DNA, 21 bp, Artificial sequence
  SiRNA target sequence
ccatgttattctaaaatcata

SEQ ID NO: 40442 - DNA, 21 bp, Artificial sequence
  SiRNA target sequence
catgttattctaaaatcatac

SEQ ID NO: 40443 - DNA, 21 bp, Artificial sequence
  SiRNA target sequence
atgttattctaaaatcatacg

SEQ ID NO: 40444 - DNA, 21 bp, Artificial sequence
  SiRNA target sequence
tgttattctaaaatcatacgg

SEQ ID NO: 40445 - DNA, 21 bp, Artificial sequence
  SiRNA target sequence
gttattctaaaatcatacgga

SEQ ID NO: 40446 - DNA, 21 bp, Artificial sequence
  SiRNA target sequence
ttattctaaaatcatacggac

SEQ ID NO: 40447 - DNA, 21 bp, Artificial sequence
  SiRNA target sequence
tattctaaaatcatacggaca

SEQ ID NO: 40448 - DNA, 21 bp, Artificial sequence
  SiRNA target sequence
attctaaaatcatacggacaa

SEQ ID NO: 40449 - DNA, 21 bp, Artificial sequence
  SiRNA target sequence
ttctaaaatcatacggacaac

SEQ ID NO: 40450 - DNA, 21 bp, Artificial sequence
  SiRNA target sequence
tctaaaatcatacggacaaca

SEQ ID NO: 40451 - DNA, 21 bp, Artificial sequence
  SiRNA target sequence
ctaaaatcatacggacaacag

SEQ ID NO: 40452 - DNA, 21 bp, Artificial sequence
  SiRNA target sequence
taaaatcatacggacaacaga

SEQ ID NO: 40453 - DNA, 21 bp, Artificial sequence
  SiRNA target sequence
aaaatcatacggacaacagag

SEQ ID NO: 40454 - DNA, 21 bp, Artificial sequence
  SiRNA target sequence
aaatcatacggacaacagaga

SEQ ID NO: 40455 - DNA, 21 bp, Artificial sequence
  SiRNA target sequence
aatcatacggacaacagagaa

SEQ ID NO: 40456 - DNA, 21 bp, Artificial sequence
  SiRNA target sequence
atcatacggacaacagagaac

SEQ ID NO: 40457 - DNA, 21 bp, Artificial sequence
  SiRNA target sequence
tcatacggacaacagagaacg

SEQ ID NO: 40458 - DNA, 21 bp, Artificial sequence
  SiRNA target sequence
catacggacaacagagaacga

SEQ ID NO: 40459 - DNA, 21 bp, Artificial sequence
  SiRNA target sequence
atacggacaacagagaacgat

SEQ ID NO: 40460 - DNA, 21 bp, Artificial sequence
  SiRNA target sequence
tacggacaacagagaacgata

SEQ ID NO: 40461 - DNA, 21 bp, Artificial sequence
  SiRNA target sequence
acggacaacagagaacgatac

SEQ ID NO: 40462 - DNA, 21 bp, Artificial sequence
  SiRNA target sequence
cggacaacagagaacgatacg

SEQ ID NO: 40463 - DNA, 21 bp, Artificial sequence
  SiRNA target sequence
ggacaacagagaacgatacga

SEQ ID NO: 40464 - DNA, 21 bp, Artificial sequence
  SiRNA target sequence
gacaacagagaacgatacgac

SEQ ID NO: 40465 - DNA, 21 bp, Artificial sequence
  SiRNA target sequence
acaacagagaacgatacgaca

SEQ ID NO: 40466 - DNA, 21 bp, Artificial sequence
  SiRNA target sequence
caacagagaacgatacgacac

SEQ ID NO: 40467 - DNA, 21 bp, Artificial sequence
  SiRNA target sequence
aacagagaacgatacgacacg

SEQ ID NO: 40468 - DNA, 21 bp, Artificial sequence
  SiRNA target sequence
acagagaacgatacgacacgg

SEQ ID NO: 40469 - DNA, 21 bp, Artificial sequence
  SiRNA target sequence
cagagaacgatacgacacgga

SEQ ID NO: 40470 - DNA, 21 bp, Artificial sequence
  SiRNA target sequence
agagaacgatacgacacggac

SEQ ID NO: 40471 - DNA, 21 bp, Artificial sequence
  SiRNA target sequence
gagaacgatacgacacggact

SEQ ID NO: 40472 - DNA, 21 bp, Artificial sequence
  SiRNA target sequence
agaacgatacgacacggacta

SEQ ID NO: 40473 - DNA, 21 bp, Artificial sequence
  SiRNA target sequence
gaacgatacgacacggactaa

SEQ ID NO: 40474 - DNA, 21 bp, Artificial sequence
  SiRNA target sequence
aacgatacgacacggactaat

SEQ ID NO: 40475 - DNA, 21 bp, Artificial sequence
  SiRNA target sequence
acgatacgacacggactaata

SEQ ID NO: 40476 - DNA, 21 bp, Artificial sequence
  SiRNA target sequence
cgatacgacacggactaatac

SEQ ID NO: 40477 - DNA, 21 bp, Artificial sequence
  SiRNA target sequence
gatacgacacggactaatact

SEQ ID NO: 40478 - DNA, 21 bp, Artificial sequence
  SiRNA target sequence
atacgacacggactaatactg

SEQ ID NO: 40479 - DNA, 21 bp, Artificial sequence
  SiRNA target sequence
tacgacacggactaatactga

SEQ ID NO: 40480 - DNA, 21 bp, Artificial sequence
  SiRNA target sequence
acgacacggactaatactgaa

SEQ ID NO: 40481 - DNA, 21 bp, Artificial sequence
  SiRNA target sequence
cgacacggactaatactgaaa

SEQ ID NO: 40482 - DNA, 21 bp, Artificial sequence
  SiRNA target sequence
gacacggactaatactgaaat

SEQ ID NO: 40483 - DNA, 21 bp, Artificial sequence
  SiRNA target sequence
acacggactaatactgaaatt

SEQ ID NO: 40484 - DNA, 21 bp, Artificial sequence
  SiRNA target sequence
cacggactaatactgaaatta

SEQ ID NO: 40485 - DNA, 21 bp, Artificial sequence
  SiRNA target sequence
acggactaatactgaaattat

SEQ ID NO: 40486 - DNA, 21 bp, Artificial sequence
  SiRNA target sequence
cggactaatactgaaattatg

SEQ ID NO: 40487 - DNA, 21 bp, Artificial sequence
  SiRNA target sequence
ggactaatactgaaattatgg

SEQ ID NO: 40488 - DNA, 21 bp, Artificial sequence
  SiRNA target sequence
gactaatactgaaattatgga

SEQ ID NO: 40489 - DNA, 21 bp, Artificial sequence
  SiRNA target sequence
actaatactgaaattatggat

SEQ ID NO: 40490 - DNA, 21 bp, Artificial sequence
  SiRNA target sequence
ctaatactgaaattatggatc

SEQ ID NO: 40491 - DNA, 21 bp, Artificial sequence
  SiRNA target sequence
taatactgaaattatggatcc

SEQ ID NO: 40492 - DNA, 21 bp, Artificial sequence
  SiRNA target sequence
aatactgaaattatggatcct

SEQ ID NO: 40493 - DNA, 21 bp, Artificial sequence
  SiRNA target sequence
atactgaaattatggatcctg

SEQ ID NO: 40494 - DNA, 21 bp, Artificial sequence
  SiRNA target sequence
tactgaaattatggatcctgc

SEQ ID NO: 40495 - DNA, 21 bp, Artificial sequence
  SiRNA target sequence
actgaaattatggatcctgcc

SEQ ID NO: 40496 - DNA, 21 bp, Artificial sequence
  SiRNA target sequence
ctgaaattatggatcctgccc

SEQ ID NO: 40497 - DNA, 21 bp, Artificial sequence
  SiRNA target sequence
tgaaattatggatcctgcccc

SEQ ID NO: 40498 - DNA, 21 bp, Artificial sequence
  SiRNA target sequence
gaaattatggatcctgcccct

SEQ ID NO: 40499 - DNA, 21 bp, Artificial sequence
  SiRNA target sequence
aaattatggatcctgcccctt

SEQ ID NO: 40500 - DNA, 21 bp, Artificial sequence
  SiRNA target sequence
aattatggatcctgccccttg

SEQ ID NO: 40501 - DNA, 21 bp, Artificial sequence
  SiRNA target sequence
attatggatcctgccccttgt

SEQ ID NO: 40502 - DNA, 21 bp, Artificial sequence
  SiRNA target sequence
ttatggatcctgccccttgtg

SEQ ID NO: 40503 - DNA, 21 bp, Artificial sequence
  SiRNA target sequence
tatggatcctgccccttgtga

SEQ ID NO: 40504 - DNA, 21 bp, Artificial sequence
  SiRNA target sequence
atggatcctgccccttgtgaa

SEQ ID NO: 40505 - DNA, 21 bp, Artificial sequence
  SiRNA target sequence
tggatcctgccccttgtgaat

SEQ ID NO: 40506 - DNA, 21 bp, Artificial sequence
  SiRNA target sequence
ggatcctgccccttgtgaata

SEQ ID NO: 40507 - DNA, 21 bp, Artificial sequence
  SiRNA target sequence
gatcctgccccttgtgaatat

SEQ ID NO: 40508 - DNA, 21 bp, Artificial sequence
  SiRNA target sequence
atcctgccccttgtgaatatg

SEQ ID NO: 40509 - DNA, 21 bp, Artificial sequence
  SiRNA target sequence
tcctgccccttgtgaatatgt

SEQ ID NO: 40510 - DNA, 21 bp, Artificial sequence
  SiRNA target sequence
cctgccccttgtgaatatgtt

SEQ ID NO: 40511 - DNA, 21 bp, Artificial sequence
  SiRNA target sequence
ctgccccttgtgaatatgttt

SEQ ID NO: 40512 - DNA, 21 bp, Artificial sequence
  SiRNA target sequence
tgccccttgtgaatatgtttg

SEQ ID NO: 40513 - DNA, 21 bp, Artificial sequence
  SiRNA target sequence
gccccttgtgaatatgtttgc

SEQ ID NO: 40514 - DNA, 21 bp, Artificial sequence
  SiRNA target sequence
ccccttgtgaatatgtttgca

SEQ ID NO: 40515 - DNA, 21 bp, Artificial sequence
  SiRNA target sequence
cccttgtgaatatgtttgcaa

SEQ ID NO: 40516 - DNA, 21 bp, Artificial sequence
  SiRNA target sequence
ccttgtgaatatgtttgcaat

SEQ ID NO: 40517 - DNA, 21 bp, Artificial sequence
  SiRNA target sequence
cttgtgaatatgtttgcaata

SEQ ID NO: 40518 - DNA, 21 bp, Artificial sequence
  SiRNA target sequence
ttgtgaatatgtttgcaatat

SEQ ID NO: 40519 - DNA, 21 bp, Artificial sequence
  SiRNA target sequence
tgtgaatatgtttgcaatatg

SEQ ID NO: 40520 - DNA, 21 bp, Artificial sequence
  SiRNA target sequence
gtgaatatgtttgcaatatgt

SEQ ID NO: 40521 - DNA, 21 bp, Artificial sequence
  SiRNA target sequence
tgaatatgtttgcaatatgtt

SEQ ID NO: 40522 - DNA, 21 bp, Artificial sequence
  SiRNA target sequence
gaatatgtttgcaatatgttt

SEQ ID NO: 40523 - DNA, 21 bp, Artificial sequence
  SiRNA target sequence
aatatgtttgcaatatgtttt

SEQ ID NO: 40524 - DNA, 21 bp, Artificial sequence
  SiRNA target sequence
atatgtttgcaatatgttttc

SEQ ID NO: 40525 - DNA, 21 bp, Artificial sequence
  SiRNA target sequence
tatgtttgcaatatgttttca

SEQ ID NO: 40526 - DNA, 21 bp, Artificial sequence
  SiRNA target sequence
atgtttgcaatatgttttcat

SEQ ID NO: 40527 - DNA, 21 bp, Artificial sequence
  SiRNA target sequence
tgtttgcaatatgttttcata

SEQ ID NO: 40528 - DNA, 21 bp, Artificial sequence
  SiRNA target sequence
gtttgcaatatgttttcatat

SEQ ID NO: 40529 - DNA, 21 bp, Artificial sequence
  SiRNA target sequence
tttgcaatatgttttcatatt

SEQ ID NO: 40530 - DNA, 21 bp, Artificial sequence
  SiRNA target sequence
ttgcaatatgttttcatattg

SEQ ID NO: 40531 - DNA, 21 bp, Artificial sequence
  SiRNA target sequence
tgcaatatgttttcatattgg

SEQ ID NO: 40532 - DNA, 21 bp, Artificial sequence
  SiRNA target sequence
gcaatatgttttcatattggc

SEQ ID NO: 40533 - DNA, 21 bp, Artificial sequence
  SiRNA target sequence
caatatgttttcatattggcg

SEQ ID NO: 40534 - DNA, 21 bp, Artificial sequence
  SiRNA target sequence
aatatgttttcatattggcga

SEQ ID NO: 40535 - DNA, 21 bp, Artificial sequence
  SiRNA target sequence
atatgttttcatattggcgag

SEQ ID NO: 40536 - DNA, 21 bp, Artificial sequence
  SiRNA target sequence
tatgttttcatattggcgagc

SEQ ID NO: 40537 - DNA, 21 bp, Artificial sequence
  SiRNA target sequence
atgttttcatattggcgagct

SEQ ID NO: 40538 - DNA, 21 bp, Artificial sequence
  SiRNA target sequence
tgttttcatattggcgagcta

SEQ ID NO: 40539 - DNA, 21 bp, Artificial sequence
  SiRNA target sequence
gttttcatattggcgagctac

SEQ ID NO: 40540 - DNA, 21 bp, Artificial sequence
  SiRNA target sequence
ttttcatattggcgagctact

SEQ ID NO: 40541 - DNA, 21 bp, Artificial sequence
  SiRNA target sequence
tttcatattggcgagctacta

SEQ ID NO: 40542 - DNA, 21 bp, Artificial sequence
  SiRNA target sequence
ttcatattggcgagctactat

SEQ ID NO: 40543 - DNA, 21 bp, Artificial sequence
  SiRNA target sequence
tcatattggcgagctactatg

SEQ ID NO: 40544 - DNA, 21 bp, Artificial sequence
  SiRNA target sequence
catattggcgagctactatgt

SEQ ID NO: 40545 - DNA, 21 bp, Artificial sequence
  SiRNA target sequence
atattggcgagctactatgtg

SEQ ID NO: 40546 - DNA, 21 bp, Artificial sequence
  SiRNA target sequence
tattggcgagctactatgtgc

SEQ ID NO: 40547 - DNA, 21 bp, Artificial sequence
  SiRNA target sequence
attggcgagctactatgtgct

SEQ ID NO: 40548 - DNA, 21 bp, Artificial sequence
  SiRNA target sequence
ttggcgagctactatgtgcta

SEQ ID NO: 40549 - DNA, 21 bp, Artificial sequence
  SiRNA target sequence
tggcgagctactatgtgctat

SEQ ID NO: 40550 - DNA, 21 bp, Artificial sequence
  SiRNA target sequence
ggcgagctactatgtgctatc

SEQ ID NO: 40551 - DNA, 21 bp, Artificial sequence
  SiRNA target sequence
gcgagctactatgtgctatcg

SEQ ID NO: 40552 - DNA, 21 bp, Artificial sequence
  SiRNA target sequence
cgagctactatgtgctatcgt

SEQ ID NO: 40553 - DNA, 21 bp, Artificial sequence
  SiRNA target sequence
gagctactatgtgctatcgta

SEQ ID NO: 40554 - DNA, 21 bp, Artificial sequence
  SiRNA target sequence
agctactatgtgctatcgtat

SEQ ID NO: 40555 - DNA, 21 bp, Artificial sequence
  SiRNA target sequence
gctactatgtgctatcgtata

SEQ ID NO: 40556 - DNA, 21 bp, Artificial sequence
  SiRNA target sequence
ctactatgtgctatcgtatag

SEQ ID NO: 40557 - DNA, 21 bp, Artificial sequence
  SiRNA target sequence
tactatgtgctatcgtatagc

SEQ ID NO: 40558 - DNA, 21 bp, Artificial sequence
  SiRNA target sequence
actatgtgctatcgtatagct

SEQ ID NO: 40559 - DNA, 21 bp, Artificial sequence
  SiRNA target sequence
ctatgtgctatcgtatagcta

SEQ ID NO: 40560 - DNA, 21 bp, Artificial sequence
  SiRNA target sequence
tatgtgctatcgtatagctat

SEQ ID NO: 40561 - DNA, 21 bp, Artificial sequence
  SiRNA target sequence
atgtgctatcgtatagctata

SEQ ID NO: 40562 - DNA, 21 bp, Artificial sequence
  SiRNA target sequence
tgtgctatcgtatagctatag

SEQ ID NO: 40563 - DNA, 21 bp, Artificial sequence
  SiRNA target sequence
gtgctatcgtatagctatagt

SEQ ID NO: 40564 - DNA, 21 bp, Artificial sequence
  SiRNA target sequence
tgctatcgtatagctatagtt

SEQ ID NO: 40565 - DNA, 21 bp, Artificial sequence
  SiRNA target sequence
gctatcgtatagctatagtta

SEQ ID NO: 40566 - DNA, 21 bp, Artificial sequence
  SiRNA target sequence
ctatcgtatagctatagttaa

SEQ ID NO: 40567 - DNA, 21 bp, Artificial sequence
  SiRNA target sequence
tatcgtatagctatagttaaa

SEQ ID NO: 40568 - DNA, 21 bp, Artificial sequence
  SiRNA target sequence
atcgtatagctatagttaaaa

SEQ ID NO: 40569 - DNA, 21 bp, Artificial sequence
  SiRNA target sequence
tcgtatagctatagttaaaac

SEQ ID NO: 40570 - DNA, 21 bp, Artificial sequence
  SiRNA target sequence
cgtatagctatagttaaaaca

SEQ ID NO: 40571 - DNA, 21 bp, Artificial sequence
  SiRNA target sequence
gtatagctatagttaaaacag

SEQ ID NO: 40572 - DNA, 21 bp, Artificial sequence
  SiRNA target sequence
tatagctatagttaaaacagc

SEQ ID NO: 40573 - DNA, 21 bp, Artificial sequence
  SiRNA target sequence
atagctatagttaaaacagct

SEQ ID NO: 40574 - DNA, 21 bp, Artificial sequence
  SiRNA target sequence
tagctatagttaaaacagctt

SEQ ID NO: 40575 - DNA, 21 bp, Artificial sequence
  SiRNA target sequence
agctatagttaaaacagcttt

SEQ ID NO: 40576 - DNA, 21 bp, Artificial sequence
  SiRNA target sequence
gctatagttaaaacagctttt

SEQ ID NO: 40577 - DNA, 21 bp, Artificial sequence
  SiRNA target sequence
ctatagttaaaacagcttttc

SEQ ID NO: 40578 - DNA, 21 bp, Artificial sequence
  SiRNA target sequence
tatagttaaaacagcttttca

SEQ ID NO: 40579 - DNA, 21 bp, Artificial sequence
  SiRNA target sequence
atagttaaaacagcttttcac

SEQ ID NO: 40580 - DNA, 21 bp, Artificial sequence
  SiRNA target sequence
tagttaaaacagcttttcaca

SEQ ID NO: 40581 - DNA, 21 bp, Artificial sequence
  SiRNA target sequence
agttaaaacagcttttcacac

SEQ ID NO: 40582 - DNA, 21 bp, Artificial sequence
  SiRNA target sequence
gttaaaacagcttttcacact

SEQ ID NO: 40583 - DNA, 21 bp, Artificial sequence
  SiRNA target sequence
ttaaaacagcttttcacactg

SEQ ID NO: 40584 - DNA, 21 bp, Artificial sequence
  SiRNA target sequence
taaaacagcttttcacactgg

SEQ ID NO: 40585 - DNA, 21 bp, Artificial sequence
  SiRNA target sequence
aaaacagcttttcacactggt

SEQ ID NO: 40586 - DNA, 21 bp, Artificial sequence
  SiRNA target sequence
aaacagcttttcacactggta

SEQ ID NO: 40587 - DNA, 21 bp, Artificial sequence
  SiRNA target sequence
aacagcttttcacactggtag

SEQ ID NO: 40588 - DNA, 21 bp, Artificial sequence
  SiRNA target sequence
acagcttttcacactggtagg

SEQ ID NO: 40589 - DNA, 21 bp, Artificial sequence
  SiRNA target sequence
cagcttttcacactggtaggt

SEQ ID NO: 40590 - DNA, 21 bp, Artificial sequence
  SiRNA target sequence
agcttttcacactggtaggtt

SEQ ID NO: 40591 - DNA, 21 bp, Artificial sequence
  SiRNA target sequence
gcttttcacactggtaggtta

SEQ ID NO: 40592 - DNA, 21 bp, Artificial sequence
  SiRNA target sequence
cttttcacactggtaggttag

SEQ ID NO: 40593 - DNA, 21 bp, Artificial sequence
  SiRNA target sequence
ttttcacactggtaggttagg

SEQ ID NO: 40594 - DNA, 21 bp, Artificial sequence
  SiRNA target sequence
tttcacactggtaggttagga

SEQ ID NO: 40595 - DNA, 21 bp, Artificial sequence
  SiRNA target sequence
ttcacactggtaggttaggaa

SEQ ID NO: 40596 - DNA, 21 bp, Artificial sequence
  SiRNA target sequence
tcacactggtaggttaggaat

SEQ ID NO: 40597 - DNA, 21 bp, Artificial sequence
  SiRNA target sequence
cacactggtaggttaggaatt

SEQ ID NO: 40598 - DNA, 21 bp, Artificial sequence
  SiRNA target sequence
acactggtaggttaggaattt

SEQ ID NO: 40599 - DNA, 21 bp, Artificial sequence
  SiRNA target sequence
cactggtaggttaggaatttt

SEQ ID NO: 40600 - DNA, 21 bp, Artificial sequence
  SiRNA target sequence
actggtaggttaggaattttc

SEQ ID NO: 40601 - DNA, 21 bp, Artificial sequence
  SiRNA target sequence
ctggtaggttaggaattttct

SEQ ID NO: 40602 - DNA, 21 bp, Artificial sequence
  SiRNA target sequence
tggtaggttaggaattttctt

SEQ ID NO: 40603 - DNA, 21 bp, Artificial sequence
  SiRNA target sequence
ggtaggttaggaattttcttc

SEQ ID NO: 40604 - DNA, 21 bp, Artificial sequence
  SiRNA target sequence
gtaggttaggaattttcttcg

SEQ ID NO: 40605 - DNA, 21 bp, Artificial sequence
  SiRNA target sequence
taggttaggaattttcttcgg

SEQ ID NO: 40606 - DNA, 21 bp, Artificial sequence
  SiRNA target sequence
aggttaggaattttcttcgga

SEQ ID NO: 40607 - DNA, 21 bp, Artificial sequence
  SiRNA target sequence
ggttaggaattttcttcggac

SEQ ID NO: 40608 - DNA, 21 bp, Artificial sequence
  SiRNA target sequence
gttaggaattttcttcggacc

SEQ ID NO: 40609 - DNA, 21 bp, Artificial sequence
  SiRNA target sequence
ttaggaattttcttcggacct

SEQ ID NO: 40610 - DNA, 21 bp, Artificial sequence
  SiRNA target sequence
taggaattttcttcggacctg

SEQ ID NO: 40611 - DNA, 21 bp, Artificial sequence
  SiRNA target sequence
aggaattttcttcggacctgg

SEQ ID NO: 40612 - DNA, 21 bp, Artificial sequence
  SiRNA target sequence
ggaattttcttcggacctggt

SEQ ID NO: 40613 - DNA, 21 bp, Artificial sequence
  SiRNA target sequence
gaattttcttcggacctggta

SEQ ID NO: 40614 - DNA, 21 bp, Artificial sequence
  SiRNA target sequence
aattttcttcggacctggtaa

SEQ ID NO: 40615 - DNA, 21 bp, Artificial sequence
  SiRNA target sequence
attttcttcggacctggtaag

SEQ ID NO: 40616 - DNA, 21 bp, Artificial sequence
  SiRNA target sequence
ttttcttcggacctggtaaga

SEQ ID NO: 40617 - DNA, 21 bp, Artificial sequence
  SiRNA target sequence
tttcttcggacctggtaagat

SEQ ID NO: 40618 - DNA, 21 bp, Artificial sequence
  SiRNA target sequence
ttcttcggacctggtaagatt

SEQ ID NO: 40619 - DNA, 21 bp, Artificial sequence
  SiRNA target sequence
tcttcggacctggtaagattc

SEQ ID NO: 40620 - DNA, 21 bp, Artificial sequence
  SiRNA target sequence
cttcggacctggtaagattcc

SEQ ID NO: 40621 - DNA, 21 bp, Artificial sequence
  SiRNA target sequence
ttcggacctggtaagattcca

SEQ ID NO: 40622 - DNA, 21 bp, Artificial sequence
  SiRNA target sequence
tcggacctggtaagattccaa

SEQ ID NO: 40623 - DNA, 21 bp, Artificial sequence
  SiRNA target sequence
cggacctggtaagattccaat

SEQ ID NO: 40624 - DNA, 21 bp, Artificial sequence
  SiRNA target sequence
ggacctggtaagattccaata

SEQ ID NO: 40625 - DNA, 21 bp, Artificial sequence
  SiRNA target sequence
gacctggtaagattccaataa

SEQ ID NO: 40626 - DNA, 21 bp, Artificial sequence
  SiRNA target sequence
acctggtaagattccaataac

SEQ ID NO: 40627 - DNA, 21 bp, Artificial sequence
  SiRNA target sequence
cctggtaagattccaataacg

SEQ ID NO: 40628 - DNA, 21 bp, Artificial sequence
  SiRNA target sequence
ctggtaagattccaataacga

SEQ ID NO: 40629 - DNA, 21 bp, Artificial sequence
  SiRNA target sequence
tggtaagattccaataacgac

SEQ ID NO: 40630 - DNA, 21 bp, Artificial sequence
  SiRNA target sequence
ggtaagattccaataacgacg

SEQ ID NO: 40631 - DNA, 21 bp, Artificial sequence
  SiRNA target sequence
gtaagattccaataacgacga

SEQ ID NO: 40632 - DNA, 21 bp, Artificial sequence
  SiRNA target sequence
taagattccaataacgacgac

SEQ ID NO: 40633 - DNA, 21 bp, Artificial sequence
  SiRNA target sequence
aagattccaataacgacgacg

SEQ ID NO: 40634 - DNA, 21 bp, Artificial sequence
  SiRNA target sequence
agattccaataacgacgacga

SEQ ID NO: 40635 - DNA, 21 bp, Artificial sequence
  SiRNA target sequence
gattccaataacgacgacgaa

SEQ ID NO: 40636 - DNA, 21 bp, Artificial sequence
  SiRNA target sequence
attccaataacgacgacgaaa

SEQ ID NO: 40637 - DNA, 21 bp, Artificial sequence
  SiRNA target sequence
ttccaataacgacgacgaaag

SEQ ID NO: 40638 - DNA, 21 bp, Artificial sequence
  SiRNA target sequence
tccaataacgacgacgaaaga

SEQ ID NO: 40639 - DNA, 21 bp, Artificial sequence
  SiRNA target sequence
ccaataacgacgacgaaagat

SEQ ID NO: 40640 - DNA, 21 bp, Artificial sequence
  SiRNA target sequence
caataacgacgacgaaagata

SEQ ID NO: 40641 - DNA, 21 bp, Artificial sequence
  SiRNA target sequence
aataacgacgacgaaagataa

SEQ ID NO: 40642 - DNA, 21 bp, Artificial sequence
  SiRNA target sequence
ataacgacgacgaaagataat

SEQ ID NO: 40643 - DNA, 21 bp, Artificial sequence
  SiRNA target sequence
taacgacgacgaaagataata

SEQ ID NO: 40644 - DNA, 21 bp, Artificial sequence
  SiRNA target sequence
aacgacgacgaaagataatat

SEQ ID NO: 40645 - DNA, 21 bp, Artificial sequence
  SiRNA target sequence
acgacgacgaaagataatatt

SEQ ID NO: 40646 - DNA, 21 bp, Artificial sequence
  SiRNA target sequence
cgacgacgaaagataatattt

SEQ ID NO: 40647 - DNA, 21 bp, Artificial sequence
  SiRNA target sequence
gacgacgaaagataatatttc

SEQ ID NO: 40648 - DNA, 21 bp, Artificial sequence
  SiRNA target sequence
acgacgaaagataatatttcc

SEQ ID NO: 40649 - DNA, 21 bp, Artificial sequence
  SiRNA target sequence
cgacgaaagataatatttccc

SEQ ID NO: 40650 - DNA, 21 bp, Artificial sequence
  SiRNA target sequence
gacgaaagataatatttcccc

SEQ ID NO: 40651 - DNA, 21 bp, Artificial sequence
  SiRNA target sequence
acgaaagataatatttccccg

SEQ ID NO: 40652 - DNA, 21 bp, Artificial sequence
  SiRNA target sequence
cgaaagataatatttccccgg

SEQ ID NO: 40653 - DNA, 21 bp, Artificial sequence
  SiRNA target sequence
gaaagataatatttccccgga

SEQ ID NO: 40654 - DNA, 21 bp, Artificial sequence
  SiRNA target sequence
aaagataatatttccccggac

SEQ ID NO: 40655 - DNA, 21 bp, Artificial sequence
  SiRNA target sequence
aagataatatttccccggact

SEQ ID NO: 40656 - DNA, 21 bp, Artificial sequence
  SiRNA target sequence
agataatatttccccggactt

SEQ ID NO: 40657 - DNA, 21 bp, Artificial sequence
  SiRNA target sequence
gataatatttccccggacttg

SEQ ID NO: 40658 - DNA, 21 bp, Artificial sequence
  SiRNA target sequence
ataatatttccccggacttga

SEQ ID NO: 40659 - DNA, 21 bp, Artificial sequence
  SiRNA target sequence
taatatttccccggacttgac

SEQ ID NO: 40660 - DNA, 21 bp, Artificial sequence
  SiRNA target sequence
aatatttccccggacttgact

SEQ ID NO: 40661 - DNA, 21 bp, Artificial sequence
  SiRNA target sequence
atatttccccggacttgactc

SEQ ID NO: 40662 - DNA, 21 bp, Artificial sequence
  SiRNA target sequence
tatttccccggacttgactca

SEQ ID NO: 40663 - DNA, 21 bp, Artificial sequence
  SiRNA target sequence
atttccccggacttgactcag

SEQ ID NO: 40664 - DNA, 21 bp, Artificial sequence
  SiRNA target sequence
tttccccggacttgactcagt

SEQ ID NO: 40665 - DNA, 21 bp, Artificial sequence
  SiRNA target sequence
ttccccggacttgactcagtt

SEQ ID NO: 40666 - DNA, 21 bp, Artificial sequence
  SiRNA target sequence
tccccggacttgactcagtta

SEQ ID NO: 40667 - DNA, 21 bp, Artificial sequence
  SiRNA target sequence
ccccggacttgactcagttag

SEQ ID NO: 40668 - DNA, 21 bp, Artificial sequence
  SiRNA target sequence
cccggacttgactcagttaga

SEQ ID NO: 40669 - DNA, 21 bp, Artificial sequence
  SiRNA target sequence
ccggacttgactcagttagat

SEQ ID NO: 40670 - DNA, 21 bp, Artificial sequence
  SiRNA target sequence
cggacttgactcagttagatg

SEQ ID NO: 40671 - DNA, 21 bp, Artificial sequence
  SiRNA target sequence
ggacttgactcagttagatgg

SEQ ID NO: 40672 - DNA, 21 bp, Artificial sequence
  SiRNA target sequence
gacttgactcagttagatgga

SEQ ID NO: 40673 - DNA, 21 bp, Artificial sequence
  SiRNA target sequence
acttgactcagttagatggaa

SEQ ID NO: 40674 - DNA, 21 bp, Artificial sequence
  SiRNA target sequence
cttgactcagttagatggaat

SEQ ID NO: 40675 - DNA, 21 bp, Artificial sequence
  SiRNA target sequence
ttgactcagttagatggaatt

SEQ ID NO: 40676 - DNA, 21 bp, Artificial sequence
  SiRNA target sequence
tgactcagttagatggaatta

SEQ ID NO: 40677 - DNA, 21 bp, Artificial sequence
  SiRNA target sequence
gactcagttagatggaattaa

SEQ ID NO: 40678 - DNA, 21 bp, Artificial sequence
  SiRNA target sequence
actcagttagatggaattaaa

SEQ ID NO: 40679 - DNA, 21 bp, Artificial sequence
  SiRNA target sequence
ctcagttagatggaattaaag

SEQ ID NO: 40680 - DNA, 21 bp, Artificial sequence
  SiRNA target sequence
tcagttagatggaattaaagc

SEQ ID NO: 40681 - DNA, 21 bp, Artificial sequence
  SiRNA target sequence
cagttagatggaattaaagcg

SEQ ID NO: 40682 - DNA, 21 bp, Artificial sequence
  SiRNA target sequence
agttagatggaattaaagcgc

SEQ ID NO: 40683 - DNA, 21 bp, Artificial sequence
  SiRNA target sequence
gttagatggaattaaagcgcc

SEQ ID NO: 40684 - DNA, 21 bp, Artificial sequence
  SiRNA target sequence
ttagatggaattaaagcgcct

SEQ ID NO: 40685 - DNA, 21 bp, Artificial sequence
  SiRNA target sequence
tagatggaattaaagcgcctt

SEQ ID NO: 40686 - DNA, 21 bp, Artificial sequence
  SiRNA target sequence
agatggaattaaagcgccttc

SEQ ID NO: 40687 - DNA, 21 bp, Artificial sequence
  SiRNA target sequence
gatggaattaaagcgccttct

SEQ ID NO: 40688 - DNA, 21 bp, Artificial sequence
  SiRNA target sequence
atggaattaaagcgccttctg

SEQ ID NO: 40689 - DNA, 21 bp, Artificial sequence
  SiRNA target sequence
tggaattaaagcgccttctga

SEQ ID NO: 40690 - DNA, 21 bp, Artificial sequence
  SiRNA target sequence
ggaattaaagcgccttctgat

SEQ ID NO: 40691 - DNA, 21 bp, Artificial sequence
  SiRNA target sequence
gaattaaagcgccttctgata

SEQ ID NO: 40692 - DNA, 21 bp, Artificial sequence
  SiRNA target sequence
aattaaagcgccttctgataa

SEQ ID NO: 40693 - DNA, 21 bp, Artificial sequence
  SiRNA target sequence
attaaagcgccttctgataac

SEQ ID NO: 40694 - DNA, 21 bp, Artificial sequence
  SiRNA target sequence
ttaaagcgccttctgataaca

SEQ ID NO: 40695 - DNA, 21 bp, Artificial sequence
  SiRNA target sequence
taaagcgccttctgataacaa

SEQ ID NO: 40696 - DNA, 21 bp, Artificial sequence
  SiRNA target sequence
aaagcgccttctgataacaat

SEQ ID NO: 40697 - DNA, 21 bp, Artificial sequence
  SiRNA target sequence
aagcgccttctgataacaatt

SEQ ID NO: 40698 - DNA, 21 bp, Artificial sequence
  SiRNA target sequence
agcgccttctgataacaatta

SEQ ID NO: 40699 - DNA, 21 bp, Artificial sequence
  SiRNA target sequence
gcgccttctgataacaattac

SEQ ID NO: 40700 - DNA, 21 bp, Artificial sequence
  SiRNA target sequence
cgccttctgataacaattaca

SEQ ID NO: 40701 - DNA, 21 bp, Artificial sequence
  SiRNA target sequence
gccttctgataacaattacaa

SEQ ID NO: 40702 - DNA, 21 bp, Artificial sequence
  SiRNA target sequence
ccttctgataacaattacaaa

SEQ ID NO: 40703 - DNA, 21 bp, Artificial sequence
  SiRNA target sequence
cttctgataacaattacaaat

SEQ ID NO: 40704 - DNA, 21 bp, Artificial sequence
  SiRNA target sequence
ttctgataacaattacaaata

SEQ ID NO: 40705 - DNA, 21 bp, Artificial sequence
  SiRNA target sequence
tctgataacaattacaaatac

SEQ ID NO: 40706 - DNA, 21 bp, Artificial sequence
  SiRNA target sequence
ctgataacaattacaaataca

SEQ ID NO: 40707 - DNA, 21 bp, Artificial sequence
  SiRNA target sequence
tgataacaattacaaatacat

SEQ ID NO: 40708 - DNA, 21 bp, Artificial sequence
  SiRNA target sequence
gataacaattacaaatacatc

SEQ ID NO: 40709 - DNA, 21 bp, Artificial sequence
  SiRNA target sequence
ataacaattacaaatacatct

SEQ ID NO: 40710 - DNA, 21 bp, Artificial sequence
  SiRNA target sequence
taacaattacaaatacatctt

SEQ ID NO: 40711 - DNA, 21 bp, Artificial sequence
  SiRNA target sequence
aacaattacaaatacatcttg

SEQ ID NO: 40712 - DNA, 21 bp, Artificial sequence
  SiRNA target sequence
acaattacaaatacatcttgg

SEQ ID NO: 40713 - DNA, 21 bp, Artificial sequence
  SiRNA target sequence
caattacaaatacatcttgga

SEQ ID NO: 40714 - DNA, 21 bp, Artificial sequence
  SiRNA target sequence
aattacaaatacatcttggat

SEQ ID NO: 40715 - DNA, 21 bp, Artificial sequence
  SiRNA target sequence
attacaaatacatcttggatc

SEQ ID NO: 40716 - DNA, 21 bp, Artificial sequence
  SiRNA target sequence
ttacaaatacatcttggatct

SEQ ID NO: 40717 - DNA, 21 bp, Artificial sequence
  SiRNA target sequence
tacaaatacatcttggatcta

SEQ ID NO: 40718 - DNA, 21 bp, Artificial sequence
  SiRNA target sequence
acaaatacatcttggatctaa

SEQ ID NO: 40719 - DNA, 21 bp, Artificial sequence
  SiRNA target sequence
caaatacatcttggatctaac

SEQ ID NO: 40720 - DNA, 21 bp, Artificial sequence
  SiRNA target sequence
aaatacatcttggatctaact

SEQ ID NO: 40721 - DNA, 21 bp, Artificial sequence
  SiRNA target sequence
aatacatcttggatctaacta

SEQ ID NO: 40722 - DNA, 21 bp, Artificial sequence
  SiRNA target sequence
atacatcttggatctaactaa

SEQ ID NO: 40723 - DNA, 21 bp, Artificial sequence
  SiRNA target sequence
tacatcttggatctaactaat

SEQ ID NO: 40724 - DNA, 21 bp, Artificial sequence
  SiRNA target sequence
acatcttggatctaactaatg

SEQ ID NO: 40725 - DNA, 21 bp, Artificial sequence
  SiRNA target sequence
catcttggatctaactaatga

SEQ ID NO: 40726 - DNA, 21 bp, Artificial sequence
  SiRNA target sequence
atcttggatctaactaatgat

SEQ ID NO: 40727 - DNA, 21 bp, Artificial sequence
  SiRNA target sequence
tcttggatctaactaatgata

SEQ ID NO: 40728 - DNA, 21 bp, Artificial sequence
  SiRNA target sequence
cttggatctaactaatgatac

SEQ ID NO: 40729 - DNA, 21 bp, Artificial sequence
  SiRNA target sequence
ttggatctaactaatgatacg

SEQ ID NO: 40730 - DNA, 21 bp, Artificial sequence
  SiRNA target sequence
tggatctaactaatgatacgg

SEQ ID NO: 40731 - DNA, 21 bp, Artificial sequence
  SiRNA target sequence
ggatctaactaatgatacgga

SEQ ID NO: 40732 - DNA, 21 bp, Artificial sequence
  SiRNA target sequence
gatctaactaatgatacggag

SEQ ID NO: 40733 - DNA, 21 bp, Artificial sequence
  SiRNA target sequence
atctaactaatgatacggaga

SEQ ID NO: 40734 - DNA, 21 bp, Artificial sequence
  SiRNA target sequence
tctaactaatgatacggagat

SEQ ID NO: 40735 - DNA, 21 bp, Artificial sequence
  SiRNA target sequence
ctaactaatgatacggagatc

SEQ ID NO: 40736 - DNA, 21 bp, Artificial sequence
  SiRNA target sequence
taactaatgatacggagatca

SEQ ID NO: 40737 - DNA, 21 bp, Artificial sequence
  SiRNA target sequence
aactaatgatacggagatcac

SEQ ID NO: 40738 - DNA, 21 bp, Artificial sequence
  SiRNA target sequence
actaatgatacggagatcacc

SEQ ID NO: 40739 - DNA, 21 bp, Artificial sequence
  SiRNA target sequence
ctaatgatacggagatcacca

SEQ ID NO: 40740 - DNA, 21 bp, Artificial sequence
  SiRNA target sequence
taatgatacggagatcaccat

SEQ ID NO: 40741 - DNA, 21 bp, Artificial sequence
  SiRNA target sequence
aatgatacggagatcaccata

SEQ ID NO: 40742 - DNA, 21 bp, Artificial sequence
  SiRNA target sequence
atgatacggagatcaccataa

SEQ ID NO: 40743 - DNA, 21 bp, Artificial sequence
  SiRNA target sequence
tgatacggagatcaccataag

SEQ ID NO: 40744 - DNA, 21 bp, Artificial sequence
  SiRNA target sequence
gatacggagatcaccataagg

SEQ ID NO: 40745 - DNA, 21 bp, Artificial sequence
  SiRNA target sequence
atacggagatcaccataaggg

SEQ ID NO: 40746 - DNA, 21 bp, Artificial sequence
  SiRNA target sequence
tacggagatcaccataagggt

SEQ ID NO: 40747 - DNA, 21 bp, Artificial sequence
  SiRNA target sequence
acggagatcaccataagggta

SEQ ID NO: 40748 - DNA, 21 bp, Artificial sequence
  SiRNA target sequence
cggagatcaccataagggtac

SEQ ID NO: 40749 - DNA, 21 bp, Artificial sequence
  SiRNA target sequence
ggagatcaccataagggtacc

SEQ ID NO: 40750 - DNA, 21 bp, Artificial sequence
  SiRNA target sequence
gagatcaccataagggtacct

SEQ ID NO: 40751 - DNA, 21 bp, Artificial sequence
  SiRNA target sequence
agatcaccataagggtacctt

SEQ ID NO: 40752 - DNA, 21 bp, Artificial sequence
  SiRNA target sequence
gatcaccataagggtaccttt

SEQ ID NO: 40753 - DNA, 21 bp, Artificial sequence
  SiRNA target sequence
atcaccataagggtacctttt

SEQ ID NO: 40754 - DNA, 21 bp, Artificial sequence
  SiRNA target sequence
tcaccataagggtaccttttg

SEQ ID NO: 40755 - DNA, 21 bp, Artificial sequence
  SiRNA target sequence
caccataagggtaccttttgt

SEQ ID NO: 40756 - DNA, 21 bp, Artificial sequence
  SiRNA target sequence
accataagggtaccttttgtt

SEQ ID NO: 40757 - DNA, 21 bp, Artificial sequence
  SiRNA target sequence
ccataagggtaccttttgttt

SEQ ID NO: 40758 - DNA, 21 bp, Artificial sequence
  SiRNA target sequence
cataagggtaccttttgtttc

SEQ ID NO: 40759 - DNA, 21 bp, Artificial sequence
  SiRNA target sequence
ataagggtaccttttgtttca

SEQ ID NO: 40760 - DNA, 21 bp, Artificial sequence
  SiRNA target sequence
taagggtaccttttgtttcaa

SEQ ID NO: 40761 - DNA, 21 bp, Artificial sequence
  SiRNA target sequence
aagggtaccttttgtttcaaa

SEQ ID NO: 40762 - DNA, 21 bp, Artificial sequence
  SiRNA target sequence
agggtaccttttgtttcaaac

SEQ ID NO: 40763 - DNA, 21 bp, Artificial sequence
  SiRNA target sequence
gggtaccttttgtttcaaaca

SEQ ID NO: 40764 - DNA, 21 bp, Artificial sequence
  SiRNA target sequence
ggtaccttttgtttcaaacaa

SEQ ID NO: 40765 - DNA, 21 bp, Artificial sequence
  SiRNA target sequence
gtaccttttgtttcaaacaaa

SEQ ID NO: 40766 - DNA, 21 bp, Artificial sequence
  SiRNA target sequence
taccttttgtttcaaacaaaa

SEQ ID NO: 40767 - DNA, 21 bp, Artificial sequence
  SiRNA target sequence
accttttgtttcaaacaaaat

SEQ ID NO: 40768 - DNA, 21 bp, Artificial sequence
  SiRNA target sequence
ccttttgtttcaaacaaaatg

SEQ ID NO: 40769 - DNA, 21 bp, Artificial sequence
  SiRNA target sequence
cttttgtttcaaacaaaatgt

SEQ ID NO: 40770 - DNA, 21 bp, Artificial sequence
  SiRNA target sequence
ttttgtttcaaacaaaatgtt

SEQ ID NO: 40771 - DNA, 21 bp, Artificial sequence
  SiRNA target sequence
tttgtttcaaacaaaatgttc

SEQ ID NO: 40772 - DNA, 21 bp, Artificial sequence
  SiRNA target sequence
ttgtttcaaacaaaatgttca

SEQ ID NO: 40773 - DNA, 21 bp, Artificial sequence
  SiRNA target sequence
tgtttcaaacaaaatgttcat

SEQ ID NO: 40774 - DNA, 21 bp, Artificial sequence
  SiRNA target sequence
gtttcaaacaaaatgttcatg

SEQ ID NO: 40775 - DNA, 21 bp, Artificial sequence
  SiRNA target sequence
tttcaaacaaaatgttcatga

SEQ ID NO: 40776 - DNA, 21 bp, Artificial sequence
  SiRNA target sequence
ttcaaacaaaatgttcatgaa

SEQ ID NO: 40777 - DNA, 21 bp, Artificial sequence
  SiRNA target sequence
tcaaacaaaatgttcatgaaa

SEQ ID NO: 40778 - DNA, 21 bp, Artificial sequence
  SiRNA target sequence
caaacaaaatgttcatgaaat

SEQ ID NO: 40779 - DNA, 21 bp, Artificial sequence
  SiRNA target sequence
aaacaaaatgttcatgaaatc

SEQ ID NO: 40780 - DNA, 21 bp, Artificial sequence
  SiRNA target sequence
aacaaaatgttcatgaaatct

SEQ ID NO: 40781 - DNA, 21 bp, Artificial sequence
  SiRNA target sequence
acaaaatgttcatgaaatcta

SEQ ID NO: 40782 - DNA, 21 bp, Artificial sequence
  SiRNA target sequence
caaaatgttcatgaaatctac

SEQ ID NO: 40783 - DNA, 21 bp, Artificial sequence
  SiRNA target sequence
aaaatgttcatgaaatctacg

SEQ ID NO: 40784 - DNA, 21 bp, Artificial sequence
  SiRNA target sequence
aaatgttcatgaaatctacgg

SEQ ID NO: 40785 - DNA, 21 bp, Artificial sequence
  SiRNA target sequence
aatgttcatgaaatctacggg

SEQ ID NO: 40786 - DNA, 21 bp, Artificial sequence
  SiRNA target sequence
atgttcatgaaatctacggga

SEQ ID NO: 40787 - DNA, 21 bp, Artificial sequence
  SiRNA target sequence
tgttcatgaaatctacgggaa

SEQ ID NO: 40788 - DNA, 21 bp, Artificial sequence
  SiRNA target sequence
gttcatgaaatctacgggaat

SEQ ID NO: 40789 - DNA, 21 bp, Artificial sequence
  SiRNA target sequence
ttcatgaaatctacgggaatt

SEQ ID NO: 40790 - DNA, 21 bp, Artificial sequence
  SiRNA target sequence
tcatgaaatctacgggaattt

SEQ ID NO: 40791 - DNA, 21 bp, Artificial sequence
  SiRNA target sequence
catgaaatctacgggaattta

SEQ ID NO: 40792 - DNA, 21 bp, Artificial sequence
  SiRNA target sequence
atgaaatctacgggaatttat

SEQ ID NO: 40793 - DNA, 21 bp, Artificial sequence
  SiRNA target sequence
tgaaatctacgggaatttatg

SEQ ID NO: 40794 - DNA, 21 bp, Artificial sequence
  SiRNA target sequence
gaaatctacgggaatttatgg

SEQ ID NO: 40795 - DNA, 21 bp, Artificial sequence
  SiRNA target sequence
aaatctacgggaatttatggt

SEQ ID NO: 40796 - DNA, 21 bp, Artificial sequence
  SiRNA target sequence
aatctacgggaatttatggtg

SEQ ID NO: 40797 - DNA, 21 bp, Artificial sequence
  SiRNA target sequence
atctacgggaatttatggtgg

SEQ ID NO: 40798 - DNA, 21 bp, Artificial sequence
  SiRNA target sequence
tctacgggaatttatggtgga

SEQ ID NO: 40799 - DNA, 21 bp, Artificial sequence
  SiRNA target sequence
ctacgggaatttatggtggaa

SEQ ID NO: 40800 - DNA, 21 bp, Artificial sequence
  SiRNA target sequence
tacgggaatttatggtggaaa

SEQ ID NO: 40801 - DNA, 21 bp, Artificial sequence
  SiRNA target sequence
acgggaatttatggtggaaat

SEQ ID NO: 40802 - DNA, 21 bp, Artificial sequence
  SiRNA target sequence
cgggaatttatggtggaaatt

SEQ ID NO: 40803 - DNA, 21 bp, Artificial sequence
  SiRNA target sequence
gggaatttatggtggaaattc

SEQ ID NO: 40804 - DNA, 21 bp, Artificial sequence
  SiRNA target sequence
ggaatttatggtggaaattct

SEQ ID NO: 40805 - DNA, 21 bp, Artificial sequence
  SiRNA target sequence
gaatttatggtggaaattctg

SEQ ID NO: 40806 - DNA, 21 bp, Artificial sequence
  SiRNA target sequence
aatttatggtggaaattctga

SEQ ID NO: 40807 - DNA, 21 bp, Artificial sequence
  SiRNA target sequence
atttatggtggaaattctgaa

SEQ ID NO: 40808 - DNA, 21 bp, Artificial sequence
  SiRNA target sequence
tttatggtggaaattctgaaa

SEQ ID NO: 40809 - DNA, 21 bp, Artificial sequence
  SiRNA target sequence
ttatggtggaaattctgaaaa

SEQ ID NO: 40810 - DNA, 21 bp, Artificial sequence
  SiRNA target sequence
tatggtggaaattctgaaaat

SEQ ID NO: 40811 - DNA, 21 bp, Artificial sequence
  SiRNA target sequence
atggtggaaattctgaaaata

SEQ ID NO: 40812 - DNA, 21 bp, Artificial sequence
  SiRNA target sequence
tggtggaaattctgaaaataa

SEQ ID NO: 40813 - DNA, 21 bp, Artificial sequence
  SiRNA target sequence
ggtggaaattctgaaaataat

SEQ ID NO: 40814 - DNA, 21 bp, Artificial sequence
  SiRNA target sequence
gtggaaattctgaaaataatt

SEQ ID NO: 40815 - DNA, 21 bp, Artificial sequence
  SiRNA target sequence
tggaaattctgaaaataattg

SEQ ID NO: 40816 - DNA, 21 bp, Artificial sequence
  SiRNA target sequence
ggaaattctgaaaataattgg

SEQ ID NO: 40817 - DNA, 21 bp, Artificial sequence
  SiRNA target sequence
gaaattctgaaaataattggg

SEQ ID NO: 40818 - DNA, 21 bp, Artificial sequence
  SiRNA target sequence
aaattctgaaaataattggga

SEQ ID NO: 40819 - DNA, 21 bp, Artificial sequence
  SiRNA target sequence
aattctgaaaataattgggat

SEQ ID NO: 40820 - DNA, 21 bp, Artificial sequence
  SiRNA target sequence
attctgaaaataattgggatt

SEQ ID NO: 40821 - DNA, 21 bp, Artificial sequence
  SiRNA target sequence
ttctgaaaataattgggattt

SEQ ID NO: 40822 - DNA, 21 bp, Artificial sequence
  SiRNA target sequence
tctgaaaataattgggatttc

SEQ ID NO: 40823 - DNA, 21 bp, Artificial sequence
  SiRNA target sequence
ctgaaaataattgggatttct

SEQ ID NO: 40824 - DNA, 21 bp, Artificial sequence
  SiRNA target sequence
tgaaaataattgggatttctc

SEQ ID NO: 40825 - DNA, 21 bp, Artificial sequence
  SiRNA target sequence
gaaaataattgggatttctct

SEQ ID NO: 40826 - DNA, 21 bp, Artificial sequence
  SiRNA target sequence
aaaataattgggatttctctg

SEQ ID NO: 40827 - DNA, 21 bp, Artificial sequence
  SiRNA target sequence
aaataattgggatttctctga

SEQ ID NO: 40828 - DNA, 21 bp, Artificial sequence
  SiRNA target sequence
aataattgggatttctctgaa

SEQ ID NO: 40829 - DNA, 21 bp, Artificial sequence
  SiRNA target sequence
ataattgggatttctctgaat

SEQ ID NO: 40830 - DNA, 21 bp, Artificial sequence
  SiRNA target sequence
taattgggatttctctgaatc

SEQ ID NO: 40831 - DNA, 21 bp, Artificial sequence
  SiRNA target sequence
aattgggatttctctgaatca

SEQ ID NO: 40832 - DNA, 21 bp, Artificial sequence
  SiRNA target sequence
attgggatttctctgaatcat

SEQ ID NO: 40833 - DNA, 21 bp, Artificial sequence
  SiRNA target sequence
ttgggatttctctgaatcatt

SEQ ID NO: 40834 - DNA, 21 bp, Artificial sequence
  SiRNA target sequence
tgggatttctctgaatcattt

SEQ ID NO: 40835 - DNA, 21 bp, Artificial sequence
  SiRNA target sequence
gggatttctctgaatcattta

SEQ ID NO: 40836 - DNA, 21 bp, Artificial sequence
  SiRNA target sequence
ggatttctctgaatcatttac

SEQ ID NO: 40837 - DNA, 21 bp, Artificial sequence
  SiRNA target sequence
gatttctctgaatcatttact

SEQ ID NO: 40838 - DNA, 21 bp, Artificial sequence
  SiRNA target sequence
atttctctgaatcatttactg

SEQ ID NO: 40839 - DNA, 21 bp, Artificial sequence
  SiRNA target sequence
tttctctgaatcatttactgg

SEQ ID NO: 40840 - DNA, 21 bp, Artificial sequence
  SiRNA target sequence
ttctctgaatcatttactgga

SEQ ID NO: 40841 - DNA, 21 bp, Artificial sequence
  SiRNA target sequence
tctctgaatcatttactggat

SEQ ID NO: 40842 - DNA, 21 bp, Artificial sequence
  SiRNA target sequence
ctctgaatcatttactggatt

SEQ ID NO: 40843 - DNA, 21 bp, Artificial sequence
  SiRNA target sequence
tctgaatcatttactggattt

SEQ ID NO: 40844 - DNA, 21 bp, Artificial sequence
  SiRNA target sequence
ctgaatcatttactggatttt

SEQ ID NO: 40845 - DNA, 21 bp, Artificial sequence
  SiRNA target sequence
tgaatcatttactggattttt

SEQ ID NO: 40846 - DNA, 21 bp, Artificial sequence
  SiRNA target sequence
gaatcatttactggatttttg

SEQ ID NO: 40847 - DNA, 21 bp, Artificial sequence
  SiRNA target sequence
aatcatttactggatttttgt

SEQ ID NO: 40848 - DNA, 21 bp, Artificial sequence
  SiRNA target sequence
atcatttactggatttttgtg

SEQ ID NO: 40849 - DNA, 21 bp, Artificial sequence
  SiRNA target sequence
tcatttactggatttttgtgc

SEQ ID NO: 40850 - DNA, 21 bp, Artificial sequence
  SiRNA target sequence
catttactggatttttgtgca

SEQ ID NO: 40851 - DNA, 21 bp, Artificial sequence
  SiRNA target sequence
atttactggatttttgtgcat

SEQ ID NO: 40852 - DNA, 21 bp, Artificial sequence
  SiRNA target sequence
tttactggatttttgtgcata

SEQ ID NO: 40853 - DNA, 21 bp, Artificial sequence
  SiRNA target sequence
ttactggatttttgtgcataa

SEQ ID NO: 40854 - DNA, 21 bp, Artificial sequence
  SiRNA target sequence
tactggatttttgtgcataag

SEQ ID NO: 40855 - DNA, 21 bp, Artificial sequence
  SiRNA target sequence
actggatttttgtgcataaga

SEQ ID NO: 40856 - DNA, 21 bp, Artificial sequence
  SiRNA target sequence
ctggatttttgtgcataagac

SEQ ID NO: 40857 - DNA, 21 bp, Artificial sequence
  SiRNA target sequence
tggatttttgtgcataagacc

SEQ ID NO: 40858 - DNA, 21 bp, Artificial sequence
  SiRNA target sequence
ggatttttgtgcataagacct

SEQ ID NO: 40859 - DNA, 21 bp, Artificial sequence
  SiRNA target sequence
gatttttgtgcataagaccta

SEQ ID NO: 40860 - DNA, 21 bp, Artificial sequence
  SiRNA target sequence
atttttgtgcataagacctat

SEQ ID NO: 40861 - DNA, 21 bp, Artificial sequence
  SiRNA target sequence
tttttgtgcataagacctatt

SEQ ID NO: 40862 - DNA, 21 bp, Artificial sequence
  SiRNA target sequence
ttttgtgcataagacctatta

SEQ ID NO: 40863 - DNA, 21 bp, Artificial sequence
  SiRNA target sequence
tttgtgcataagacctattac

SEQ ID NO: 40864 - DNA, 21 bp, Artificial sequence
  SiRNA target sequence
ttgtgcataagacctattaca

SEQ ID NO: 40865 - DNA, 21 bp, Artificial sequence
  SiRNA target sequence
tgtgcataagacctattacaa

SEQ ID NO: 40866 - DNA, 21 bp, Artificial sequence
  SiRNA target sequence
gtgcataagacctattacaaa

SEQ ID NO: 40867 - DNA, 21 bp, Artificial sequence
  SiRNA target sequence
tgcataagacctattacaaaa

SEQ ID NO: 40868 - DNA, 21 bp, Artificial sequence
  SiRNA target sequence
gcataagacctattacaaaat

SEQ ID NO: 40869 - DNA, 21 bp, Artificial sequence
  SiRNA target sequence
cataagacctattacaaaatt

SEQ ID NO: 40870 - DNA, 21 bp, Artificial sequence
  SiRNA target sequence
ataagacctattacaaaattt

SEQ ID NO: 40871 - DNA, 21 bp, Artificial sequence
  SiRNA target sequence
taagacctattacaaaattta

SEQ ID NO: 40872 - DNA, 21 bp, Artificial sequence
  SiRNA target sequence
aagacctattacaaaatttat

SEQ ID NO: 40873 - DNA, 21 bp, Artificial sequence
  SiRNA target sequence
agacctattacaaaatttatg

SEQ ID NO: 40874 - DNA, 21 bp, Artificial sequence
  SiRNA target sequence
gacctattacaaaatttatgt

SEQ ID NO: 40875 - DNA, 21 bp, Artificial sequence
  SiRNA target sequence
acctattacaaaatttatgtg

SEQ ID NO: 40876 - DNA, 21 bp, Artificial sequence
  SiRNA target sequence
cctattacaaaatttatgtgt

SEQ ID NO: 40877 - DNA, 21 bp, Artificial sequence
  SiRNA target sequence
ctattacaaaatttatgtgtc

SEQ ID NO: 40878 - DNA, 21 bp, Artificial sequence
  SiRNA target sequence
tattacaaaatttatgtgtcc

SEQ ID NO: 40879 - DNA, 21 bp, Artificial sequence
  SiRNA target sequence
attacaaaatttatgtgtcca

SEQ ID NO: 40880 - DNA, 21 bp, Artificial sequence
  SiRNA target sequence
ttacaaaatttatgtgtccag

SEQ ID NO: 40881 - DNA, 21 bp, Artificial sequence
  SiRNA target sequence
tacaaaatttatgtgtccaga

SEQ ID NO: 40882 - DNA, 21 bp, Artificial sequence
  SiRNA target sequence
acaaaatttatgtgtccagag

SEQ ID NO: 40883 - DNA, 21 bp, Artificial sequence
  SiRNA target sequence
caaaatttatgtgtccagaga

SEQ ID NO: 40884 - DNA, 21 bp, Artificial sequence
  SiRNA target sequence
aaaatttatgtgtccagagac

SEQ ID NO: 40885 - DNA, 21 bp, Artificial sequence
  SiRNA target sequence
aaatttatgtgtccagagact

SEQ ID NO: 40886 - DNA, 21 bp, Artificial sequence
  SiRNA target sequence
aatttatgtgtccagagactg

SEQ ID NO: 40887 - DNA, 21 bp, Artificial sequence
  SiRNA target sequence
atttatgtgtccagagactgt

SEQ ID NO: 40888 - DNA, 21 bp, Artificial sequence
  SiRNA target sequence
tttatgtgtccagagactgta

SEQ ID NO: 40889 - DNA, 21 bp, Artificial sequence
  SiRNA target sequence
ttatgtgtccagagactgtat

SEQ ID NO: 40890 - DNA, 21 bp, Artificial sequence
  SiRNA target sequence
tatgtgtccagagactgtatc

SEQ ID NO: 40891 - DNA, 21 bp, Artificial sequence
  SiRNA target sequence
atgtgtccagagactgtatcc

SEQ ID NO: 40892 - DNA, 21 bp, Artificial sequence
  SiRNA target sequence
tgtgtccagagactgtatcca

SEQ ID NO: 40893 - DNA, 21 bp, Artificial sequence
  SiRNA target sequence
gtgtccagagactgtatccaa

SEQ ID NO: 40894 - DNA, 21 bp, Artificial sequence
  SiRNA target sequence
tgtccagagactgtatccaat

SEQ ID NO: 40895 - DNA, 21 bp, Artificial sequence
  SiRNA target sequence
gtccagagactgtatccaata

SEQ ID NO: 40896 - DNA, 21 bp, Artificial sequence
  SiRNA target sequence
tccagagactgtatccaataa

SEQ ID NO: 40897 - DNA, 21 bp, Artificial sequence
  SiRNA target sequence
ccagagactgtatccaataat

SEQ ID NO: 40898 - DNA, 21 bp, Artificial sequence
  SiRNA target sequence
cagagactgtatccaataatg

SEQ ID NO: 40899 - DNA, 21 bp, Artificial sequence
  SiRNA target sequence
agagactgtatccaataatgt

SEQ ID NO: 40900 - DNA, 21 bp, Artificial sequence
  SiRNA target sequence
gagactgtatccaataatgtg

SEQ ID NO: 40901 - DNA, 21 bp, Artificial sequence
  SiRNA target sequence
agactgtatccaataatgtgt

SEQ ID NO: 40902 - DNA, 21 bp, Artificial sequence
  SiRNA target sequence
gactgtatccaataatgtgtc

SEQ ID NO: 40903 - DNA, 21 bp, Artificial sequence
  SiRNA target sequence
actgtatccaataatgtgtcg

SEQ ID NO: 40904 - DNA, 21 bp, Artificial sequence
  SiRNA target sequence
ctgtatccaataatgtgtcga

SEQ ID NO: 40905 - DNA, 21 bp, Artificial sequence
  SiRNA target sequence
tgtatccaataatgtgtcgat

SEQ ID NO: 40906 - DNA, 21 bp, Artificial sequence
  SiRNA target sequence
gtatccaataatgtgtcgata

SEQ ID NO: 40907 - DNA, 21 bp, Artificial sequence
  SiRNA target sequence
tatccaataatgtgtcgatag

SEQ ID NO: 40908 - DNA, 21 bp, Artificial sequence
  SiRNA target sequence
atccaataatgtgtcgatagt

SEQ ID NO: 40909 - DNA, 21 bp, Artificial sequence
  SiRNA target sequence
tccaataatgtgtcgatagtt

SEQ ID NO: 40910 - DNA, 21 bp, Artificial sequence
  SiRNA target sequence
ccaataatgtgtcgatagttg

SEQ ID NO: 40911 - DNA, 21 bp, Artificial sequence
  SiRNA target sequence
caataatgtgtcgatagttgt

SEQ ID NO: 40912 - DNA, 21 bp, Artificial sequence
  SiRNA target sequence
aataatgtgtcgatagttgta

SEQ ID NO: 40913 - DNA, 21 bp, Artificial sequence
  SiRNA target sequence
ataatgtgtcgatagttgtat

SEQ ID NO: 40914 - DNA, 21 bp, Artificial sequence
  SiRNA target sequence
taatgtgtcgatagttgtatg

SEQ ID NO: 40915 - DNA, 21 bp, Artificial sequence
  SiRNA target sequence
aatgtgtcgatagttgtatgg

SEQ ID NO: 40916 - DNA, 21 bp, Artificial sequence
  SiRNA target sequence
atgtgtcgatagttgtatgga

SEQ ID NO: 40917 - DNA, 21 bp, Artificial sequence
  SiRNA target sequence
tgtgtcgatagttgtatggaa

SEQ ID NO: 40918 - DNA, 21 bp, Artificial sequence
  SiRNA target sequence
gtgtcgatagttgtatggaag

SEQ ID NO: 40919 - DNA, 21 bp, Artificial sequence
  SiRNA target sequence
tgtcgatagttgtatggaagt

SEQ ID NO: 40920 - DNA, 21 bp, Artificial sequence
  SiRNA target sequence
gtcgatagttgtatggaagtg

SEQ ID NO: 40921 - DNA, 21 bp, Artificial sequence
  SiRNA target sequence
tcgatagttgtatggaagtgg

SEQ ID NO: 40922 - DNA, 21 bp, Artificial sequence
  SiRNA target sequence
cgatagttgtatggaagtggg

SEQ ID NO: 40923 - DNA, 21 bp, Artificial sequence
  SiRNA target sequence
gatagttgtatggaagtgggc

SEQ ID NO: 40924 - DNA, 21 bp, Artificial sequence
  SiRNA target sequence
atagttgtatggaagtgggct

SEQ ID NO: 40925 - DNA, 21 bp, Artificial sequence
  SiRNA target sequence
tagttgtatggaagtgggctg

SEQ ID NO: 40926 - DNA, 21 bp, Artificial sequence
  SiRNA target sequence
agttgtatggaagtgggctga

SEQ ID NO: 40927 - DNA, 21 bp, Artificial sequence
  SiRNA target sequence
gttgtatggaagtgggctgaa

SEQ ID NO: 40928 - DNA, 21 bp, Artificial sequence
  SiRNA target sequence
ttgtatggaagtgggctgaag

SEQ ID NO: 40929 - DNA, 21 bp, Artificial sequence
  SiRNA target sequence
tgtatggaagtgggctgaaga

SEQ ID NO: 40930 - DNA, 21 bp, Artificial sequence
  SiRNA target sequence
gtatggaagtgggctgaagat

SEQ ID NO: 40931 - DNA, 21 bp, Artificial sequence
  SiRNA target sequence
tatggaagtgggctgaagatg

SEQ ID NO: 40932 - DNA, 21 bp, Artificial sequence
  SiRNA target sequence
atggaagtgggctgaagatgt

SEQ ID NO: 40933 - DNA, 21 bp, Artificial sequence
  SiRNA target sequence
tggaagtgggctgaagatgtg

SEQ ID NO: 40934 - DNA, 21 bp, Artificial sequence
  SiRNA target sequence
ggaagtgggctgaagatgtgg

SEQ ID NO: 40935 - DNA, 21 bp, Artificial sequence
  SiRNA target sequence
gaagtgggctgaagatgtggt

SEQ ID NO: 40936 - DNA, 21 bp, Artificial sequence
  SiRNA target sequence
aagtgggctgaagatgtggta

SEQ ID NO: 40937 - DNA, 21 bp, Artificial sequence
  SiRNA target sequence
agtgggctgaagatgtggtag

SEQ ID NO: 40938 - DNA, 21 bp, Artificial sequence
  SiRNA target sequence
gtgggctgaagatgtggtagt

SEQ ID NO: 40939 - DNA, 21 bp, Artificial sequence
  SiRNA target sequence
tgggctgaagatgtggtagta

SEQ ID NO: 40940 - DNA, 21 bp, Artificial sequence
  SiRNA target sequence
gggctgaagatgtggtagtag

SEQ ID NO: 40941 - DNA, 21 bp, Artificial sequence
  SiRNA target sequence
ggctgaagatgtggtagtagt

SEQ ID NO: 40942 - DNA, 21 bp, Artificial sequence
  SiRNA target sequence
gctgaagatgtggtagtagta

SEQ ID NO: 40943 - DNA, 21 bp, Artificial sequence
  SiRNA target sequence
ctgaagatgtggtagtagtag

SEQ ID NO: 40944 - DNA, 21 bp, Artificial sequence
  SiRNA target sequence
tgaagatgtggtagtagtaga

SEQ ID NO: 40945 - DNA, 21 bp, Artificial sequence
  SiRNA target sequence
gaagatgtggtagtagtagaa

SEQ ID NO: 40946 - DNA, 21 bp, Artificial sequence
  SiRNA target sequence
aagatgtggtagtagtagaac

SEQ ID NO: 40947 - DNA, 21 bp, Artificial sequence
  SiRNA target sequence
agatgtggtagtagtagaacc

SEQ ID NO: 40948 - DNA, 21 bp, Artificial sequence
  SiRNA target sequence
gatgtggtagtagtagaacct

SEQ ID NO: 40949 - DNA, 21 bp, Artificial sequence
  SiRNA target sequence
atgtggtagtagtagaaccta

SEQ ID NO: 40950 - DNA, 21 bp, Artificial sequence
  SiRNA target sequence
tgtggtagtagtagaacctaa

SEQ ID NO: 40951 - DNA, 21 bp, Artificial sequence
  SiRNA target sequence
gtggtagtagtagaacctaag

SEQ ID NO: 40952 - DNA, 21 bp, Artificial sequence
  SiRNA target sequence
tggtagtagtagaacctaagc

SEQ ID NO: 40953 - DNA, 21 bp, Artificial sequence
  SiRNA target sequence
ggtagtagtagaacctaagcc

SEQ ID NO: 40954 - DNA, 21 bp, Artificial sequence
  SiRNA target sequence
gtagtagtagaacctaagcct

SEQ ID NO: 40955 - DNA, 21 bp, Artificial sequence
  SiRNA target sequence
tagtagtagaacctaagcctt

SEQ ID NO: 40956 - DNA, 21 bp, Artificial sequence
  SiRNA target sequence
agtagtagaacctaagccttt

SEQ ID NO: 40957 - DNA, 21 bp, Artificial sequence
  SiRNA target sequence
gtagtagaacctaagccttta

SEQ ID NO: 40958 - DNA, 21 bp, Artificial sequence
  SiRNA target sequence
tagtagaacctaagcctttac

SEQ ID NO: 40959 - DNA, 21 bp, Artificial sequence
  SiRNA target sequence
agtagaacctaagcctttact

SEQ ID NO: 40960 - DNA, 21 bp, Artificial sequence
  SiRNA target sequence
gtagaacctaagcctttactt

SEQ ID NO: 40961 - DNA, 21 bp, Artificial sequence
  SiRNA target sequence
tagaacctaagcctttacttt

SEQ ID NO: 40962 - DNA, 21 bp, Artificial sequence
  SiRNA target sequence
agaacctaagcctttactttc

SEQ ID NO: 40963 - DNA, 21 bp, Artificial sequence
  SiRNA target sequence
gaacctaagcctttactttca

SEQ ID NO: 40964 - DNA, 21 bp, Artificial sequence
  SiRNA target sequence
aacctaagcctttactttcag

SEQ ID NO: 40965 - DNA, 21 bp, Artificial sequence
  SiRNA target sequence
acctaagcctttactttcagg

SEQ ID NO: 40966 - DNA, 21 bp, Artificial sequence
  SiRNA target sequence
cctaagcctttactttcagga

SEQ ID NO: 40967 - DNA, 21 bp, Artificial sequence
  SiRNA target sequence
ctaagcctttactttcaggac

SEQ ID NO: 40968 - DNA, 21 bp, Artificial sequence
  SiRNA target sequence
taagcctttactttcaggacc

SEQ ID NO: 40969 - DNA, 21 bp, Artificial sequence
  SiRNA target sequence
aagcctttactttcaggacca

SEQ ID NO: 40970 - DNA, 21 bp, Artificial sequence
  SiRNA target sequence
agcctttactttcaggaccaa

SEQ ID NO: 40971 - DNA, 21 bp, Artificial sequence
  SiRNA target sequence
gcctttactttcaggaccaac

SEQ ID NO: 40972 - DNA, 21 bp, Artificial sequence
  SiRNA target sequence
cctttactttcaggaccaacg

SEQ ID NO: 40973 - DNA, 21 bp, Artificial sequence
  SiRNA target sequence
ctttactttcaggaccaacgc

SEQ ID NO: 40974 - DNA, 21 bp, Artificial sequence
  SiRNA target sequence
tttactttcaggaccaacgca

SEQ ID NO: 40975 - DNA, 21 bp, Artificial sequence
  SiRNA target sequence
ttactttcaggaccaacgcaa

SEQ ID NO: 40976 - DNA, 21 bp, Artificial sequence
  SiRNA target sequence
tactttcaggaccaacgcaag

SEQ ID NO: 40977 - DNA, 21 bp, Artificial sequence
  SiRNA target sequence
actttcaggaccaacgcaagt

SEQ ID NO: 40978 - DNA, 21 bp, Artificial sequence
  SiRNA target sequence
ctttcaggaccaacgcaagtg

SEQ ID NO: 40979 - DNA, 21 bp, Artificial sequence
  SiRNA target sequence
tttcaggaccaacgcaagtgt

SEQ ID NO: 40980 - DNA, 21 bp, Artificial sequence
  SiRNA target sequence
ttcaggaccaacgcaagtgtt

SEQ ID NO: 40981 - DNA, 21 bp, Artificial sequence
  SiRNA target sequence
tcaggaccaacgcaagtgttt

SEQ ID NO: 40982 - DNA, 21 bp, Artificial sequence
  SiRNA target sequence
caggaccaacgcaagtgtttc

SEQ ID NO: 40983 - DNA, 21 bp, Artificial sequence
  SiRNA target sequence
aggaccaacgcaagtgtttca

SEQ ID NO: 40984 - DNA, 21 bp, Artificial sequence
  SiRNA target sequence
ggaccaacgcaagtgtttcaa

SEQ ID NO: 40985 - DNA, 21 bp, Artificial sequence
  SiRNA target sequence
gaccaacgcaagtgtttcaac

SEQ ID NO: 40986 - DNA, 21 bp, Artificial sequence
  SiRNA target sequence
accaacgcaagtgtttcaacc

SEQ ID NO: 40987 - DNA, 21 bp, Artificial sequence
  SiRNA target sequence
ccaacgcaagtgtttcaacca

SEQ ID NO: 40988 - DNA, 21 bp, Artificial sequence
  SiRNA target sequence
caacgcaagtgtttcaaccac

SEQ ID NO: 40989 - DNA, 21 bp, Artificial sequence
  SiRNA target sequence
aacgcaagtgtttcaaccacc

SEQ ID NO: 40990 - DNA, 21 bp, Artificial sequence
  SiRNA target sequence
acgcaagtgtttcaaccacct

SEQ ID NO: 40991 - DNA, 21 bp, Artificial sequence
  SiRNA target sequence
cgcaagtgtttcaaccacctg

SEQ ID NO: 40992 - DNA, 21 bp, Artificial sequence
  SiRNA target sequence
gcaagtgtttcaaccacctgt

SEQ ID NO: 40993 - DNA, 21 bp, Artificial sequence
  SiRNA target sequence
caagtgtttcaaccacctgta

SEQ ID NO: 40994 - DNA, 21 bp, Artificial sequence
  SiRNA target sequence
aagtgtttcaaccacctgtaa

SEQ ID NO: 40995 - DNA, 21 bp, Artificial sequence
  SiRNA target sequence
agtgtttcaaccacctgtaac

SEQ ID NO: 40996 - DNA, 21 bp, Artificial sequence
  SiRNA target sequence
gtgtttcaaccacctgtaaca

SEQ ID NO: 40997 - DNA, 21 bp, Artificial sequence
  SiRNA target sequence
tgtttcaaccacctgtaacat

SEQ ID NO: 40998 - DNA, 21 bp, Artificial sequence
  SiRNA target sequence
gtttcaaccacctgtaacatc

SEQ ID NO: 40999 - DNA, 21 bp, Artificial sequence
  SiRNA target sequence
tttcaaccacctgtaacatct

SEQ ID NO: 41000 - DNA, 21 bp, Artificial sequence
  SiRNA target sequence
ttcaaccacctgtaacatctg

SEQ ID NO: 41001 - DNA, 21 bp, Artificial sequence
  SiRNA target sequence
tcaaccacctgtaacatctgc

SEQ ID NO: 41002 - DNA, 21 bp, Artificial sequence
  SiRNA target sequence
caaccacctgtaacatctgca

SEQ ID NO: 41003 - DNA, 21 bp, Artificial sequence
  SiRNA target sequence
aaccacctgtaacatctgcag

SEQ ID NO: 41004 - DNA, 21 bp, Artificial sequence
  SiRNA target sequence
accacctgtaacatctgcaga

SEQ ID NO: 41005 - DNA, 21 bp, Artificial sequence
  SiRNA target sequence
ccacctgtaacatctgcagat

SEQ ID NO: 41006 - DNA, 21 bp, Artificial sequence
  SiRNA target sequence
cacctgtaacatctgcagatt

SEQ ID NO: 41007 - DNA, 21 bp, Artificial sequence
  SiRNA target sequence
acctgtaacatctgcagattc

SEQ ID NO: 41008 - DNA, 21 bp, Artificial sequence
  SiRNA target sequence
cctgtaacatctgcagattct

SEQ ID NO: 41009 - DNA, 21 bp, Artificial sequence
  SiRNA target sequence
ctgtaacatctgcagattcta

SEQ ID NO: 41010 - DNA, 21 bp, Artificial sequence
  SiRNA target sequence
tgtaacatctgcagattctat

SEQ ID NO: 41011 - DNA, 21 bp, Artificial sequence
  SiRNA target sequence
gtaacatctgcagattctatc

SEQ ID NO: 41012 - DNA, 21 bp, Artificial sequence
  SiRNA target sequence
taacatctgcagattctatca

SEQ ID NO: 41013 - DNA, 21 bp, Artificial sequence
  SiRNA target sequence
aacatctgcagattctatcaa

SEQ ID NO: 41014 - DNA, 21 bp, Artificial sequence
  SiRNA target sequence
acatctgcagattctatcaat

SEQ ID NO: 41015 - DNA, 21 bp, Artificial sequence
  SiRNA target sequence
catctgcagattctatcaata

SEQ ID NO: 41016 - DNA, 21 bp, Artificial sequence
  SiRNA target sequence
atctgcagattctatcaatac

SEQ ID NO: 41017 - DNA, 21 bp, Artificial sequence
  SiRNA target sequence
tctgcagattctatcaatacc

SEQ ID NO: 41018 - DNA, 21 bp, Artificial sequence
  SiRNA target sequence
ctgcagattctatcaatacca

SEQ ID NO: 41019 - DNA, 21 bp, Artificial sequence
  SiRNA target sequence
tgcagattctatcaataccat

SEQ ID NO: 41020 - DNA, 21 bp, Artificial sequence
  SiRNA target sequence
gcagattctatcaataccata

SEQ ID NO: 41021 - DNA, 21 bp, Artificial sequence
  SiRNA target sequence
cagattctatcaataccatag

SEQ ID NO: 41022 - DNA, 21 bp, Artificial sequence
  SiRNA target sequence
agattctatcaataccataga

SEQ ID NO: 41023 - DNA, 21 bp, Artificial sequence
  SiRNA target sequence
gattctatcaataccatagat

SEQ ID NO: 41024 - DNA, 21 bp, Artificial sequence
  SiRNA target sequence
attctatcaataccatagatg

SEQ ID NO: 41025 - DNA, 21 bp, Artificial sequence
  SiRNA target sequence
ttctatcaataccatagatgc

SEQ ID NO: 41026 - DNA, 21 bp, Artificial sequence
  SiRNA target sequence
tctatcaataccatagatgct

SEQ ID NO: 41027 - DNA, 21 bp, Artificial sequence
  SiRNA target sequence
ctatcaataccatagatgctt

SEQ ID NO: 41028 - DNA, 21 bp, Artificial sequence
  SiRNA target sequence
tatcaataccatagatgcttc

SEQ ID NO: 41029 - DNA, 21 bp, Artificial sequence
  SiRNA target sequence
atcaataccatagatgcttca

SEQ ID NO: 41030 - DNA, 21 bp, Artificial sequence
  SiRNA target sequence
tcaataccatagatgcttcaa

SEQ ID NO: 41031 - DNA, 21 bp, Artificial sequence
  SiRNA target sequence
caataccatagatgcttcaat

SEQ ID NO: 41032 - DNA, 21 bp, Artificial sequence
  SiRNA target sequence
aataccatagatgcttcaatg

SEQ ID NO: 41033 - DNA, 21 bp, Artificial sequence
  SiRNA target sequence
ataccatagatgcttcaatgc

SEQ ID NO: 41034 - DNA, 21 bp, Artificial sequence
  SiRNA target sequence
taccatagatgcttcaatgca

SEQ ID NO: 41035 - DNA, 21 bp, Artificial sequence
  SiRNA target sequence
accatagatgcttcaatgcaa

SEQ ID NO: 41036 - DNA, 21 bp, Artificial sequence
  SiRNA target sequence
ccatagatgcttcaatgcaaa

SEQ ID NO: 41037 - DNA, 21 bp, Artificial sequence
  SiRNA target sequence
catagatgcttcaatgcaaat

SEQ ID NO: 41038 - DNA, 21 bp, Artificial sequence
  SiRNA target sequence
atagatgcttcaatgcaaatt

SEQ ID NO: 41039 - DNA, 21 bp, Artificial sequence
  SiRNA target sequence
tagatgcttcaatgcaaatta

SEQ ID NO: 41040 - DNA, 21 bp, Artificial sequence
  SiRNA target sequence
agatgcttcaatgcaaattaa

SEQ ID NO: 41041 - DNA, 21 bp, Artificial sequence
  SiRNA target sequence
gatgcttcaatgcaaattaac

SEQ ID NO: 41042 - DNA, 21 bp, Artificial sequence
  SiRNA target sequence
atgcttcaatgcaaattaact

SEQ ID NO: 41043 - DNA, 21 bp, Artificial sequence
  SiRNA target sequence
tgcttcaatgcaaattaactt

SEQ ID NO: 41044 - DNA, 21 bp, Artificial sequence
  SiRNA target sequence
gcttcaatgcaaattaactta

SEQ ID NO: 41045 - DNA, 21 bp, Artificial sequence
  SiRNA target sequence
cttcaatgcaaattaacttag

SEQ ID NO: 41046 - DNA, 21 bp, Artificial sequence
  SiRNA target sequence
ttcaatgcaaattaacttagc

SEQ ID NO: 41047 - DNA, 21 bp, Artificial sequence
  SiRNA target sequence
tcaatgcaaattaacttagca

SEQ ID NO: 41048 - DNA, 21 bp, Artificial sequence
  SiRNA target sequence
caatgcaaattaacttagcaa

SEQ ID NO: 41049 - DNA, 21 bp, Artificial sequence
  SiRNA target sequence
aatgcaaattaacttagcaaa

SEQ ID NO: 41050 - DNA, 21 bp, Artificial sequence
  SiRNA target sequence
atgcaaattaacttagcaaat

SEQ ID NO: 41051 - DNA, 21 bp, Artificial sequence
  SiRNA target sequence
tgcaaattaacttagcaaata

SEQ ID NO: 41052 - DNA, 21 bp, Artificial sequence
  SiRNA target sequence
gcaaattaacttagcaaataa

SEQ ID NO: 41053 - DNA, 21 bp, Artificial sequence
  SiRNA target sequence
caaattaacttagcaaataaa

SEQ ID NO: 41054 - DNA, 21 bp, Artificial sequence
  SiRNA target sequence
aaattaacttagcaaataaag

SEQ ID NO: 41055 - DNA, 21 bp, Artificial sequence
  SiRNA target sequence
aattaacttagcaaataaagc

SEQ ID NO: 41056 - DNA, 21 bp, Artificial sequence
  SiRNA target sequence
attaacttagcaaataaagct

SEQ ID NO: 41057 - DNA, 21 bp, Artificial sequence
  SiRNA target sequence
ttaacttagcaaataaagctg

SEQ ID NO: 41058 - DNA, 21 bp, Artificial sequence
  SiRNA target sequence
taacttagcaaataaagctga

SEQ ID NO: 41059 - DNA, 21 bp, Artificial sequence
  SiRNA target sequence
aacttagcaaataaagctgat

SEQ ID NO: 41060 - DNA, 21 bp, Artificial sequence
  SiRNA target sequence
acttagcaaataaagctgatg

SEQ ID NO: 41061 - DNA, 21 bp, Artificial sequence
  SiRNA target sequence
cttagcaaataaagctgatga

SEQ ID NO: 41062 - DNA, 21 bp, Artificial sequence
  SiRNA target sequence
ttagcaaataaagctgatgaa

SEQ ID NO: 41063 - DNA, 21 bp, Artificial sequence
  SiRNA target sequence
tagcaaataaagctgatgaaa

SEQ ID NO: 41064 - DNA, 21 bp, Artificial sequence
  SiRNA target sequence
agcaaataaagctgatgaaaa

SEQ ID NO: 41065 - DNA, 21 bp, Artificial sequence
  SiRNA target sequence
gcaaataaagctgatgaaaat

SEQ ID NO: 41066 - DNA, 21 bp, Artificial sequence
  SiRNA target sequence
caaataaagctgatgaaaatg

SEQ ID NO: 41067 - DNA, 21 bp, Artificial sequence
  SiRNA target sequence
aaataaagctgatgaaaatgt

SEQ ID NO: 41068 - DNA, 21 bp, Artificial sequence
  SiRNA target sequence
aataaagctgatgaaaatgta

SEQ ID NO: 41069 - DNA, 21 bp, Artificial sequence
  SiRNA target sequence
ataaagctgatgaaaatgtag

SEQ ID NO: 41070 - DNA, 21 bp, Artificial sequence
  SiRNA target sequence
taaagctgatgaaaatgtagt

SEQ ID NO: 41071 - DNA, 21 bp, Artificial sequence
  SiRNA target sequence
aaagctgatgaaaatgtagtt

SEQ ID NO: 41072 - DNA, 21 bp, Artificial sequence
  SiRNA target sequence
aagctgatgaaaatgtagtta

SEQ ID NO: 41073 - DNA, 21 bp, Artificial sequence
  SiRNA target sequence
agctgatgaaaatgtagttac

SEQ ID NO: 41074 - DNA, 21 bp, Artificial sequence
  SiRNA target sequence
gctgatgaaaatgtagttaca

SEQ ID NO: 41075 - DNA, 21 bp, Artificial sequence
  SiRNA target sequence
ctgatgaaaatgtagttacat

SEQ ID NO: 41076 - DNA, 21 bp, Artificial sequence
  SiRNA target sequence
tgatgaaaatgtagttacatt

SEQ ID NO: 41077 - DNA, 21 bp, Artificial sequence
  SiRNA target sequence
gatgaaaatgtagttacattc

SEQ ID NO: 41078 - DNA, 21 bp, Artificial sequence
  SiRNA target sequence
atgaaaatgtagttacattct

SEQ ID NO: 41079 - DNA, 21 bp, Artificial sequence
  SiRNA target sequence
tgaaaatgtagttacattctt

SEQ ID NO: 41080 - DNA, 21 bp, Artificial sequence
  SiRNA target sequence
gaaaatgtagttacattcttt

SEQ ID NO: 41081 - DNA, 21 bp, Artificial sequence
  SiRNA target sequence
aaaatgtagttacattctttg

SEQ ID NO: 41082 - DNA, 21 bp, Artificial sequence
  SiRNA target sequence
aaatgtagttacattctttga

SEQ ID NO: 41083 - DNA, 21 bp, Artificial sequence
  SiRNA target sequence
aatgtagttacattctttgat

SEQ ID NO: 41084 - DNA, 21 bp, Artificial sequence
  SiRNA target sequence
atgtagttacattctttgatt

SEQ ID NO: 41085 - DNA, 21 bp, Artificial sequence
  SiRNA target sequence
tgtagttacattctttgattc

SEQ ID NO: 41086 - DNA, 21 bp, Artificial sequence
  SiRNA target sequence
gtagttacattctttgattct

SEQ ID NO: 41087 - DNA, 21 bp, Artificial sequence
  SiRNA target sequence
tagttacattctttgattctg

SEQ ID NO: 41088 - DNA, 21 bp, Artificial sequence
  SiRNA target sequence
agttacattctttgattctga

SEQ ID NO: 41089 - DNA, 21 bp, Artificial sequence
  SiRNA target sequence
gttacattctttgattctgat

SEQ ID NO: 41090 - DNA, 21 bp, Artificial sequence
  SiRNA target sequence
ttacattctttgattctgatg

SEQ ID NO: 41091 - DNA, 21 bp, Artificial sequence
  SiRNA target sequence
tacattctttgattctgatga

SEQ ID NO: 41092 - DNA, 21 bp, Artificial sequence
  SiRNA target sequence
acattctttgattctgatgat

SEQ ID NO: 41093 - DNA, 21 bp, Artificial sequence
  SiRNA target sequence
cattctttgattctgatgatg

SEQ ID NO: 41094 - DNA, 21 bp, Artificial sequence
  SiRNA target sequence
attctttgattctgatgatgc

SEQ ID NO: 41095 - DNA, 21 bp, Artificial sequence
  SiRNA target sequence
ttctttgattctgatgatgct

SEQ ID NO: 41096 - DNA, 21 bp, Artificial sequence
  SiRNA target sequence
tctttgattctgatgatgctg

SEQ ID NO: 41097 - DNA, 21 bp, Artificial sequence
  SiRNA target sequence
ctttgattctgatgatgctga

SEQ ID NO: 41098 - DNA, 21 bp, Artificial sequence
  SiRNA target sequence
tttgattctgatgatgctgaa

SEQ ID NO: 41099 - DNA, 21 bp, Artificial sequence
  SiRNA target sequence
ttgattctgatgatgctgaag

SEQ ID NO: 41100 - DNA, 21 bp, Artificial sequence
  SiRNA target sequence
tgattctgatgatgctgaaga

SEQ ID NO: 41101 - DNA, 21 bp, Artificial sequence
  SiRNA target sequence
gattctgatgatgctgaagaa

SEQ ID NO: 41102 - DNA, 21 bp, Artificial sequence
  SiRNA target sequence
attctgatgatgctgaagaaa

SEQ ID NO: 41103 - DNA, 21 bp, Artificial sequence
  SiRNA target sequence
ttctgatgatgctgaagaaag

SEQ ID NO: 41104 - DNA, 21 bp, Artificial sequence
  SiRNA target sequence
tctgatgatgctgaagaaagg

SEQ ID NO: 41105 - DNA, 21 bp, Artificial sequence
  SiRNA target sequence
ctgatgatgctgaagaaagga

SEQ ID NO: 41106 - DNA, 21 bp, Artificial sequence
  SiRNA target sequence
tgatgatgctgaagaaaggaa

SEQ ID NO: 41107 - DNA, 21 bp, Artificial sequence
  SiRNA target sequence
gatgatgctgaagaaaggaac

SEQ ID NO: 41108 - DNA, 21 bp, Artificial sequence
  SiRNA target sequence
atgatgctgaagaaaggaaca

SEQ ID NO: 41109 - DNA, 21 bp, Artificial sequence
  SiRNA target sequence
tgatgctgaagaaaggaacat

SEQ ID NO: 41110 - DNA, 21 bp, Artificial sequence
  SiRNA target sequence
gatgctgaagaaaggaacatg

SEQ ID NO: 41111 - DNA, 21 bp, Artificial sequence
  SiRNA target sequence
atgctgaagaaaggaacatgg

SEQ ID NO: 41112 - DNA, 21 bp, Artificial sequence
  SiRNA target sequence
tgctgaagaaaggaacatgga

SEQ ID NO: 41113 - DNA, 21 bp, Artificial sequence
  SiRNA target sequence
gctgaagaaaggaacatggaa

SEQ ID NO: 41114 - DNA, 21 bp, Artificial sequence
  SiRNA target sequence
ctgaagaaaggaacatggaag

SEQ ID NO: 41115 - DNA, 21 bp, Artificial sequence
  SiRNA target sequence
tgaagaaaggaacatggaagc

SEQ ID NO: 41116 - DNA, 21 bp, Artificial sequence
  SiRNA target sequence
gaagaaaggaacatggaagca

SEQ ID NO: 41117 - DNA, 21 bp, Artificial sequence
  SiRNA target sequence
aagaaaggaacatggaagcat

SEQ ID NO: 41118 - DNA, 21 bp, Artificial sequence
  SiRNA target sequence
agaaaggaacatggaagcatt

SEQ ID NO: 41119 - DNA, 21 bp, Artificial sequence
  SiRNA target sequence
gaaaggaacatggaagcatta

SEQ ID NO: 41120 - DNA, 21 bp, Artificial sequence
  SiRNA target sequence
aaaggaacatggaagcattat

SEQ ID NO: 41121 - DNA, 21 bp, Artificial sequence
  SiRNA target sequence
aaggaacatggaagcattatt

SEQ ID NO: 41122 - DNA, 21 bp, Artificial sequence
  SiRNA target sequence
aggaacatggaagcattattg

SEQ ID NO: 41123 - DNA, 21 bp, Artificial sequence
  SiRNA target sequence
ggaacatggaagcattattga

SEQ ID NO: 41124 - DNA, 21 bp, Artificial sequence
  SiRNA target sequence
gaacatggaagcattattgaa

SEQ ID NO: 41125 - DNA, 21 bp, Artificial sequence
  SiRNA target sequence
aacatggaagcattattgaaa

SEQ ID NO: 41126 - DNA, 21 bp, Artificial sequence
  SiRNA target sequence
acatggaagcattattgaaag

SEQ ID NO: 41127 - DNA, 21 bp, Artificial sequence
  SiRNA target sequence
catggaagcattattgaaagg

SEQ ID NO: 41128 - DNA, 21 bp, Artificial sequence
  SiRNA target sequence
atggaagcattattgaaagga

SEQ ID NO: 41129 - DNA, 21 bp, Artificial sequence
  SiRNA target sequence
tggaagcattattgaaaggaa

SEQ ID NO: 41130 - DNA, 21 bp, Artificial sequence
  SiRNA target sequence
ggaagcattattgaaaggaag

SEQ ID NO: 41131 - DNA, 21 bp, Artificial sequence
  SiRNA target sequence
gaagcattattgaaaggaagt

SEQ ID NO: 41132 - DNA, 21 bp, Artificial sequence
  SiRNA target sequence
aagcattattgaaaggaagtg

SEQ ID NO: 41133 - DNA, 21 bp, Artificial sequence
  SiRNA target sequence
agcattattgaaaggaagtgg

SEQ ID NO: 41134 - DNA, 21 bp, Artificial sequence
  SiRNA target sequence
gcattattgaaaggaagtggt

SEQ ID NO: 41135 - DNA, 21 bp, Artificial sequence
  SiRNA target sequence
cattattgaaaggaagtggtg

SEQ ID NO: 41136 - DNA, 21 bp, Artificial sequence
  SiRNA target sequence
attattgaaaggaagtggtga

SEQ ID NO: 41137 - DNA, 21 bp, Artificial sequence
  SiRNA target sequence
ttattgaaaggaagtggtgaa

SEQ ID NO: 41138 - DNA, 21 bp, Artificial sequence
  SiRNA target sequence
tattgaaaggaagtggtgaac

SEQ ID NO: 41139 - DNA, 21 bp, Artificial sequence
  SiRNA target sequence
attgaaaggaagtggtgaaca

SEQ ID NO: 41140 - DNA, 21 bp, Artificial sequence
  SiRNA target sequence
ttgaaaggaagtggtgaacaa

SEQ ID NO: 41141 - DNA, 21 bp, Artificial sequence
  SiRNA target sequence
tgaaaggaagtggtgaacaaa

SEQ ID NO: 41142 - DNA, 21 bp, Artificial sequence
  SiRNA target sequence
gaaaggaagtggtgaacaaat

SEQ ID NO: 41143 - DNA, 21 bp, Artificial sequence
  SiRNA target sequence
aaaggaagtggtgaacaaatc

SEQ ID NO: 41144 - DNA, 21 bp, Artificial sequence
  SiRNA target sequence
aaggaagtggtgaacaaatca

SEQ ID NO: 41145 - DNA, 21 bp, Artificial sequence
  SiRNA target sequence
aggaagtggtgaacaaatcat

SEQ ID NO: 41146 - DNA, 21 bp, Artificial sequence
  SiRNA target sequence
ggaagtggtgaacaaatcatg

SEQ ID NO: 41147 - DNA, 21 bp, Artificial sequence
  SiRNA target sequence
gaagtggtgaacaaatcatga

SEQ ID NO: 41148 - DNA, 21 bp, Artificial sequence
  SiRNA target sequence
aagtggtgaacaaatcatgaa

SEQ ID NO: 41149 - DNA, 21 bp, Artificial sequence
  SiRNA target sequence
agtggtgaacaaatcatgaat

SEQ ID NO: 41150 - DNA, 21 bp, Artificial sequence
  SiRNA target sequence
gtggtgaacaaatcatgaatt

SEQ ID NO: 41151 - DNA, 21 bp, Artificial sequence
  SiRNA target sequence
tggtgaacaaatcatgaattt

SEQ ID NO: 41152 - DNA, 21 bp, Artificial sequence
  SiRNA target sequence
ggtgaacaaatcatgaatttg

SEQ ID NO: 41153 - DNA, 21 bp, Artificial sequence
  SiRNA target sequence
gtgaacaaatcatgaatttga

SEQ ID NO: 41154 - DNA, 21 bp, Artificial sequence
  SiRNA target sequence
tgaacaaatcatgaatttgag

SEQ ID NO: 41155 - DNA, 21 bp, Artificial sequence
  SiRNA target sequence
gaacaaatcatgaatttgaga

SEQ ID NO: 41156 - DNA, 21 bp, Artificial sequence
  SiRNA target sequence
aacaaatcatgaatttgagat

SEQ ID NO: 41157 - DNA, 21 bp, Artificial sequence
  SiRNA target sequence
acaaatcatgaatttgagatc

SEQ ID NO: 41158 - DNA, 21 bp, Artificial sequence
  SiRNA target sequence
caaatcatgaatttgagatcc

SEQ ID NO: 41159 - DNA, 21 bp, Artificial sequence
  SiRNA target sequence
aaatcatgaatttgagatcct

SEQ ID NO: 41160 - DNA, 21 bp, Artificial sequence
  SiRNA target sequence
aatcatgaatttgagatcctt

SEQ ID NO: 41161 - DNA, 21 bp, Artificial sequence
  SiRNA target sequence
atcatgaatttgagatcctta

SEQ ID NO: 41162 - DNA, 21 bp, Artificial sequence
  SiRNA target sequence
tcatgaatttgagatccttac

SEQ ID NO: 41163 - DNA, 21 bp, Artificial sequence
  SiRNA target sequence
catgaatttgagatccttact

SEQ ID NO: 41164 - DNA, 21 bp, Artificial sequence
  SiRNA target sequence
atgaatttgagatccttacta

SEQ ID NO: 41165 - DNA, 21 bp, Artificial sequence
  SiRNA target sequence
tgaatttgagatccttactaa

SEQ ID NO: 41166 - DNA, 21 bp, Artificial sequence
  SiRNA target sequence
gaatttgagatccttactaag

SEQ ID NO: 41167 - DNA, 21 bp, Artificial sequence
  SiRNA target sequence
aatttgagatccttactaaga

SEQ ID NO: 41168 - DNA, 21 bp, Artificial sequence
  SiRNA target sequence
atttgagatccttactaagaa

SEQ ID NO: 41169 - DNA, 21 bp, Artificial sequence
  SiRNA target sequence
tttgagatccttactaagaac

SEQ ID NO: 41170 - DNA, 21 bp, Artificial sequence
  SiRNA target sequence
ttgagatccttactaagaacg

SEQ ID NO: 41171 - DNA, 21 bp, Artificial sequence
  SiRNA target sequence
tgagatccttactaagaacgt

SEQ ID NO: 41172 - DNA, 21 bp, Artificial sequence
  SiRNA target sequence
gagatccttactaagaacgtt

SEQ ID NO: 41173 - DNA, 21 bp, Artificial sequence
  SiRNA target sequence
agatccttactaagaacgttt

SEQ ID NO: 41174 - DNA, 21 bp, Artificial sequence
  SiRNA target sequence
gatccttactaagaacgttta

SEQ ID NO: 41175 - DNA, 21 bp, Artificial sequence
  SiRNA target sequence
atccttactaagaacgtttag

SEQ ID NO: 41176 - DNA, 21 bp, Artificial sequence
  SiRNA target sequence
tccttactaagaacgtttagg

SEQ ID NO: 41177 - DNA, 21 bp, Artificial sequence
  SiRNA target sequence
ccttactaagaacgtttagga

SEQ ID NO: 41178 - DNA, 21 bp, Artificial sequence
  SiRNA target sequence
cttactaagaacgtttaggac

SEQ ID NO: 41179 - DNA, 21 bp, Artificial sequence
  SiRNA target sequence
ttactaagaacgtttaggacc

SEQ ID NO: 41180 - DNA, 21 bp, Artificial sequence
  SiRNA target sequence
tactaagaacgtttaggacca

SEQ ID NO: 41181 - DNA, 21 bp, Artificial sequence
  SiRNA target sequence
actaagaacgtttaggaccat

SEQ ID NO: 41182 - DNA, 21 bp, Artificial sequence
  SiRNA target sequence
ctaagaacgtttaggaccata

SEQ ID NO: 41183 - DNA, 21 bp, Artificial sequence
  SiRNA target sequence
taagaacgtttaggaccatat

SEQ ID NO: 41184 - DNA, 21 bp, Artificial sequence
  SiRNA target sequence
aagaacgtttaggaccatatc

SEQ ID NO: 41185 - DNA, 21 bp, Artificial sequence
  SiRNA target sequence
agaacgtttaggaccatatca

SEQ ID NO: 41186 - DNA, 21 bp, Artificial sequence
  SiRNA target sequence
gaacgtttaggaccatatcag

SEQ ID NO: 41187 - DNA, 21 bp, Artificial sequence
  SiRNA target sequence
aacgtttaggaccatatcaga

SEQ ID NO: 41188 - DNA, 21 bp, Artificial sequence
  SiRNA target sequence
acgtttaggaccatatcagaa

SEQ ID NO: 41189 - DNA, 21 bp, Artificial sequence
  SiRNA target sequence
cgtttaggaccatatcagaaa

SEQ ID NO: 41190 - DNA, 21 bp, Artificial sequence
  SiRNA target sequence
gtttaggaccatatcagaaaa

SEQ ID NO: 41191 - DNA, 21 bp, Artificial sequence
  SiRNA target sequence
tttaggaccatatcagaaaat

SEQ ID NO: 41192 - DNA, 21 bp, Artificial sequence
  SiRNA target sequence
ttaggaccatatcagaaaatt

SEQ ID NO: 41193 - DNA, 21 bp, Artificial sequence
  SiRNA target sequence
taggaccatatcagaaaattg

SEQ ID NO: 41194 - DNA, 21 bp, Artificial sequence
  SiRNA target sequence
aggaccatatcagaaaattgg

SEQ ID NO: 41195 - DNA, 21 bp, Artificial sequence
  SiRNA target sequence
ggaccatatcagaaaattgga

SEQ ID NO: 41196 - DNA, 21 bp, Artificial sequence
  SiRNA target sequence
gaccatatcagaaaattggaa

SEQ ID NO: 41197 - DNA, 21 bp, Artificial sequence
  SiRNA target sequence
accatatcagaaaattggaat

SEQ ID NO: 41198 - DNA, 21 bp, Artificial sequence
  SiRNA target sequence
ccatatcagaaaattggaatt

SEQ ID NO: 41199 - DNA, 21 bp, Artificial sequence
  SiRNA target sequence
catatcagaaaattggaattt

SEQ ID NO: 41200 - DNA, 21 bp, Artificial sequence
  SiRNA target sequence
atatcagaaaattggaattta

SEQ ID NO: 41201 - DNA, 21 bp, Artificial sequence
  SiRNA target sequence
tatcagaaaattggaatttac

SEQ ID NO: 41202 - DNA, 21 bp, Artificial sequence
  SiRNA target sequence
atcagaaaattggaatttacc

SEQ ID NO: 41203 - DNA, 21 bp, Artificial sequence
  SiRNA target sequence
tcagaaaattggaatttacca

SEQ ID NO: 41204 - DNA, 21 bp, Artificial sequence
  SiRNA target sequence
cagaaaattggaatttaccac

SEQ ID NO: 41205 - DNA, 21 bp, Artificial sequence
  SiRNA target sequence
agaaaattggaatttaccacc

SEQ ID NO: 41206 - DNA, 21 bp, Artificial sequence
  SiRNA target sequence
gaaaattggaatttaccacct

SEQ ID NO: 41207 - DNA, 21 bp, Artificial sequence
  SiRNA target sequence
aaaattggaatttaccaccta

SEQ ID NO: 41208 - DNA, 21 bp, Artificial sequence
  SiRNA target sequence
aaattggaatttaccacctaa

SEQ ID NO: 41209 - DNA, 21 bp, Artificial sequence
  SiRNA target sequence
aattggaatttaccacctaac

SEQ ID NO: 41210 - DNA, 21 bp, Artificial sequence
  SiRNA target sequence
attggaatttaccacctaaca

SEQ ID NO: 41211 - DNA, 21 bp, Artificial sequence
  SiRNA target sequence
ttggaatttaccacctaacac

SEQ ID NO: 41212 - DNA, 21 bp, Artificial sequence
  SiRNA target sequence
tggaatttaccacctaacaca

SEQ ID NO: 41213 - DNA, 21 bp, Artificial sequence
  SiRNA target sequence
ggaatttaccacctaacacaa

SEQ ID NO: 41214 - DNA, 21 bp, Artificial sequence
  SiRNA target sequence
gaatttaccacctaacacaaa

SEQ ID NO: 41215 - DNA, 21 bp, Artificial sequence
  SiRNA target sequence
aatttaccacctaacacaaaa

SEQ ID NO: 41216 - DNA, 21 bp, Artificial sequence
  SiRNA target sequence
atttaccacctaacacaaaaa

SEQ ID NO: 41217 - DNA, 21 bp, Artificial sequence
  SiRNA target sequence
tttaccacctaacacaaaaac

SEQ ID NO: 41218 - DNA, 21 bp, Artificial sequence
  SiRNA target sequence
ttaccacctaacacaaaaaca

SEQ ID NO: 41219 - DNA, 21 bp, Artificial sequence
  SiRNA target sequence
taccacctaacacaaaaacag

SEQ ID NO: 41220 - DNA, 21 bp, Artificial sequence
  SiRNA target sequence
accacctaacacaaaaacagc

SEQ ID NO: 41221 - DNA, 21 bp, Artificial sequence
  SiRNA target sequence
ccacctaacacaaaaacagca

SEQ ID NO: 41222 - DNA, 21 bp, Artificial sequence
  SiRNA target sequence
cacctaacacaaaaacagcaa

SEQ ID NO: 41223 - DNA, 21 bp, Artificial sequence
  SiRNA target sequence
acctaacacaaaaacagcaat

SEQ ID NO: 41224 - DNA, 21 bp, Artificial sequence
  SiRNA target sequence
cctaacacaaaaacagcaata

SEQ ID NO: 41225 - DNA, 21 bp, Artificial sequence
  SiRNA target sequence
ctaacacaaaaacagcaataa

SEQ ID NO: 41226 - DNA, 21 bp, Artificial sequence
  SiRNA target sequence
taacacaaaaacagcaataac

SEQ ID NO: 41227 - DNA, 21 bp, Artificial sequence
  SiRNA target sequence
aacacaaaaacagcaataaca

SEQ ID NO: 41228 - DNA, 21 bp, Artificial sequence
  SiRNA target sequence
acacaaaaacagcaataacag

SEQ ID NO: 41229 - DNA, 21 bp, Artificial sequence
  SiRNA target sequence
cacaaaaacagcaataacaga

SEQ ID NO: 41230 - DNA, 21 bp, Artificial sequence
  SiRNA target sequence
acaaaaacagcaataacagat

SEQ ID NO: 41231 - DNA, 21 bp, Artificial sequence
  SiRNA target sequence
caaaaacagcaataacagatt

SEQ ID NO: 41232 - DNA, 21 bp, Artificial sequence
  SiRNA target sequence
aaaaacagcaataacagattt

SEQ ID NO: 41233 - DNA, 21 bp, Artificial sequence
  SiRNA target sequence
aaaacagcaataacagatttg

SEQ ID NO: 41234 - DNA, 21 bp, Artificial sequence
  SiRNA target sequence
aaacagcaataacagatttga

SEQ ID NO: 41235 - DNA, 21 bp, Artificial sequence
  SiRNA target sequence
aacagcaataacagatttgac

SEQ ID NO: 41236 - DNA, 21 bp, Artificial sequence
  SiRNA target sequence
acagcaataacagatttgact

SEQ ID NO: 41237 - DNA, 21 bp, Artificial sequence
  SiRNA target sequence
cagcaataacagatttgactg

SEQ ID NO: 41238 - DNA, 21 bp, Artificial sequence
  SiRNA target sequence
agcaataacagatttgactga

SEQ ID NO: 41239 - DNA, 21 bp, Artificial sequence
  SiRNA target sequence
gcaataacagatttgactgac

SEQ ID NO: 41240 - DNA, 21 bp, Artificial sequence
  SiRNA target sequence
caataacagatttgactgacg

SEQ ID NO: 41241 - DNA, 21 bp, Artificial sequence
  SiRNA target sequence
aataacagatttgactgacgt

SEQ ID NO: 41242 - DNA, 21 bp, Artificial sequence
  SiRNA target sequence
ataacagatttgactgacgtt

SEQ ID NO: 41243 - DNA, 21 bp, Artificial sequence
  SiRNA target sequence
taacagatttgactgacgttg

SEQ ID NO: 41244 - DNA, 21 bp, Artificial sequence
  SiRNA target sequence
aacagatttgactgacgttgc

SEQ ID NO: 41245 - DNA, 21 bp, Artificial sequence
  SiRNA target sequence
acagatttgactgacgttgcg

SEQ ID NO: 41246 - DNA, 21 bp, Artificial sequence
  SiRNA target sequence
cagatttgactgacgttgcgg

SEQ ID NO: 41247 - DNA, 21 bp, Artificial sequence
  SiRNA target sequence
agatttgactgacgttgcgga

SEQ ID NO: 41248 - DNA, 21 bp, Artificial sequence
  SiRNA target sequence
gatttgactgacgttgcggat

SEQ ID NO: 41249 - DNA, 21 bp, Artificial sequence
  SiRNA target sequence
atttgactgacgttgcggata

SEQ ID NO: 41250 - DNA, 21 bp, Artificial sequence
  SiRNA target sequence
tttgactgacgttgcggataa

SEQ ID NO: 41251 - DNA, 21 bp, Artificial sequence
  SiRNA target sequence
ttgactgacgttgcggataaa

SEQ ID NO: 41252 - DNA, 21 bp, Artificial sequence
  SiRNA target sequence
tgactgacgttgcggataaag

SEQ ID NO: 41253 - DNA, 21 bp, Artificial sequence
  SiRNA target sequence
gactgacgttgcggataaaga

SEQ ID NO: 41254 - DNA, 21 bp, Artificial sequence
  SiRNA target sequence
actgacgttgcggataaagaa

SEQ ID NO: 41255 - DNA, 21 bp, Artificial sequence
  SiRNA target sequence
ctgacgttgcggataaagaag

SEQ ID NO: 41256 - DNA, 21 bp, Artificial sequence
  SiRNA target sequence
tgacgttgcggataaagaagg

SEQ ID NO: 41257 - DNA, 21 bp, Artificial sequence
  SiRNA target sequence
gacgttgcggataaagaaggt

SEQ ID NO: 41258 - DNA, 21 bp, Artificial sequence
  SiRNA target sequence
acgttgcggataaagaaggta

SEQ ID NO: 41259 - DNA, 21 bp, Artificial sequence
  SiRNA target sequence
cgttgcggataaagaaggtag

SEQ ID NO: 41260 - DNA, 21 bp, Artificial sequence
  SiRNA target sequence
gttgcggataaagaaggtagg

SEQ ID NO: 41261 - DNA, 21 bp, Artificial sequence
  SiRNA target sequence
ttgcggataaagaaggtaggg

SEQ ID NO: 41262 - DNA, 21 bp, Artificial sequence
  SiRNA target sequence
tgcggataaagaaggtaggga

SEQ ID NO: 41263 - DNA, 21 bp, Artificial sequence
  SiRNA target sequence
gcggataaagaaggtagggat

SEQ ID NO: 41264 - DNA, 21 bp, Artificial sequence
  SiRNA target sequence
cggataaagaaggtagggatt

SEQ ID NO: 41265 - DNA, 21 bp, Artificial sequence
  SiRNA target sequence
ggataaagaaggtagggatta

SEQ ID NO: 41266 - DNA, 21 bp, Artificial sequence
  SiRNA target sequence
gataaagaaggtagggattat

SEQ ID NO: 41267 - DNA, 21 bp, Artificial sequence
  SiRNA target sequence
ataaagaaggtagggattata

SEQ ID NO: 41268 - DNA, 21 bp, Artificial sequence
  SiRNA target sequence
taaagaaggtagggattatat

SEQ ID NO: 41269 - DNA, 21 bp, Artificial sequence
  SiRNA target sequence
aaagaaggtagggattatatg

SEQ ID NO: 41270 - DNA, 21 bp, Artificial sequence
  SiRNA target sequence
aagaaggtagggattatatgt

SEQ ID NO: 41271 - DNA, 21 bp, Artificial sequence
  SiRNA target sequence
agaaggtagggattatatgtc

SEQ ID NO: 41272 - DNA, 21 bp, Artificial sequence
  SiRNA target sequence
gaaggtagggattatatgtct

SEQ ID NO: 41273 - DNA, 21 bp, Artificial sequence
  SiRNA target sequence
aaggtagggattatatgtctt

SEQ ID NO: 41274 - DNA, 21 bp, Artificial sequence
  SiRNA target sequence
aggtagggattatatgtctta

SEQ ID NO: 41275 - DNA, 21 bp, Artificial sequence
  SiRNA target sequence
ggtagggattatatgtcttat

SEQ ID NO: 41276 - DNA, 21 bp, Artificial sequence
  SiRNA target sequence
gtagggattatatgtcttatt

SEQ ID NO: 41277 - DNA, 21 bp, Artificial sequence
  SiRNA target sequence
tagggattatatgtcttattt

SEQ ID NO: 41278 - DNA, 21 bp, Artificial sequence
  SiRNA target sequence
agggattatatgtcttattta

SEQ ID NO: 41279 - DNA, 21 bp, Artificial sequence
  SiRNA target sequence
gggattatatgtcttatttat

SEQ ID NO: 41280 - DNA, 21 bp, Artificial sequence
  SiRNA target sequence
ggattatatgtcttatttatc

SEQ ID NO: 41281 - DNA, 21 bp, Artificial sequence
  SiRNA target sequence
gattatatgtcttatttatca

SEQ ID NO: 41282 - DNA, 21 bp, Artificial sequence
  SiRNA target sequence
attatatgtcttatttatcat

SEQ ID NO: 41283 - DNA, 21 bp, Artificial sequence
  SiRNA target sequence
ttatatgtcttatttatcata

SEQ ID NO: 41284 - DNA, 21 bp, Artificial sequence
  SiRNA target sequence
tatatgtcttatttatcatac

SEQ ID NO: 41285 - DNA, 21 bp, Artificial sequence
  SiRNA target sequence
atatgtcttatttatcataca

SEQ ID NO: 41286 - DNA, 21 bp, Artificial sequence
  SiRNA target sequence
tatgtcttatttatcatacat

SEQ ID NO: 41287 - DNA, 21 bp, Artificial sequence
  SiRNA target sequence
atgtcttatttatcatacatc

SEQ ID NO: 41288 - DNA, 21 bp, Artificial sequence
  SiRNA target sequence
tgtcttatttatcatacatct

SEQ ID NO: 41289 - DNA, 21 bp, Artificial sequence
  SiRNA target sequence
gtcttatttatcatacatcta

SEQ ID NO: 41290 - DNA, 21 bp, Artificial sequence
  SiRNA target sequence
tcttatttatcatacatctat

SEQ ID NO: 41291 - DNA, 21 bp, Artificial sequence
  SiRNA target sequence
cttatttatcatacatctata

SEQ ID NO: 41292 - DNA, 21 bp, Artificial sequence
  SiRNA target sequence
ttatttatcatacatctatag

SEQ ID NO: 41293 - DNA, 21 bp, Artificial sequence
  SiRNA target sequence
tatttatcatacatctataga

SEQ ID NO: 41294 - DNA, 21 bp, Artificial sequence
  SiRNA target sequence
atttatcatacatctatagat

SEQ ID NO: 41295 - DNA, 21 bp, Artificial sequence
  SiRNA target sequence
tttatcatacatctatagatt

SEQ ID NO: 41296 - DNA, 21 bp, Artificial sequence
  SiRNA target sequence
ttatcatacatctatagattc

SEQ ID NO: 41297 - DNA, 21 bp, Artificial sequence
  SiRNA target sequence
tatcatacatctatagattct

SEQ ID NO: 41298 - DNA, 21 bp, Artificial sequence
  SiRNA target sequence
atcatacatctatagattcta

SEQ ID NO: 41299 - DNA, 21 bp, Artificial sequence
  SiRNA target sequence
tcatacatctatagattctat

SEQ ID NO: 41300 - DNA, 21 bp, Artificial sequence
  SiRNA target sequence
catacatctatagattctata

SEQ ID NO: 41301 - DNA, 21 bp, Artificial sequence
  SiRNA target sequence
atacatctatagattctatag

SEQ ID NO: 41302 - DNA, 21 bp, Artificial sequence
  SiRNA target sequence
tacatctatagattctataga

SEQ ID NO: 41303 - DNA, 21 bp, Artificial sequence
  SiRNA target sequence
acatctatagattctatagag

SEQ ID NO: 41304 - DNA, 21 bp, Artificial sequence
  SiRNA target sequence
catctatagattctatagagg

SEQ ID NO: 41305 - DNA, 21 bp, Artificial sequence
  SiRNA target sequence
atctatagattctatagagga

SEQ ID NO: 41306 - DNA, 21 bp, Artificial sequence
  SiRNA target sequence
tctatagattctatagaggag

SEQ ID NO: 41307 - DNA, 21 bp, Artificial sequence
  SiRNA target sequence
ctatagattctatagaggagg

SEQ ID NO: 41308 - DNA, 21 bp, Artificial sequence
  SiRNA target sequence
tatagattctatagaggaggg

SEQ ID NO: 41309 - DNA, 21 bp, Artificial sequence
  SiRNA target sequence
atagattctatagaggaggga

SEQ ID NO: 41310 - DNA, 21 bp, Artificial sequence
  SiRNA target sequence
tagattctatagaggagggag

SEQ ID NO: 41311 - DNA, 21 bp, Artificial sequence
  SiRNA target sequence
agattctatagaggagggaga

SEQ ID NO: 41312 - DNA, 21 bp, Artificial sequence
  SiRNA target sequence
gattctatagaggagggagaa

SEQ ID NO: 41313 - DNA, 21 bp, Artificial sequence
  SiRNA target sequence
attctatagaggagggagaag

SEQ ID NO: 41314 - DNA, 21 bp, Artificial sequence
  SiRNA target sequence
ttctatagaggagggagaaga

SEQ ID NO: 41315 - DNA, 21 bp, Artificial sequence
  SiRNA target sequence
tctatagaggagggagaagat

SEQ ID NO: 41316 - DNA, 21 bp, Artificial sequence
  SiRNA target sequence
ctatagaggagggagaagata

SEQ ID NO: 41317 - DNA, 21 bp, Artificial sequence
  SiRNA target sequence
tatagaggagggagaagatat

SEQ ID NO: 41318 - DNA, 21 bp, Artificial sequence
  SiRNA target sequence
atagaggagggagaagatata

SEQ ID NO: 41319 - DNA, 21 bp, Artificial sequence
  SiRNA target sequence
tagaggagggagaagatataa

SEQ ID NO: 41320 - DNA, 21 bp, Artificial sequence
  SiRNA target sequence
agaggagggagaagatataag

SEQ ID NO: 41321 - DNA, 21 bp, Artificial sequence
  SiRNA target sequence
gaggagggagaagatataagt

SEQ ID NO: 41322 - DNA, 21 bp, Artificial sequence
  SiRNA target sequence
aggagggagaagatataagtt

SEQ ID NO: 41323 - DNA, 21 bp, Artificial sequence
  SiRNA target sequence
ggagggagaagatataagttt

SEQ ID NO: 41324 - DNA, 21 bp, Artificial sequence
  SiRNA target sequence
gagggagaagatataagtttt

SEQ ID NO: 41325 - DNA, 21 bp, Artificial sequence
  SiRNA target sequence
agggagaagatataagttttt

SEQ ID NO: 41326 - DNA, 21 bp, Artificial sequence
  SiRNA target sequence
gggagaagatataagtttttc

SEQ ID NO: 41327 - DNA, 21 bp, Artificial sequence
  SiRNA target sequence
ggagaagatataagtttttca

SEQ ID NO: 41328 - DNA, 21 bp, Artificial sequence
  SiRNA target sequence
gagaagatataagtttttcaa

SEQ ID NO: 41329 - DNA, 21 bp, Artificial sequence
  SiRNA target sequence
agaagatataagtttttcaat

SEQ ID NO: 41330 - DNA, 21 bp, Artificial sequence
  SiRNA target sequence
gaagatataagtttttcaata

SEQ ID NO: 41331 - DNA, 21 bp, Artificial sequence
  SiRNA target sequence
aagatataagtttttcaatac

SEQ ID NO: 41332 - DNA, 21 bp, Artificial sequence
  SiRNA target sequence
agatataagtttttcaataca

SEQ ID NO: 41333 - DNA, 21 bp, Artificial sequence
  SiRNA target sequence
gatataagtttttcaatacaa

SEQ ID NO: 41334 - DNA, 21 bp, Artificial sequence
  SiRNA target sequence
atataagtttttcaatacaac

SEQ ID NO: 41335 - DNA, 21 bp, Artificial sequence
  SiRNA target sequence
tataagtttttcaatacaaca

SEQ ID NO: 41336 - DNA, 21 bp, Artificial sequence
  SiRNA target sequence
ataagtttttcaatacaacag

SEQ ID NO: 41337 - DNA, 21 bp, Artificial sequence
  SiRNA target sequence
taagtttttcaatacaacagc

SEQ ID NO: 41338 - DNA, 21 bp, Artificial sequence
  SiRNA target sequence
aagtttttcaatacaacagct

SEQ ID NO: 41339 - DNA, 21 bp, Artificial sequence
  SiRNA target sequence
agtttttcaatacaacagctt

SEQ ID NO: 41340 - DNA, 21 bp, Artificial sequence
  SiRNA target sequence
gtttttcaatacaacagcttt

SEQ ID NO: 41341 - DNA, 21 bp, Artificial sequence
  SiRNA target sequence
tttttcaatacaacagctttg

SEQ ID NO: 41342 - DNA, 21 bp, Artificial sequence
  SiRNA target sequence
ttttcaatacaacagctttga

SEQ ID NO: 41343 - DNA, 21 bp, Artificial sequence
  SiRNA target sequence
tttcaatacaacagctttgaa

SEQ ID NO: 41344 - DNA, 21 bp, Artificial sequence
  SiRNA target sequence
ttcaatacaacagctttgaaa

SEQ ID NO: 41345 - DNA, 21 bp, Artificial sequence
  SiRNA target sequence
tcaatacaacagctttgaaac

SEQ ID NO: 41346 - DNA, 21 bp, Artificial sequence
  SiRNA target sequence
caatacaacagctttgaaaca

SEQ ID NO: 41347 - DNA, 21 bp, Artificial sequence
  SiRNA target sequence
aatacaacagctttgaaacaa

SEQ ID NO: 41348 - DNA, 21 bp, Artificial sequence
  SiRNA target sequence
atacaacagctttgaaacaat

SEQ ID NO: 41349 - DNA, 21 bp, Artificial sequence
  SiRNA target sequence
tacaacagctttgaaacaatc

SEQ ID NO: 41350 - DNA, 21 bp, Artificial sequence
  SiRNA target sequence
acaacagctttgaaacaatct

SEQ ID NO: 41351 - DNA, 21 bp, Artificial sequence
  SiRNA target sequence
caacagctttgaaacaatctc

SEQ ID NO: 41352 - DNA, 21 bp, Artificial sequence
  SiRNA target sequence
aacagctttgaaacaatctca

SEQ ID NO: 41353 - DNA, 21 bp, Artificial sequence
  SiRNA target sequence
acagctttgaaacaatctcaa

SEQ ID NO: 41354 - DNA, 21 bp, Artificial sequence
  SiRNA target sequence
cagctttgaaacaatctcaaa

SEQ ID NO: 41355 - DNA, 21 bp, Artificial sequence
  SiRNA target sequence
agctttgaaacaatctcaaac

SEQ ID NO: 41356 - DNA, 21 bp, Artificial sequence
  SiRNA target sequence
gctttgaaacaatctcaaact

SEQ ID NO: 41357 - DNA, 21 bp, Artificial sequence
  SiRNA target sequence
ctttgaaacaatctcaaactt

SEQ ID NO: 41358 - DNA, 21 bp, Artificial sequence
  SiRNA target sequence
tttgaaacaatctcaaacttg

SEQ ID NO: 41359 - DNA, 21 bp, Artificial sequence
  SiRNA target sequence
ttgaaacaatctcaaacttgc

SEQ ID NO: 41360 - DNA, 21 bp, Artificial sequence
  SiRNA target sequence
tgaaacaatctcaaacttgct

SEQ ID NO: 41361 - DNA, 21 bp, Artificial sequence
  SiRNA target sequence
gaaacaatctcaaacttgcta

SEQ ID NO: 41362 - DNA, 21 bp, Artificial sequence
  SiRNA target sequence
aaacaatctcaaacttgctat

SEQ ID NO: 41363 - DNA, 21 bp, Artificial sequence
  SiRNA target sequence
aacaatctcaaacttgctatg

SEQ ID NO: 41364 - DNA, 21 bp, Artificial sequence
  SiRNA target sequence
acaatctcaaacttgctatgt

SEQ ID NO: 41365 - DNA, 21 bp, Artificial sequence
  SiRNA target sequence
caatctcaaacttgctatgtt

SEQ ID NO: 41366 - DNA, 21 bp, Artificial sequence
  SiRNA target sequence
aatctcaaacttgctatgttc

SEQ ID NO: 41367 - DNA, 21 bp, Artificial sequence
  SiRNA target sequence
atctcaaacttgctatgttcg

SEQ ID NO: 41368 - DNA, 21 bp, Artificial sequence
  SiRNA target sequence
tctcaaacttgctatgttcgt

SEQ ID NO: 41369 - DNA, 21 bp, Artificial sequence
  SiRNA target sequence
ctcaaacttgctatgttcgta

SEQ ID NO: 41370 - DNA, 21 bp, Artificial sequence
  SiRNA target sequence
tcaaacttgctatgttcgtag

SEQ ID NO: 41371 - DNA, 21 bp, Artificial sequence
  SiRNA target sequence
caaacttgctatgttcgtagc

SEQ ID NO: 41372 - DNA, 21 bp, Artificial sequence
  SiRNA target sequence
aaacttgctatgttcgtagct

SEQ ID NO: 41373 - DNA, 21 bp, Artificial sequence
  SiRNA target sequence
aacttgctatgttcgtagctt

SEQ ID NO: 41374 - DNA, 21 bp, Artificial sequence
  SiRNA target sequence
acttgctatgttcgtagcttc

SEQ ID NO: 41375 - DNA, 21 bp, Artificial sequence
  SiRNA target sequence
cttgctatgttcgtagcttct

SEQ ID NO: 41376 - DNA, 21 bp, Artificial sequence
  SiRNA target sequence
ttgctatgttcgtagcttctt

SEQ ID NO: 41377 - DNA, 21 bp, Artificial sequence
  SiRNA target sequence
tgctatgttcgtagcttctta

SEQ ID NO: 41378 - DNA, 21 bp, Artificial sequence
  SiRNA target sequence
gctatgttcgtagcttcttaa

SEQ ID NO: 41379 - DNA, 21 bp, Artificial sequence
  SiRNA target sequence
ctatgttcgtagcttcttaat

SEQ ID NO: 41380 - DNA, 21 bp, Artificial sequence
  SiRNA target sequence
tatgttcgtagcttcttaata

SEQ ID NO: 41381 - DNA, 21 bp, Artificial sequence
  SiRNA target sequence
atgttcgtagcttcttaatac

SEQ ID NO: 41382 - DNA, 21 bp, Artificial sequence
  SiRNA target sequence
tgttcgtagcttcttaatacc

SEQ ID NO: 41383 - DNA, 21 bp, Artificial sequence
  SiRNA target sequence
gttcgtagcttcttaataccg

SEQ ID NO: 41384 - DNA, 21 bp, Artificial sequence
  SiRNA target sequence
ttcgtagcttcttaataccgc

SEQ ID NO: 41385 - DNA, 21 bp, Artificial sequence
  SiRNA target sequence
tcgtagcttcttaataccgcg

SEQ ID NO: 41386 - DNA, 21 bp, Artificial sequence
  SiRNA target sequence
cgtagcttcttaataccgcga

SEQ ID NO: 41387 - DNA, 21 bp, Artificial sequence
  SiRNA target sequence
gtagcttcttaataccgcgat

SEQ ID NO: 41388 - DNA, 21 bp, Artificial sequence
  SiRNA target sequence
tagcttcttaataccgcgata

SEQ ID NO: 41389 - DNA, 21 bp, Artificial sequence
  SiRNA target sequence
agcttcttaataccgcgatat

SEQ ID NO: 41390 - DNA, 21 bp, Artificial sequence
  SiRNA target sequence
gcttcttaataccgcgatatt

SEQ ID NO: 41391 - DNA, 21 bp, Artificial sequence
  SiRNA target sequence
cttcttaataccgcgatatta

SEQ ID NO: 41392 - DNA, 21 bp, Artificial sequence
  SiRNA target sequence
ttcttaataccgcgatattat

SEQ ID NO: 41393 - DNA, 21 bp, Artificial sequence
  SiRNA target sequence
tcttaataccgcgatattata

SEQ ID NO: 41394 - DNA, 21 bp, Artificial sequence
  SiRNA target sequence
cttaataccgcgatattatac

SEQ ID NO: 41395 - DNA, 21 bp, Artificial sequence
  SiRNA target sequence
ttaataccgcgatattatact

SEQ ID NO: 41396 - DNA, 21 bp, Artificial sequence
  SiRNA target sequence
taataccgcgatattatactg

SEQ ID NO: 41397 - DNA, 21 bp, Artificial sequence
  SiRNA target sequence
aataccgcgatattatactgc

SEQ ID NO: 41398 - DNA, 21 bp, Artificial sequence
  SiRNA target sequence
ataccgcgatattatactgct

SEQ ID NO: 41399 - DNA, 21 bp, Artificial sequence
  SiRNA target sequence
taccgcgatattatactgctg

SEQ ID NO: 41400 - DNA, 21 bp, Artificial sequence
  SiRNA target sequence
accgcgatattatactgctga

SEQ ID NO: 41401 - DNA, 21 bp, Artificial sequence
  SiRNA target sequence
ccgcgatattatactgctgat

SEQ ID NO: 41402 - DNA, 21 bp, Artificial sequence
  SiRNA target sequence
cgcgatattatactgctgata

SEQ ID NO: 41403 - DNA, 21 bp, Artificial sequence
  SiRNA target sequence
gcgatattatactgctgataa

SEQ ID NO: 41404 - DNA, 21 bp, Artificial sequence
  SiRNA target sequence
cgatattatactgctgataac

SEQ ID NO: 41405 - DNA, 21 bp, Artificial sequence
  SiRNA target sequence
gatattatactgctgataaca

SEQ ID NO: 41406 - DNA, 21 bp, Artificial sequence
  SiRNA target sequence
atattatactgctgataacac

SEQ ID NO: 41407 - DNA, 21 bp, Artificial sequence
  SiRNA target sequence
tattatactgctgataacaca

SEQ ID NO: 41408 - DNA, 21 bp, Artificial sequence
  SiRNA target sequence
attatactgctgataacacaa

SEQ ID NO: 41409 - DNA, 21 bp, Artificial sequence
  SiRNA target sequence
ttatactgctgataacacaaa

SEQ ID NO: 41410 - DNA, 21 bp, Artificial sequence
  SiRNA target sequence
tatactgctgataacacaaac

SEQ ID NO: 41411 - DNA, 21 bp, Artificial sequence
  SiRNA target sequence
atactgctgataacacaaaca

SEQ ID NO: 41412 - DNA, 21 bp, Artificial sequence
  SiRNA target sequence
tactgctgataacacaaacaa

SEQ ID NO: 41413 - DNA, 21 bp, Artificial sequence
  SiRNA target sequence
actgctgataacacaaacaac

SEQ ID NO: 41414 - DNA, 21 bp, Artificial sequence
  SiRNA target sequence
ctgctgataacacaaacaacg

SEQ ID NO: 41415 - DNA, 21 bp, Artificial sequence
  SiRNA target sequence
tgctgataacacaaacaacga

SEQ ID NO: 41416 - DNA, 21 bp, Artificial sequence
  SiRNA target sequence
gctgataacacaaacaacgat

SEQ ID NO: 41417 - DNA, 21 bp, Artificial sequence
  SiRNA target sequence
ctgataacacaaacaacgatg

SEQ ID NO: 41418 - DNA, 21 bp, Artificial sequence
  SiRNA target sequence
tgataacacaaacaacgatgg

SEQ ID NO: 41419 - DNA, 21 bp, Artificial sequence
  SiRNA target sequence
gataacacaaacaacgatgga

SEQ ID NO: 41420 - DNA, 21 bp, Artificial sequence
  SiRNA target sequence
ataacacaaacaacgatggac

SEQ ID NO: 41421 - DNA, 21 bp, Artificial sequence
  SiRNA target sequence
taacacaaacaacgatggacc

SEQ ID NO: 41422 - DNA, 21 bp, Artificial sequence
  SiRNA target sequence
aacacaaacaacgatggacct

SEQ ID NO: 41423 - DNA, 21 bp, Artificial sequence
  SiRNA target sequence
acacaaacaacgatggacctt

SEQ ID NO: 41424 - DNA, 21 bp, Artificial sequence
  SiRNA target sequence
cacaaacaacgatggaccttc

SEQ ID NO: 41425 - DNA, 21 bp, Artificial sequence
  SiRNA target sequence
acaaacaacgatggaccttca

SEQ ID NO: 41426 - DNA, 21 bp, Artificial sequence
  SiRNA target sequence
caaacaacgatggaccttcac

SEQ ID NO: 41427 - DNA, 21 bp, Artificial sequence
  SiRNA target sequence
aaacaacgatggaccttcaca

SEQ ID NO: 41428 - DNA, 21 bp, Artificial sequence
  SiRNA target sequence
aacaacgatggaccttcacat

SEQ ID NO: 41429 - DNA, 21 bp, Artificial sequence
  SiRNA target sequence
acaacgatggaccttcacata

SEQ ID NO: 41430 - DNA, 21 bp, Artificial sequence
  SiRNA target sequence
caacgatggaccttcacatat

SEQ ID NO: 41431 - DNA, 21 bp, Artificial sequence
  SiRNA target sequence
aacgatggaccttcacatata

SEQ ID NO: 41432 - DNA, 21 bp, Artificial sequence
  SiRNA target sequence
acgatggaccttcacatataa

SEQ ID NO: 41433 - DNA, 21 bp, Artificial sequence
  SiRNA target sequence
cgatggaccttcacatataac

SEQ ID NO: 41434 - DNA, 21 bp, Artificial sequence
  SiRNA target sequence
gatggaccttcacatataaca

SEQ ID NO: 41435 - DNA, 21 bp, Artificial sequence
  SiRNA target sequence
atggaccttcacatataacat

SEQ ID NO: 41436 - DNA, 21 bp, Artificial sequence
  SiRNA target sequence
tggaccttcacatataacata

SEQ ID NO: 41437 - DNA, 21 bp, Artificial sequence
  SiRNA target sequence
ggaccttcacatataacatat

SEQ ID NO: 41438 - DNA, 21 bp, Artificial sequence
  SiRNA target sequence
gaccttcacatataacatatc

SEQ ID NO: 41439 - DNA, 21 bp, Artificial sequence
  SiRNA target sequence
accttcacatataacatatcc

SEQ ID NO: 41440 - DNA, 21 bp, Artificial sequence
  SiRNA target sequence
ccttcacatataacatatcca

SEQ ID NO: 41441 - DNA, 21 bp, Artificial sequence
  SiRNA target sequence
cttcacatataacatatccag

SEQ ID NO: 41442 - DNA, 21 bp, Artificial sequence
  SiRNA target sequence
ttcacatataacatatccagt

SEQ ID NO: 41443 - DNA, 21 bp, Artificial sequence
  SiRNA target sequence
tcacatataacatatccagtt

SEQ ID NO: 41444 - DNA, 21 bp, Artificial sequence
  SiRNA target sequence
cacatataacatatccagttc

SEQ ID NO: 41445 - DNA, 21 bp, Artificial sequence
  SiRNA target sequence
acatataacatatccagttct

SEQ ID NO: 41446 - DNA, 21 bp, Artificial sequence
  SiRNA target sequence
catataacatatccagttctt

SEQ ID NO: 41447 - DNA, 21 bp, Artificial sequence
  SiRNA target sequence
atataacatatccagttctta

SEQ ID NO: 41448 - DNA, 21 bp, Artificial sequence
  SiRNA target sequence
tataacatatccagttcttaa

SEQ ID NO: 41449 - DNA, 21 bp, Artificial sequence
  SiRNA target sequence
ataacatatccagttcttaat

SEQ ID NO: 41450 - DNA, 21 bp, Artificial sequence
  SiRNA target sequence
taacatatccagttcttaatc

SEQ ID NO: 41451 - DNA, 21 bp, Artificial sequence
  SiRNA target sequence
aacatatccagttcttaatcc

SEQ ID NO: 41452 - DNA, 21 bp, Artificial sequence
  SiRNA target sequence
acatatccagttcttaatcca

SEQ ID NO: 41453 - DNA, 21 bp, Artificial sequence
  SiRNA target sequence
catatccagttcttaatccag

SEQ ID NO: 41454 - DNA, 21 bp, Artificial sequence
  SiRNA target sequence
atatccagttcttaatccagt

SEQ ID NO: 41455 - DNA, 21 bp, Artificial sequence
  SiRNA target sequence
tatccagttcttaatccagtt

SEQ ID NO: 41456 - DNA, 21 bp, Artificial sequence
  SiRNA target sequence
atccagttcttaatccagttc

SEQ ID NO: 41457 - DNA, 21 bp, Artificial sequence
  SiRNA target sequence
tccagttcttaatccagttca

SEQ ID NO: 41458 - DNA, 21 bp, Artificial sequence
  SiRNA target sequence
ccagttcttaatccagttcat

SEQ ID NO: 41459 - DNA, 21 bp, Artificial sequence
  SiRNA target sequence
cagttcttaatccagttcatg

SEQ ID NO: 41460 - DNA, 21 bp, Artificial sequence
  SiRNA target sequence
agttcttaatccagttcatga

SEQ ID NO: 41461 - DNA, 21 bp, Artificial sequence
  SiRNA target sequence
gttcttaatccagttcatgaa

SEQ ID NO: 41462 - DNA, 21 bp, Artificial sequence
  SiRNA target sequence
ttcttaatccagttcatgaag

SEQ ID NO: 41463 - DNA, 21 bp, Artificial sequence
  SiRNA target sequence
tcttaatccagttcatgaagt

SEQ ID NO: 41464 - DNA, 21 bp, Artificial sequence
  SiRNA target sequence
cttaatccagttcatgaagta

SEQ ID NO: 41465 - DNA, 21 bp, Artificial sequence
  SiRNA target sequence
ttaatccagttcatgaagtag

SEQ ID NO: 41466 - DNA, 21 bp, Artificial sequence
  SiRNA target sequence
taatccagttcatgaagtaga

SEQ ID NO: 41467 - DNA, 21 bp, Artificial sequence
  SiRNA target sequence
aatccagttcatgaagtagaa

SEQ ID NO: 41468 - DNA, 21 bp, Artificial sequence
  SiRNA target sequence
atccagttcatgaagtagaag

SEQ ID NO: 41469 - DNA, 21 bp, Artificial sequence
  SiRNA target sequence
tccagttcatgaagtagaagt

SEQ ID NO: 41470 - DNA, 21 bp, Artificial sequence
  SiRNA target sequence
ccagttcatgaagtagaagta

SEQ ID NO: 41471 - DNA, 21 bp, Artificial sequence
  SiRNA target sequence
cagttcatgaagtagaagtac

SEQ ID NO: 41472 - DNA, 21 bp, Artificial sequence
  SiRNA target sequence
agttcatgaagtagaagtacc

SEQ ID NO: 41473 - DNA, 21 bp, Artificial sequence
  SiRNA target sequence
gttcatgaagtagaagtacca

SEQ ID NO: 41474 - DNA, 21 bp, Artificial sequence
  SiRNA target sequence
ttcatgaagtagaagtaccat

SEQ ID NO: 41475 - DNA, 21 bp, Artificial sequence
  SiRNA target sequence
tcatgaagtagaagtaccata

SEQ ID NO: 41476 - DNA, 21 bp, Artificial sequence
  SiRNA target sequence
catgaagtagaagtaccatac

SEQ ID NO: 41477 - DNA, 21 bp, Artificial sequence
  SiRNA target sequence
atgaagtagaagtaccatact

SEQ ID NO: 41478 - DNA, 21 bp, Artificial sequence
  SiRNA target sequence
tgaagtagaagtaccatacta

SEQ ID NO: 41479 - DNA, 21 bp, Artificial sequence
  SiRNA target sequence
gaagtagaagtaccatactat

SEQ ID NO: 41480 - DNA, 21 bp, Artificial sequence
  SiRNA target sequence
aagtagaagtaccatactatt

SEQ ID NO: 41481 - DNA, 21 bp, Artificial sequence
  SiRNA target sequence
agtagaagtaccatactattg

SEQ ID NO: 41482 - DNA, 21 bp, Artificial sequence
  SiRNA target sequence
gtagaagtaccatactattgt

SEQ ID NO: 41483 - DNA, 21 bp, Artificial sequence
  SiRNA target sequence
tagaagtaccatactattgtc

SEQ ID NO: 41484 - DNA, 21 bp, Artificial sequence
  SiRNA target sequence
agaagtaccatactattgtca

SEQ ID NO: 41485 - DNA, 21 bp, Artificial sequence
  SiRNA target sequence
gaagtaccatactattgtcaa

SEQ ID NO: 41486 - DNA, 21 bp, Artificial sequence
  SiRNA target sequence
aagtaccatactattgtcaat

SEQ ID NO: 41487 - DNA, 21 bp, Artificial sequence
  SiRNA target sequence
agtaccatactattgtcaata

SEQ ID NO: 41488 - DNA, 21 bp, Artificial sequence
  SiRNA target sequence
gtaccatactattgtcaatat

SEQ ID NO: 41489 - DNA, 21 bp, Artificial sequence
  SiRNA target sequence
taccatactattgtcaatata

SEQ ID NO: 41490 - DNA, 21 bp, Artificial sequence
  SiRNA target sequence
accatactattgtcaatatag

SEQ ID NO: 41491 - DNA, 21 bp, Artificial sequence
  SiRNA target sequence
ccatactattgtcaatatagg

SEQ ID NO: 41492 - DNA, 21 bp, Artificial sequence
  SiRNA target sequence
catactattgtcaatatagga

SEQ ID NO: 41493 - DNA, 21 bp, Artificial sequence
  SiRNA target sequence
atactattgtcaatataggaa

SEQ ID NO: 41494 - DNA, 21 bp, Artificial sequence
  SiRNA target sequence
tactattgtcaatataggaaa

SEQ ID NO: 41495 - DNA, 21 bp, Artificial sequence
  SiRNA target sequence
actattgtcaatataggaaat

SEQ ID NO: 41496 - DNA, 21 bp, Artificial sequence
  SiRNA target sequence
ctattgtcaatataggaaatt

SEQ ID NO: 41497 - DNA, 21 bp, Artificial sequence
  SiRNA target sequence
tattgtcaatataggaaatta

SEQ ID NO: 41498 - DNA, 21 bp, Artificial sequence
  SiRNA target sequence
attgtcaatataggaaattac

SEQ ID NO: 41499 - DNA, 21 bp, Artificial sequence
  SiRNA target sequence
ttgtcaatataggaaattacc

SEQ ID NO: 41500 - DNA, 21 bp, Artificial sequence
  SiRNA target sequence
tgtcaatataggaaattacca

SEQ ID NO: 41501 - DNA, 21 bp, Artificial sequence
  SiRNA target sequence
gtcaatataggaaattaccag

SEQ ID NO: 41502 - DNA, 21 bp, Artificial sequence
  SiRNA target sequence
tcaatataggaaattaccagt

SEQ ID NO: 41503 - DNA, 21 bp, Artificial sequence
  SiRNA target sequence
caatataggaaattaccagta

SEQ ID NO: 41504 - DNA, 21 bp, Artificial sequence
  SiRNA target sequence
aatataggaaattaccagtag

SEQ ID NO: 41505 - DNA, 21 bp, Artificial sequence
  SiRNA target sequence
atataggaaattaccagtagc

SEQ ID NO: 41506 - DNA, 21 bp, Artificial sequence
  SiRNA target sequence
tataggaaattaccagtagca

SEQ ID NO: 41507 - DNA, 21 bp, Artificial sequence
  SiRNA target sequence
ataggaaattaccagtagcat

SEQ ID NO: 41508 - DNA, 21 bp, Artificial sequence
  SiRNA target sequence
taggaaattaccagtagcatc

SEQ ID NO: 41509 - DNA, 21 bp, Artificial sequence
  SiRNA target sequence
aggaaattaccagtagcatct

SEQ ID NO: 41510 - DNA, 21 bp, Artificial sequence
  SiRNA target sequence
ggaaattaccagtagcatcta

SEQ ID NO: 41511 - DNA, 21 bp, Artificial sequence
  SiRNA target sequence
gaaattaccagtagcatctac

SEQ ID NO: 41512 - DNA, 21 bp, Artificial sequence
  SiRNA target sequence
aaattaccagtagcatctaca

SEQ ID NO: 41513 - DNA, 21 bp, Artificial sequence
  SiRNA target sequence
aattaccagtagcatctacaa

SEQ ID NO: 41514 - DNA, 21 bp, Artificial sequence
  SiRNA target sequence
attaccagtagcatctacaac

SEQ ID NO: 41515 - DNA, 21 bp, Artificial sequence
  SiRNA target sequence
ttaccagtagcatctacaacc

SEQ ID NO: 41516 - DNA, 21 bp, Artificial sequence
  SiRNA target sequence
taccagtagcatctacaaccg

SEQ ID NO: 41517 - DNA, 21 bp, Artificial sequence
  SiRNA target sequence
accagtagcatctacaaccga

SEQ ID NO: 41518 - DNA, 21 bp, Artificial sequence
  SiRNA target sequence
ccagtagcatctacaaccgac

SEQ ID NO: 41519 - DNA, 21 bp, Artificial sequence
  SiRNA target sequence
cagtagcatctacaaccgaca

SEQ ID NO: 41520 - DNA, 21 bp, Artificial sequence
  SiRNA target sequence
agtagcatctacaaccgacaa

SEQ ID NO: 41521 - DNA, 21 bp, Artificial sequence
  SiRNA target sequence
gtagcatctacaaccgacaaa

SEQ ID NO: 41522 - DNA, 21 bp, Artificial sequence
  SiRNA target sequence
tagcatctacaaccgacaaag

SEQ ID NO: 41523 - DNA, 21 bp, Artificial sequence
  SiRNA target sequence
agcatctacaaccgacaaagg

SEQ ID NO: 41524 - DNA, 21 bp, Artificial sequence
  SiRNA target sequence
gcatctacaaccgacaaaggg

SEQ ID NO: 41525 - DNA, 21 bp, Artificial sequence
  SiRNA target sequence
catctacaaccgacaaagggt

SEQ ID NO: 41526 - DNA, 21 bp, Artificial sequence
  SiRNA target sequence
atctacaaccgacaaagggta

SEQ ID NO: 41527 - DNA, 21 bp, Artificial sequence
  SiRNA target sequence
tctacaaccgacaaagggtat

SEQ ID NO: 41528 - DNA, 21 bp, Artificial sequence
  SiRNA target sequence
ctacaaccgacaaagggtatg

SEQ ID NO: 41529 - DNA, 21 bp, Artificial sequence
  SiRNA target sequence
tacaaccgacaaagggtatga

SEQ ID NO: 41530 - DNA, 21 bp, Artificial sequence
  SiRNA target sequence
acaaccgacaaagggtatgat

SEQ ID NO: 41531 - DNA, 21 bp, Artificial sequence
  SiRNA target sequence
caaccgacaaagggtatgatg

SEQ ID NO: 41532 - DNA, 21 bp, Artificial sequence
  SiRNA target sequence
aaccgacaaagggtatgatgc

SEQ ID NO: 41533 - DNA, 21 bp, Artificial sequence
  SiRNA target sequence
accgacaaagggtatgatgca

SEQ ID NO: 41534 - DNA, 21 bp, Artificial sequence
  SiRNA target sequence
ccgacaaagggtatgatgcat

SEQ ID NO: 41535 - DNA, 21 bp, Artificial sequence
  SiRNA target sequence
cgacaaagggtatgatgcatc

SEQ ID NO: 41536 - DNA, 21 bp, Artificial sequence
  SiRNA target sequence
gacaaagggtatgatgcatct

SEQ ID NO: 41537 - DNA, 21 bp, Artificial sequence
  SiRNA target sequence
acaaagggtatgatgcatctt

SEQ ID NO: 41538 - DNA, 21 bp, Artificial sequence
  SiRNA target sequence
caaagggtatgatgcatcttt

SEQ ID NO: 41539 - DNA, 21 bp, Artificial sequence
  SiRNA target sequence
aaagggtatgatgcatctttg

SEQ ID NO: 41540 - DNA, 21 bp, Artificial sequence
  SiRNA target sequence
aagggtatgatgcatctttga

SEQ ID NO: 41541 - DNA, 21 bp, Artificial sequence
  SiRNA target sequence
agggtatgatgcatctttgat

SEQ ID NO: 41542 - DNA, 21 bp, Artificial sequence
  SiRNA target sequence
gggtatgatgcatctttgatg

SEQ ID NO: 41543 - DNA, 21 bp, Artificial sequence
  SiRNA target sequence
ggtatgatgcatctttgatgt

SEQ ID NO: 41544 - DNA, 21 bp, Artificial sequence
  SiRNA target sequence
gtatgatgcatctttgatgta

SEQ ID NO: 41545 - DNA, 21 bp, Artificial sequence
  SiRNA target sequence
tatgatgcatctttgatgtat

SEQ ID NO: 41546 - DNA, 21 bp, Artificial sequence
  SiRNA target sequence
atgatgcatctttgatgtatt

SEQ ID NO: 41547 - DNA, 21 bp, Artificial sequence
  SiRNA target sequence
tgatgcatctttgatgtatta

SEQ ID NO: 41548 - DNA, 21 bp, Artificial sequence
  SiRNA target sequence
gatgcatctttgatgtattat

SEQ ID NO: 41549 - DNA, 21 bp, Artificial sequence
  SiRNA target sequence
atgcatctttgatgtattatt

SEQ ID NO: 41550 - DNA, 21 bp, Artificial sequence
  SiRNA target sequence
tgcatctttgatgtattattc

SEQ ID NO: 41551 - DNA, 21 bp, Artificial sequence
  SiRNA target sequence
gcatctttgatgtattattct

SEQ ID NO: 41552 - DNA, 21 bp, Artificial sequence
  SiRNA target sequence
catctttgatgtattattcta

SEQ ID NO: 41553 - DNA, 21 bp, Artificial sequence
  SiRNA target sequence
atctttgatgtattattctaa

SEQ ID NO: 41554 - DNA, 21 bp, Artificial sequence
  SiRNA target sequence
tctttgatgtattattctaat

SEQ ID NO: 41555 - DNA, 21 bp, Artificial sequence
  SiRNA target sequence
ctttgatgtattattctaatg

SEQ ID NO: 41556 - DNA, 21 bp, Artificial sequence
  SiRNA target sequence
tttgatgtattattctaatgt

SEQ ID NO: 41557 - DNA, 21 bp, Artificial sequence
  SiRNA target sequence
ttgatgtattattctaatgtt

SEQ ID NO: 41558 - DNA, 21 bp, Artificial sequence
  SiRNA target sequence
tgatgtattattctaatgttg

SEQ ID NO: 41559 - DNA, 21 bp, Artificial sequence
  SiRNA target sequence
gatgtattattctaatgttgg

SEQ ID NO: 41560 - DNA, 21 bp, Artificial sequence
  SiRNA target sequence
atgtattattctaatgttggt

SEQ ID NO: 41561 - DNA, 21 bp, Artificial sequence
  SiRNA target sequence
tgtattattctaatgttggta

SEQ ID NO: 41562 - DNA, 21 bp, Artificial sequence
  SiRNA target sequence
gtattattctaatgttggtac

SEQ ID NO: 41563 - DNA, 21 bp, Artificial sequence
  SiRNA target sequence
tattattctaatgttggtacc

SEQ ID NO: 41564 - DNA, 21 bp, Artificial sequence
  SiRNA target sequence
attattctaatgttggtacca

SEQ ID NO: 41565 - DNA, 21 bp, Artificial sequence
  SiRNA target sequence
ttattctaatgttggtaccaa

SEQ ID NO: 41566 - DNA, 21 bp, Artificial sequence
  SiRNA target sequence
tattctaatgttggtaccaat

SEQ ID NO: 41567 - DNA, 21 bp, Artificial sequence
  SiRNA target sequence
attctaatgttggtaccaatc

SEQ ID NO: 41568 - DNA, 21 bp, Artificial sequence
  SiRNA target sequence
ttctaatgttggtaccaatca

SEQ ID NO: 41569 - DNA, 21 bp, Artificial sequence
  SiRNA target sequence
tctaatgttggtaccaatcaa

SEQ ID NO: 41570 - DNA, 21 bp, Artificial sequence
  SiRNA target sequence
ctaatgttggtaccaatcaaa

SEQ ID NO: 41571 - DNA, 21 bp, Artificial sequence
  SiRNA target sequence
taatgttggtaccaatcaaat

SEQ ID NO: 41572 - DNA, 21 bp, Artificial sequence
  SiRNA target sequence
aatgttggtaccaatcaaatt

SEQ ID NO: 41573 - DNA, 21 bp, Artificial sequence
  SiRNA target sequence
atgttggtaccaatcaaattg

SEQ ID NO: 41574 - DNA, 21 bp, Artificial sequence
  SiRNA target sequence
tgttggtaccaatcaaattgt

SEQ ID NO: 41575 - DNA, 21 bp, Artificial sequence
  SiRNA target sequence
gttggtaccaatcaaattgtt

SEQ ID NO: 41576 - DNA, 21 bp, Artificial sequence
  SiRNA target sequence
ttggtaccaatcaaattgttg

SEQ ID NO: 41577 - DNA, 21 bp, Artificial sequence
  SiRNA target sequence
tggtaccaatcaaattgttgc

SEQ ID NO: 41578 - DNA, 21 bp, Artificial sequence
  SiRNA target sequence
ggtaccaatcaaattgttgct

SEQ ID NO: 41579 - DNA, 21 bp, Artificial sequence
  SiRNA target sequence
gtaccaatcaaattgttgctc

SEQ ID NO: 41580 - DNA, 21 bp, Artificial sequence
  SiRNA target sequence
taccaatcaaattgttgctcg

SEQ ID NO: 41581 - DNA, 21 bp, Artificial sequence
  SiRNA target sequence
accaatcaaattgttgctcga

SEQ ID NO: 41582 - DNA, 21 bp, Artificial sequence
  SiRNA target sequence
ccaatcaaattgttgctcgag

SEQ ID NO: 41583 - DNA, 21 bp, Artificial sequence
  SiRNA target sequence
caatcaaattgttgctcgagc

SEQ ID NO: 41584 - DNA, 21 bp, Artificial sequence
  SiRNA target sequence
aatcaaattgttgctcgagct

SEQ ID NO: 41585 - DNA, 21 bp, Artificial sequence
  SiRNA target sequence
atcaaattgttgctcgagctg

SEQ ID NO: 41586 - DNA, 21 bp, Artificial sequence
  SiRNA target sequence
tcaaattgttgctcgagctgg

SEQ ID NO: 41587 - DNA, 21 bp, Artificial sequence
  SiRNA target sequence
caaattgttgctcgagctggt

SEQ ID NO: 41588 - DNA, 21 bp, Artificial sequence
  SiRNA target sequence
aaattgttgctcgagctggta

SEQ ID NO: 41589 - DNA, 21 bp, Artificial sequence
  SiRNA target sequence
aattgttgctcgagctggtaa

SEQ ID NO: 41590 - DNA, 21 bp, Artificial sequence
  SiRNA target sequence
attgttgctcgagctggtaat

SEQ ID NO: 41591 - DNA, 21 bp, Artificial sequence
  SiRNA target sequence
ttgttgctcgagctggtaatg

SEQ ID NO: 41592 - DNA, 21 bp, Artificial sequence
  SiRNA target sequence
tgttgctcgagctggtaatga

SEQ ID NO: 41593 - DNA, 21 bp, Artificial sequence
  SiRNA target sequence
gttgctcgagctggtaatgat

SEQ ID NO: 41594 - DNA, 21 bp, Artificial sequence
  SiRNA target sequence
ttgctcgagctggtaatgatg

SEQ ID NO: 41595 - DNA, 21 bp, Artificial sequence
  SiRNA target sequence
tgctcgagctggtaatgatga

SEQ ID NO: 41596 - DNA, 21 bp, Artificial sequence
  SiRNA target sequence
gctcgagctggtaatgatgat

SEQ ID NO: 41597 - DNA, 21 bp, Artificial sequence
  SiRNA target sequence
ctcgagctggtaatgatgatt

SEQ ID NO: 41598 - DNA, 21 bp, Artificial sequence
  SiRNA target sequence
tcgagctggtaatgatgattt

SEQ ID NO: 41599 - DNA, 21 bp, Artificial sequence
  SiRNA target sequence
cgagctggtaatgatgatttc

SEQ ID NO: 41600 - DNA, 21 bp, Artificial sequence
  SiRNA target sequence
gagctggtaatgatgatttca

SEQ ID NO: 41601 - DNA, 21 bp, Artificial sequence
  SiRNA target sequence
agctggtaatgatgatttcac

SEQ ID NO: 41602 - DNA, 21 bp, Artificial sequence
  SiRNA target sequence
gctggtaatgatgatttcact

SEQ ID NO: 41603 - DNA, 21 bp, Artificial sequence
  SiRNA target sequence
ctggtaatgatgatttcactt

SEQ ID NO: 41604 - DNA, 21 bp, Artificial sequence
  SiRNA target sequence
tggtaatgatgatttcacttt

SEQ ID NO: 41605 - DNA, 21 bp, Artificial sequence
  SiRNA target sequence
ggtaatgatgatttcactttt

SEQ ID NO: 41606 - DNA, 21 bp, Artificial sequence
  SiRNA target sequence
gtaatgatgatttcacttttg

SEQ ID NO: 41607 - DNA, 21 bp, Artificial sequence
  SiRNA target sequence
taatgatgatttcacttttgg

SEQ ID NO: 41608 - DNA, 21 bp, Artificial sequence
  SiRNA target sequence
aatgatgatttcacttttgga

SEQ ID NO: 41609 - DNA, 21 bp, Artificial sequence
  SiRNA target sequence
atgatgatttcacttttggat

SEQ ID NO: 41610 - DNA, 21 bp, Artificial sequence
  SiRNA target sequence
tgatgatttcacttttggatg

SEQ ID NO: 41611 - DNA, 21 bp, Artificial sequence
  SiRNA target sequence
gatgatttcacttttggatgg

SEQ ID NO: 41612 - DNA, 21 bp, Artificial sequence
  SiRNA target sequence
atgatttcacttttggatggc

SEQ ID NO: 41613 - DNA, 21 bp, Artificial sequence
  SiRNA target sequence
tgatttcacttttggatggct

SEQ ID NO: 41614 - DNA, 21 bp, Artificial sequence
  SiRNA target sequence
gatttcacttttggatggctc

SEQ ID NO: 41615 - DNA, 21 bp, Artificial sequence
  SiRNA target sequence
atttcacttttggatggctca

SEQ ID NO: 41616 - DNA, 21 bp, Artificial sequence
  SiRNA target sequence
tttcacttttggatggctcat

SEQ ID NO: 41617 - DNA, 21 bp, Artificial sequence
  SiRNA target sequence
ttcacttttggatggctcata

SEQ ID NO: 41618 - DNA, 21 bp, Artificial sequence
  SiRNA target sequence
tcacttttggatggctcatag

SEQ ID NO: 41619 - DNA, 21 bp, Artificial sequence
  SiRNA target sequence
cacttttggatggctcatagg

SEQ ID NO: 41620 - DNA, 21 bp, Artificial sequence
  SiRNA target sequence
acttttggatggctcatagga

SEQ ID NO: 41621 - DNA, 21 bp, Artificial sequence
  SiRNA target sequence
cttttggatggctcataggaa

SEQ ID NO: 41622 - DNA, 21 bp, Artificial sequence
  SiRNA target sequence
ttttggatggctcataggaac

SEQ ID NO: 41623 - DNA, 21 bp, Artificial sequence
  SiRNA target sequence
tttggatggctcataggaaca

SEQ ID NO: 41624 - DNA, 21 bp, Artificial sequence
  SiRNA target sequence
ttggatggctcataggaacac

SEQ ID NO: 41625 - DNA, 21 bp, Artificial sequence
  SiRNA target sequence
tggatggctcataggaacacc

SEQ ID NO: 41626 - DNA, 21 bp, Artificial sequence
  SiRNA target sequence
ggatggctcataggaacaccg

SEQ ID NO: 41627 - DNA, 21 bp, Artificial sequence
  SiRNA target sequence
gatggctcataggaacaccgc

SEQ ID NO: 41628 - DNA, 21 bp, Artificial sequence
  SiRNA target sequence
atggctcataggaacaccgca

SEQ ID NO: 41629 - DNA, 21 bp, Artificial sequence
  SiRNA target sequence
tggctcataggaacaccgcaa

SEQ ID NO: 41630 - DNA, 21 bp, Artificial sequence
  SiRNA target sequence
ggctcataggaacaccgcaaa

SEQ ID NO: 41631 - DNA, 21 bp, Artificial sequence
  SiRNA target sequence
gctcataggaacaccgcaaac

SEQ ID NO: 41632 - DNA, 21 bp, Artificial sequence
  SiRNA target sequence
ctcataggaacaccgcaaact

SEQ ID NO: 41633 - DNA, 21 bp, Artificial sequence
  SiRNA target sequence
tcataggaacaccgcaaactc

SEQ ID NO: 41634 - DNA, 21 bp, Artificial sequence
  SiRNA target sequence
cataggaacaccgcaaactca

SEQ ID NO: 41635 - DNA, 21 bp, Artificial sequence
  SiRNA target sequence
ataggaacaccgcaaactcaa

SEQ ID NO: 41636 - DNA, 21 bp, Artificial sequence
  SiRNA target sequence
taggaacaccgcaaactcaag

SEQ ID NO: 41637 - DNA, 21 bp, Artificial sequence
  SiRNA target sequence
aggaacaccgcaaactcaagg

SEQ ID NO: 41638 - DNA, 21 bp, Artificial sequence
  SiRNA target sequence
ggaacaccgcaaactcaagga

SEQ ID NO: 41639 - DNA, 21 bp, Artificial sequence
  SiRNA target sequence
gaacaccgcaaactcaaggaa

SEQ ID NO: 41640 - DNA, 21 bp, Artificial sequence
  SiRNA target sequence
aacaccgcaaactcaaggaat

SEQ ID NO: 41641 - DNA, 21 bp, Artificial sequence
  SiRNA target sequence
acaccgcaaactcaaggaata

SEQ ID NO: 41642 - DNA, 21 bp, Artificial sequence
  SiRNA target sequence
caccgcaaactcaaggaataa

SEQ ID NO: 41643 - DNA, 21 bp, Artificial sequence
  SiRNA target sequence
accgcaaactcaaggaataac

SEQ ID NO: 41644 - DNA, 21 bp, Artificial sequence
  SiRNA target sequence
ccgcaaactcaaggaataacg

SEQ ID NO: 41645 - DNA, 21 bp, Artificial sequence
  SiRNA target sequence
cgcaaactcaaggaataacga

SEQ ID NO: 41646 - DNA, 21 bp, Artificial sequence
  SiRNA target sequence
gcaaactcaaggaataacgag

SEQ ID NO: 41647 - DNA, 21 bp, Artificial sequence
  SiRNA target sequence
caaactcaaggaataacgaga

SEQ ID NO: 41648 - DNA, 21 bp, Artificial sequence
  SiRNA target sequence
aaactcaaggaataacgagaa

SEQ ID NO: 41649 - DNA, 21 bp, Artificial sequence
  SiRNA target sequence
aactcaaggaataacgagaac

SEQ ID NO: 41650 - DNA, 21 bp, Artificial sequence
  SiRNA target sequence
actcaaggaataacgagaacg

SEQ ID NO: 41651 - DNA, 21 bp, Artificial sequence
  SiRNA target sequence
ctcaaggaataacgagaacgg

SEQ ID NO: 41652 - DNA, 21 bp, Artificial sequence
  SiRNA target sequence
tcaaggaataacgagaacgga

SEQ ID NO: 41653 - DNA, 21 bp, Artificial sequence
  SiRNA target sequence
caaggaataacgagaacggaa

SEQ ID NO: 41654 - DNA, 21 bp, Artificial sequence
  SiRNA target sequence
aaggaataacgagaacggaaa

SEQ ID NO: 41655 - DNA, 21 bp, Artificial sequence
  SiRNA target sequence
aggaataacgagaacggaaac

SEQ ID NO: 41656 - DNA, 21 bp, Artificial sequence
  SiRNA target sequence
ggaataacgagaacggaaact

SEQ ID NO: 41657 - DNA, 21 bp, Artificial sequence
  SiRNA target sequence
gaataacgagaacggaaacta

SEQ ID NO: 41658 - DNA, 21 bp, Artificial sequence
  SiRNA target sequence
aataacgagaacggaaactaa

SEQ ID NO: 41659 - DNA, 21 bp, Artificial sequence
  SiRNA target sequence
ataacgagaacggaaactaaa

SEQ ID NO: 41660 - DNA, 21 bp, Artificial sequence
  SiRNA target sequence
taacgagaacggaaactaaat

SEQ ID NO: 41661 - DNA, 21 bp, Artificial sequence
  SiRNA target sequence
aacgagaacggaaactaaata

SEQ ID NO: 41662 - DNA, 21 bp, Artificial sequence
  SiRNA target sequence
acgagaacggaaactaaataa

SEQ ID NO: 41663 - DNA, 21 bp, Artificial sequence
  SiRNA target sequence
cgagaacggaaactaaataaa

SEQ ID NO: 41664 - DNA, 21 bp, Artificial sequence
  SiRNA target sequence
gagaacggaaactaaataaat

SEQ ID NO: 41665 - DNA, 21 bp, Artificial sequence
  SiRNA target sequence
agaacggaaactaaataaatg

SEQ ID NO: 41666 - DNA, 21 bp, Artificial sequence
  SiRNA target sequence
gaacggaaactaaataaatga

SEQ ID NO: 41667 - DNA, 21 bp, Artificial sequence
  SiRNA target sequence
aacggaaactaaataaatgaa

SEQ ID NO: 41668 - DNA, 21 bp, Artificial sequence
  SiRNA target sequence
acggaaactaaataaatgaat

SEQ ID NO: 41669 - DNA, 21 bp, Artificial sequence
  SiRNA target sequence
cggaaactaaataaatgaatg

SEQ ID NO: 41670 - DNA, 21 bp, Artificial sequence
  SiRNA target sequence
ggaaactaaataaatgaatga

SEQ ID NO: 41671 - DNA, 21 bp, Artificial sequence
  SiRNA target sequence
gaaactaaataaatgaatgaa

SEQ ID NO: 41672 - DNA, 21 bp, Artificial sequence
  SiRNA target sequence
aaactaaataaatgaatgaag

SEQ ID NO: 41673 - DNA, 21 bp, Artificial sequence
  SiRNA target sequence
aactaaataaatgaatgaaga

SEQ ID NO: 41674 - DNA, 21 bp, Artificial sequence
  SiRNA target sequence
actaaataaatgaatgaagat

SEQ ID NO: 41675 - DNA, 21 bp, Artificial sequence
  SiRNA target sequence
ctaaataaatgaatgaagatg

SEQ ID NO: 41676 - DNA, 21 bp, Artificial sequence
  SiRNA target sequence
taaataaatgaatgaagatgt

SEQ ID NO: 41677 - DNA, 21 bp, Artificial sequence
  SiRNA target sequence
aaataaatgaatgaagatgta

SEQ ID NO: 41678 - DNA, 21 bp, Artificial sequence
  SiRNA target sequence
aataaatgaatgaagatgtac

SEQ ID NO: 41679 - DNA, 21 bp, Artificial sequence
  SiRNA target sequence
ataaatgaatgaagatgtact

SEQ ID NO: 41680 - DNA, 21 bp, Artificial sequence
  SiRNA target sequence
taaatgaatgaagatgtactt

SEQ ID NO: 41681 - DNA, 21 bp, Artificial sequence
  SiRNA target sequence
aaatgaatgaagatgtacttt

SEQ ID NO: 41682 - DNA, 21 bp, Artificial sequence
  SiRNA target sequence
aatgaatgaagatgtacttta

SEQ ID NO: 41683 - DNA, 21 bp, Artificial sequence
  SiRNA target sequence
atgaatgaagatgtactttag

SEQ ID NO: 41684 - DNA, 21 bp, Artificial sequence
  SiRNA target sequence
tgaatgaagatgtactttaga

SEQ ID NO: 41685 - DNA, 21 bp, Artificial sequence
  SiRNA target sequence
gaatgaagatgtactttagag

SEQ ID NO: 41686 - DNA, 21 bp, Artificial sequence
  SiRNA target sequence
aatgaagatgtactttagagg

SEQ ID NO: 41687 - DNA, 21 bp, Artificial sequence
  SiRNA target sequence
atgaagatgtactttagagga

SEQ ID NO: 41688 - DNA, 21 bp, Artificial sequence
  SiRNA target sequence
tgaagatgtactttagaggac

SEQ ID NO: 41689 - DNA, 21 bp, Artificial sequence
  SiRNA target sequence
gaagatgtactttagaggaca

SEQ ID NO: 41690 - DNA, 21 bp, Artificial sequence
  SiRNA target sequence
aagatgtactttagaggacag

SEQ ID NO: 41691 - DNA, 21 bp, Artificial sequence
  SiRNA target sequence
agatgtactttagaggacaga

SEQ ID NO: 41692 - DNA, 21 bp, Artificial sequence
  SiRNA target sequence
gatgtactttagaggacagac

SEQ ID NO: 41693 - DNA, 21 bp, Artificial sequence
  SiRNA target sequence
atgtactttagaggacagaca

SEQ ID NO: 41694 - DNA, 21 bp, Artificial sequence
  SiRNA target sequence
tgtactttagaggacagacat

SEQ ID NO: 41695 - DNA, 21 bp, Artificial sequence
  SiRNA target sequence
gtactttagaggacagacata

SEQ ID NO: 41696 - DNA, 21 bp, Artificial sequence
  SiRNA target sequence
tactttagaggacagacatac

SEQ ID NO: 41697 - DNA, 21 bp, Artificial sequence
  SiRNA target sequence
actttagaggacagacatacc

SEQ ID NO: 41698 - DNA, 21 bp, Artificial sequence
  SiRNA target sequence
ctttagaggacagacataccc

SEQ ID NO: 41699 - DNA, 21 bp, Artificial sequence
  SiRNA target sequence
tttagaggacagacataccct

SEQ ID NO: 41700 - DNA, 21 bp, Artificial sequence
  SiRNA target sequence
ttagaggacagacataccctc

SEQ ID NO: 41701 - DNA, 21 bp, Artificial sequence
  SiRNA target sequence
tagaggacagacataccctct

SEQ ID NO: 41702 - DNA, 21 bp, Artificial sequence
  SiRNA target sequence
agaggacagacataccctctt

SEQ ID NO: 41703 - DNA, 21 bp, Artificial sequence
  SiRNA target sequence
gaggacagacataccctcttt

SEQ ID NO: 41704 - DNA, 21 bp, Artificial sequence
  SiRNA target sequence
aggacagacataccctctttt

SEQ ID NO: 41705 - DNA, 21 bp, Artificial sequence
  SiRNA target sequence
ggacagacataccctcttttg

SEQ ID NO: 41706 - DNA, 21 bp, Artificial sequence
  SiRNA target sequence
gacagacataccctcttttgt

SEQ ID NO: 41707 - DNA, 21 bp, Artificial sequence
  SiRNA target sequence
acagacataccctcttttgta

SEQ ID NO: 41708 - DNA, 21 bp, Artificial sequence
  SiRNA target sequence
cagacataccctcttttgtat

SEQ ID NO: 41709 - DNA, 21 bp, Artificial sequence
  SiRNA target sequence
agacataccctcttttgtatg

SEQ ID NO: 41710 - DNA, 21 bp, Artificial sequence
  SiRNA target sequence
gacataccctcttttgtatgg

SEQ ID NO: 41711 - DNA, 21 bp, Artificial sequence
  SiRNA target sequence
acataccctcttttgtatggc

SEQ ID NO: 41712 - DNA, 21 bp, Artificial sequence
  SiRNA target sequence
cataccctcttttgtatggct

SEQ ID NO: 41713 - DNA, 21 bp, Artificial sequence
  SiRNA target sequence
ataccctcttttgtatggcta

SEQ ID NO: 41714 - DNA, 21 bp, Artificial sequence
  SiRNA target sequence
taccctcttttgtatggctat

SEQ ID NO: 41715 - DNA, 21 bp, Artificial sequence
  SiRNA target sequence
accctcttttgtatggctata

SEQ ID NO: 41716 - DNA, 21 bp, Artificial sequence
  SiRNA target sequence
ccctcttttgtatggctatag

SEQ ID NO: 41717 - DNA, 21 bp, Artificial sequence
  SiRNA target sequence
cctcttttgtatggctatagt

SEQ ID NO: 41718 - DNA, 21 bp, Artificial sequence
  SiRNA target sequence
ctcttttgtatggctatagtc

SEQ ID NO: 41719 - DNA, 21 bp, Artificial sequence
  SiRNA target sequence
tcttttgtatggctatagtct

SEQ ID NO: 41720 - DNA, 21 bp, Artificial sequence
  SiRNA target sequence
cttttgtatggctatagtcta

SEQ ID NO: 41721 - DNA, 21 bp, Artificial sequence
  SiRNA target sequence
ttttgtatggctatagtctaa

SEQ ID NO: 41722 - DNA, 21 bp, Artificial sequence
  SiRNA target sequence
tttgtatggctatagtctaaa

SEQ ID NO: 41723 - DNA, 21 bp, Artificial sequence
  SiRNA target sequence
ttgtatggctatagtctaaat

SEQ ID NO: 41724 - DNA, 21 bp, Artificial sequence
  SiRNA target sequence
tgtatggctatagtctaaatt

SEQ ID NO: 41725 - DNA, 21 bp, Artificial sequence
  SiRNA target sequence
gtatggctatagtctaaattt

SEQ ID NO: 41726 - DNA, 21 bp, Artificial sequence
  SiRNA target sequence
tatggctatagtctaaatttt

SEQ ID NO: 41727 - DNA, 21 bp, Artificial sequence
  SiRNA target sequence
atggctatagtctaaattttt

SEQ ID NO: 41728 - DNA, 21 bp, Artificial sequence
  SiRNA target sequence
tggctatagtctaaatttttc

SEQ ID NO: 41729 - DNA, 21 bp, Artificial sequence
  SiRNA target sequence
ggctatagtctaaatttttca

SEQ ID NO: 41730 - DNA, 21 bp, Artificial sequence
  SiRNA target sequence
gctatagtctaaatttttcag

SEQ ID NO: 41731 - DNA, 21 bp, Artificial sequence
  SiRNA target sequence
ctatagtctaaatttttcaga

SEQ ID NO: 41732 - DNA, 21 bp, Artificial sequence
  SiRNA target sequence
tatagtctaaatttttcagat

SEQ ID NO: 41733 - DNA, 21 bp, Artificial sequence
  SiRNA target sequence
atagtctaaatttttcagata

SEQ ID NO: 41734 - DNA, 21 bp, Artificial sequence
  SiRNA target sequence
tagtctaaatttttcagataa

SEQ ID NO: 41735 - DNA, 21 bp, Artificial sequence
  SiRNA target sequence
agtctaaatttttcagataat

SEQ ID NO: 41736 - DNA, 21 bp, Artificial sequence
  SiRNA target sequence
gtctaaatttttcagataatt

SEQ ID NO: 41737 - DNA, 21 bp, Artificial sequence
  SiRNA target sequence
tctaaatttttcagataattt

SEQ ID NO: 41738 - DNA, 21 bp, Artificial sequence
  SiRNA target sequence
ctaaatttttcagataatttc

SEQ ID NO: 41739 - DNA, 21 bp, Artificial sequence
  SiRNA target sequence
taaatttttcagataatttca

SEQ ID NO: 41740 - DNA, 21 bp, Artificial sequence
  SiRNA target sequence
aaatttttcagataatttcaa

SEQ ID NO: 41741 - DNA, 21 bp, Artificial sequence
  SiRNA target sequence
aatttttcagataatttcaat

SEQ ID NO: 41742 - DNA, 21 bp, Artificial sequence
  SiRNA target sequence
atttttcagataatttcaatt

SEQ ID NO: 41743 - DNA, 21 bp, Artificial sequence
  SiRNA target sequence
tttttcagataatttcaattt

SEQ ID NO: 41744 - DNA, 21 bp, Artificial sequence
  SiRNA target sequence
ttttcagataatttcaatttg

SEQ ID NO: 41745 - DNA, 21 bp, Artificial sequence
  SiRNA target sequence
tttcagataatttcaatttgg

SEQ ID NO: 41746 - DNA, 21 bp, Artificial sequence
  SiRNA target sequence
ttcagataatttcaatttgga

SEQ ID NO: 41747 - DNA, 21 bp, Artificial sequence
  SiRNA target sequence
tcagataatttcaatttggac

SEQ ID NO: 41748 - DNA, 21 bp, Artificial sequence
  SiRNA target sequence
cagataatttcaatttggacc

SEQ ID NO: 41749 - DNA, 21 bp, Artificial sequence
  SiRNA target sequence
agataatttcaatttggaccg

SEQ ID NO: 41750 - DNA, 21 bp, Artificial sequence
  SiRNA target sequence
gataatttcaatttggaccga

SEQ ID NO: 41751 - DNA, 21 bp, Artificial sequence
  SiRNA target sequence
ataatttcaatttggaccgaa

SEQ ID NO: 41752 - DNA, 21 bp, Artificial sequence
  SiRNA target sequence
taatttcaatttggaccgaaa

SEQ ID NO: 41753 - DNA, 21 bp, Artificial sequence
  SiRNA target sequence
aatttcaatttggaccgaaaa

SEQ ID NO: 41754 - DNA, 21 bp, Artificial sequence
  SiRNA target sequence
atttcaatttggaccgaaaaa

SEQ ID NO: 41755 - DNA, 21 bp, Artificial sequence
  SiRNA target sequence
tttcaatttggaccgaaaaac

SEQ ID NO: 41756 - DNA, 21 bp, Artificial sequence
  SiRNA target sequence
ttcaatttggaccgaaaaacc

SEQ ID NO: 41757 - DNA, 21 bp, Artificial sequence
  SiRNA target sequence
tcaatttggaccgaaaaaccg

SEQ ID NO: 41758 - DNA, 21 bp, Artificial sequence
  SiRNA target sequence
caatttggaccgaaaaaccga

SEQ ID NO: 41759 - DNA, 21 bp, Artificial sequence
  SiRNA target sequence
aatttggaccgaaaaaccgag

SEQ ID NO: 41760 - DNA, 21 bp, Artificial sequence
  SiRNA target sequence
atttggaccgaaaaaccgagc

SEQ ID NO: 41761 - DNA, 21 bp, Artificial sequence
  SiRNA target sequence
tttggaccgaaaaaccgagca

SEQ ID NO: 41762 - DNA, 21 bp, Artificial sequence
  SiRNA target sequence
ttggaccgaaaaaccgagcaa

SEQ ID NO: 41763 - DNA, 21 bp, Artificial sequence
  SiRNA target sequence
tggaccgaaaaaccgagcaat

SEQ ID NO: 41764 - DNA, 21 bp, Artificial sequence
  SiRNA target sequence
ggaccgaaaaaccgagcaata

SEQ ID NO: 41765 - DNA, 21 bp, Artificial sequence
  SiRNA target sequence
gaccgaaaaaccgagcaatag

SEQ ID NO: 41766 - DNA, 21 bp, Artificial sequence
  SiRNA target sequence
accgaaaaaccgagcaatagg

SEQ ID NO: 41767 - DNA, 21 bp, Artificial sequence
  SiRNA target sequence
ccgaaaaaccgagcaatagga

SEQ ID NO: 41768 - DNA, 21 bp, Artificial sequence
  SiRNA target sequence
cgaaaaaccgagcaataggag

SEQ ID NO: 41769 - DNA, 21 bp, Artificial sequence
  SiRNA target sequence
gaaaaaccgagcaataggagc

SEQ ID NO: 41770 - DNA, 21 bp, Artificial sequence
  SiRNA target sequence
aaaaaccgagcaataggagca

SEQ ID NO: 41771 - DNA, 21 bp, Artificial sequence
  SiRNA target sequence
aaaaccgagcaataggagcac

SEQ ID NO: 41772 - DNA, 21 bp, Artificial sequence
  SiRNA target sequence
aaaccgagcaataggagcact

SEQ ID NO: 41773 - DNA, 21 bp, Artificial sequence
  SiRNA target sequence
aaccgagcaataggagcacta

SEQ ID NO: 41774 - DNA, 21 bp, Artificial sequence
  SiRNA target sequence
accgagcaataggagcactat

SEQ ID NO: 41775 - DNA, 21 bp, Artificial sequence
  SiRNA target sequence
ccgagcaataggagcactatg

SEQ ID NO: 41776 - DNA, 21 bp, Artificial sequence
  SiRNA target sequence
cgagcaataggagcactatgg

SEQ ID NO: 41777 - DNA, 21 bp, Artificial sequence
  SiRNA target sequence
gagcaataggagcactatggt

SEQ ID NO: 41778 - DNA, 21 bp, Artificial sequence
  SiRNA target sequence
agcaataggagcactatggtt

SEQ ID NO: 41779 - DNA, 21 bp, Artificial sequence
  SiRNA target sequence
gcaataggagcactatggttc

SEQ ID NO: 41780 - DNA, 21 bp, Artificial sequence
  SiRNA target sequence
caataggagcactatggttcg

SEQ ID NO: 41781 - DNA, 21 bp, Artificial sequence
  SiRNA target sequence
aataggagcactatggttcga

SEQ ID NO: 41782 - DNA, 21 bp, Artificial sequence
  SiRNA target sequence
ataggagcactatggttcgag

SEQ ID NO: 41783 - DNA, 21 bp, Artificial sequence
  SiRNA target sequence
taggagcactatggttcgaga

SEQ ID NO: 41784 - DNA, 21 bp, Artificial sequence
  SiRNA target sequence
aggagcactatggttcgagaa

SEQ ID NO: 41785 - DNA, 21 bp, Artificial sequence
  SiRNA target sequence
ggagcactatggttcgagaag

SEQ ID NO: 41786 - DNA, 21 bp, Artificial sequence
  SiRNA target sequence
gagcactatggttcgagaaga

SEQ ID NO: 41787 - DNA, 21 bp, Artificial sequence
  SiRNA target sequence
agcactatggttcgagaagac

SEQ ID NO: 41788 - DNA, 21 bp, Artificial sequence
  SiRNA target sequence
gcactatggttcgagaagaca

SEQ ID NO: 41789 - DNA, 21 bp, Artificial sequence
  SiRNA target sequence
cactatggttcgagaagacat

SEQ ID NO: 41790 - DNA, 21 bp, Artificial sequence
  SiRNA target sequence
actatggttcgagaagacatt

SEQ ID NO: 41791 - DNA, 21 bp, Artificial sequence
  SiRNA target sequence
ctatggttcgagaagacatta

SEQ ID NO: 41792 - DNA, 21 bp, Artificial sequence
  SiRNA target sequence
tatggttcgagaagacattat

SEQ ID NO: 41793 - DNA, 21 bp, Artificial sequence
  SiRNA target sequence
atggttcgagaagacattata

SEQ ID NO: 41794 - DNA, 21 bp, Artificial sequence
  SiRNA target sequence
tggttcgagaagacattataa

SEQ ID NO: 41795 - DNA, 21 bp, Artificial sequence
  SiRNA target sequence
ggttcgagaagacattataag

SEQ ID NO: 41796 - DNA, 21 bp, Artificial sequence
  SiRNA target sequence
gttcgagaagacattataaga

SEQ ID NO: 41797 - DNA, 21 bp, Artificial sequence
  SiRNA target sequence
ttcgagaagacattataagac

SEQ ID NO: 41798 - DNA, 21 bp, Artificial sequence
  SiRNA target sequence
tcgagaagacattataagaca

SEQ ID NO: 41799 - DNA, 21 bp, Artificial sequence
  SiRNA target sequence
cgagaagacattataagacaa

SEQ ID NO: 41800 - DNA, 21 bp, Artificial sequence
  SiRNA target sequence
gagaagacattataagacaaa

SEQ ID NO: 41801 - DNA, 21 bp, Artificial sequence
  SiRNA target sequence
agaagacattataagacaaac

SEQ ID NO: 41802 - DNA, 21 bp, Artificial sequence
  SiRNA target sequence
gaagacattataagacaaact

SEQ ID NO: 41803 - DNA, 21 bp, Artificial sequence
  SiRNA target sequence
aagacattataagacaaactc

SEQ ID NO: 41804 - DNA, 21 bp, Artificial sequence
  SiRNA target sequence
agacattataagacaaactca

SEQ ID NO: 41805 - DNA, 21 bp, Artificial sequence
  SiRNA target sequence
gacattataagacaaactcac

SEQ ID NO: 41806 - DNA, 21 bp, Artificial sequence
  SiRNA target sequence
acattataagacaaactcact

SEQ ID NO: 41807 - DNA, 21 bp, Artificial sequence
  SiRNA target sequence
cattataagacaaactcacta

SEQ ID NO: 41808 - DNA, 21 bp, Artificial sequence
  SiRNA target sequence
attataagacaaactcactag

SEQ ID NO: 41809 - DNA, 21 bp, Artificial sequence
  SiRNA target sequence
ttataagacaaactcactaga

SEQ ID NO: 41810 - DNA, 21 bp, Artificial sequence
  SiRNA target sequence
tataagacaaactcactagat

SEQ ID NO: 41811 - DNA, 21 bp, Artificial sequence
  SiRNA target sequence
ataagacaaactcactagatg

SEQ ID NO: 41812 - DNA, 21 bp, Artificial sequence
  SiRNA target sequence
taagacaaactcactagatgg

SEQ ID NO: 41813 - DNA, 21 bp, Artificial sequence
  SiRNA target sequence
aagacaaactcactagatgga

SEQ ID NO: 41814 - DNA, 21 bp, Artificial sequence
  SiRNA target sequence
agacaaactcactagatggag

SEQ ID NO: 41815 - DNA, 21 bp, Artificial sequence
  SiRNA target sequence
gacaaactcactagatggagg

SEQ ID NO: 41816 - DNA, 21 bp, Artificial sequence
  SiRNA target sequence
acaaactcactagatggaggg

SEQ ID NO: 41817 - DNA, 21 bp, Artificial sequence
  SiRNA target sequence
caaactcactagatggagggc

SEQ ID NO: 41818 - DNA, 21 bp, Artificial sequence
  SiRNA target sequence
aaactcactagatggagggct

SEQ ID NO: 41819 - DNA, 21 bp, Artificial sequence
  SiRNA target sequence
aactcactagatggagggctt

SEQ ID NO: 41820 - DNA, 21 bp, Artificial sequence
  SiRNA target sequence
actcactagatggagggctta

SEQ ID NO: 41821 - DNA, 21 bp, Artificial sequence
  SiRNA target sequence
ctcactagatggagggcttat

SEQ ID NO: 41822 - DNA, 21 bp, Artificial sequence
  SiRNA target sequence
tcactagatggagggcttata

SEQ ID NO: 41823 - DNA, 21 bp, Artificial sequence
  SiRNA target sequence
cactagatggagggcttataa

SEQ ID NO: 41824 - DNA, 21 bp, Artificial sequence
  SiRNA target sequence
actagatggagggcttataat

SEQ ID NO: 41825 - DNA, 21 bp, Artificial sequence
  SiRNA target sequence
ctagatggagggcttataatt

SEQ ID NO: 41826 - DNA, 21 bp, Artificial sequence
  SiRNA target sequence
tagatggagggcttataatta

SEQ ID NO: 41827 - DNA, 21 bp, Artificial sequence
  SiRNA target sequence
agatggagggcttataattat

SEQ ID NO: 41828 - DNA, 21 bp, Artificial sequence
  SiRNA target sequence
gatggagggcttataattata

SEQ ID NO: 41829 - DNA, 21 bp, Artificial sequence
  SiRNA target sequence
atggagggcttataattataa

SEQ ID NO: 41830 - DNA, 21 bp, Artificial sequence
  SiRNA target sequence
tggagggcttataattataag

SEQ ID NO: 41831 - DNA, 21 bp, Artificial sequence
  SiRNA target sequence
ggagggcttataattataagc

SEQ ID NO: 41832 - DNA, 21 bp, Artificial sequence
  SiRNA target sequence
gagggcttataattataagct

SEQ ID NO: 41833 - DNA, 21 bp, Artificial sequence
  SiRNA target sequence
agggcttataattataagctt

SEQ ID NO: 41834 - DNA, 21 bp, Artificial sequence
  SiRNA target sequence
gggcttataattataagcttc

SEQ ID NO: 41835 - DNA, 21 bp, Artificial sequence
  SiRNA target sequence
ggcttataattataagcttct

SEQ ID NO: 41836 - DNA, 21 bp, Artificial sequence
  SiRNA target sequence
gcttataattataagcttctt

SEQ ID NO: 41837 - DNA, 21 bp, Artificial sequence
  SiRNA target sequence
cttataattataagcttcttg

SEQ ID NO: 41838 - DNA, 21 bp, Artificial sequence
  SiRNA target sequence
ttataattataagcttcttga

SEQ ID NO: 41839 - DNA, 21 bp, Artificial sequence
  SiRNA target sequence
tataattataagcttcttgac

SEQ ID NO: 41840 - DNA, 21 bp, Artificial sequence
  SiRNA target sequence
ataattataagcttcttgaca

SEQ ID NO: 41841 - DNA, 21 bp, Artificial sequence
  SiRNA target sequence
taattataagcttcttgacat

SEQ ID NO: 41842 - DNA, 21 bp, Artificial sequence
  SiRNA target sequence
aattataagcttcttgacata

SEQ ID NO: 41843 - DNA, 21 bp, Artificial sequence
  SiRNA target sequence
attataagcttcttgacataa

SEQ ID NO: 41844 - DNA, 21 bp, Artificial sequence
  SiRNA target sequence
ttataagcttcttgacataat

SEQ ID NO: 41845 - DNA, 21 bp, Artificial sequence
  SiRNA target sequence
tataagcttcttgacataatc

SEQ ID NO: 41846 - DNA, 21 bp, Artificial sequence
  SiRNA target sequence
ataagcttcttgacataatct

SEQ ID NO: 41847 - DNA, 21 bp, Artificial sequence
  SiRNA target sequence
taagcttcttgacataatcta

SEQ ID NO: 41848 - DNA, 21 bp, Artificial sequence
  SiRNA target sequence
aagcttcttgacataatctaa

SEQ ID NO: 41849 - DNA, 21 bp, Artificial sequence
  SiRNA target sequence
agcttcttgacataatctaac

SEQ ID NO: 41850 - DNA, 21 bp, Artificial sequence
  SiRNA target sequence
gcttcttgacataatctaacc

SEQ ID NO: 41851 - DNA, 21 bp, Artificial sequence
  SiRNA target sequence
cttcttgacataatctaacca

SEQ ID NO: 41852 - DNA, 21 bp, Artificial sequence
  SiRNA target sequence
ttcttgacataatctaaccat

SEQ ID NO: 41853 - DNA, 21 bp, Artificial sequence
  SiRNA target sequence
tcttgacataatctaaccatt

SEQ ID NO: 41854 - DNA, 21 bp, Artificial sequence
  SiRNA target sequence
cttgacataatctaaccattg

SEQ ID NO: 41855 - DNA, 21 bp, Artificial sequence
  SiRNA target sequence
ttgacataatctaaccattgc

SEQ ID NO: 41856 - DNA, 21 bp, Artificial sequence
  SiRNA target sequence
tgacataatctaaccattgcg

SEQ ID NO: 41857 - DNA, 21 bp, Artificial sequence
  SiRNA target sequence
gacataatctaaccattgcgt

SEQ ID NO: 41858 - DNA, 21 bp, Artificial sequence
  SiRNA target sequence
acataatctaaccattgcgtc

SEQ ID NO: 41859 - DNA, 21 bp, Artificial sequence
  SiRNA target sequence
cataatctaaccattgcgtca

SEQ ID NO: 41860 - DNA, 21 bp, Artificial sequence
  SiRNA target sequence
ataatctaaccattgcgtcaa

SEQ ID NO: 41861 - DNA, 21 bp, Artificial sequence
  SiRNA target sequence
taatctaaccattgcgtcaaa

SEQ ID NO: 41862 - DNA, 21 bp, Artificial sequence
  SiRNA target sequence
aatctaaccattgcgtcaaaa

SEQ ID NO: 41863 - DNA, 21 bp, Artificial sequence
  SiRNA target sequence
atctaaccattgcgtcaaaat

SEQ ID NO: 41864 - DNA, 21 bp, Artificial sequence
  SiRNA target sequence
tctaaccattgcgtcaaaatt

SEQ ID NO: 41865 - DNA, 21 bp, Artificial sequence
  SiRNA target sequence
ctaaccattgcgtcaaaattt

SEQ ID NO: 41866 - DNA, 21 bp, Artificial sequence
  SiRNA target sequence
taaccattgcgtcaaaatttc

SEQ ID NO: 41867 - DNA, 21 bp, Artificial sequence
  SiRNA target sequence
aaccattgcgtcaaaatttcg

SEQ ID NO: 41868 - DNA, 21 bp, Artificial sequence
  SiRNA target sequence
accattgcgtcaaaatttcga

SEQ ID NO: 41869 - DNA, 21 bp, Artificial sequence
  SiRNA target sequence
ccattgcgtcaaaatttcgaa

SEQ ID NO: 41870 - DNA, 21 bp, Artificial sequence
  SiRNA target sequence
cattgcgtcaaaatttcgaat

SEQ ID NO: 41871 - DNA, 21 bp, Artificial sequence
  SiRNA target sequence
attgcgtcaaaatttcgaatt

SEQ ID NO: 41872 - DNA, 21 bp, Artificial sequence
  SiRNA target sequence
ttgcgtcaaaatttcgaatta

SEQ ID NO: 41873 - DNA, 21 bp, Artificial sequence
  SiRNA target sequence
tgcgtcaaaatttcgaattag

SEQ ID NO: 41874 - DNA, 21 bp, Artificial sequence
  SiRNA target sequence
gcgtcaaaatttcgaattagt

SEQ ID NO: 41875 - DNA, 21 bp, Artificial sequence
  SiRNA target sequence
cgtcaaaatttcgaattagta

SEQ ID NO: 41876 - DNA, 21 bp, Artificial sequence
  SiRNA target sequence
gtcaaaatttcgaattagtaa

SEQ ID NO: 41877 - DNA, 21 bp, Artificial sequence
  SiRNA target sequence
tcaaaatttcgaattagtaaa

SEQ ID NO: 41878 - DNA, 21 bp, Artificial sequence
  SiRNA target sequence
caaaatttcgaattagtaaat

SEQ ID NO: 41879 - DNA, 21 bp, Artificial sequence
  SiRNA target sequence
aaaatttcgaattagtaaatt

SEQ ID NO: 41880 - DNA, 21 bp, Artificial sequence
  SiRNA target sequence
aaatttcgaattagtaaatta

SEQ ID NO: 41881 - DNA, 21 bp, Artificial sequence
  SiRNA target sequence
aatttcgaattagtaaattaa

SEQ ID NO: 41882 - DNA, 21 bp, Artificial sequence
  SiRNA target sequence
atttcgaattagtaaattaaa

SEQ ID NO: 41883 - DNA, 21 bp, Artificial sequence
  SiRNA target sequence
tttcgaattagtaaattaaaa

SEQ ID NO: 41884 - DNA, 21 bp, Artificial sequence
  SiRNA target sequence
ttcgaattagtaaattaaaaa

SEQ ID NO: 41885 - DNA, 21 bp, Artificial sequence
  SiRNA target sequence
tcgaattagtaaattaaaaaa

SEQ ID NO: 41886 - DNA, 21 bp, Artificial sequence
  SiRNA target sequence
cgaattagtaaattaaaaaaa

SEQ ID NO: 41887 - DNA, 21 bp, Artificial sequence
  SiRNA target sequence
gatgaacgtcgacctattgaa

SEQ ID NO: 41888 - DNA, 21 bp, Artificial sequence
  SiRNA target sequence
atgaacgtcgacctattgaaa

SEQ ID NO: 41889 - DNA, 21 bp, Artificial sequence
  SiRNA target sequence
tgaacgtcgacctattgaaaa

SEQ ID NO: 41890 - DNA, 21 bp, Artificial sequence
  SiRNA target sequence
gaacgtcgacctattgaaaaa

SEQ ID NO: 41891 - DNA, 21 bp, Artificial sequence
  SiRNA target sequence
aacgtcgacctattgaaaaag

SEQ ID NO: 41892 - DNA, 21 bp, Artificial sequence
  SiRNA target sequence
acgtcgacctattgaaaaagt

SEQ ID NO: 41893 - DNA, 21 bp, Artificial sequence
  SiRNA target sequence
cgtcgacctattgaaaaagtt

SEQ ID NO: 41894 - DNA, 21 bp, Artificial sequence
  SiRNA target sequence
gtcgacctattgaaaaagtta

SEQ ID NO: 41895 - DNA, 21 bp, Artificial sequence
  SiRNA target sequence
tcgacctattgaaaaagttaa

SEQ ID NO: 41896 - DNA, 21 bp, Artificial sequence
  SiRNA target sequence
cgacctattgaaaaagttaat

SEQ ID NO: 41897 - DNA, 21 bp, Artificial sequence
  SiRNA target sequence
gacctattgaaaaagttaatc

SEQ ID NO: 41898 - DNA, 21 bp, Artificial sequence
  SiRNA target sequence
acctattgaaaaagttaatca

SEQ ID NO: 41899 - DNA, 21 bp, Artificial sequence
  SiRNA target sequence
cctattgaaaaagttaatcaa

SEQ ID NO: 41900 - DNA, 21 bp, Artificial sequence
  SiRNA target sequence
ctattgaaaaagttaatcaat

SEQ ID NO: 41901 - DNA, 21 bp, Artificial sequence
  SiRNA target sequence
tattgaaaaagttaatcaatt

SEQ ID NO: 41902 - DNA, 21 bp, Artificial sequence
  SiRNA target sequence
attgaaaaagttaatcaattg

SEQ ID NO: 41903 - DNA, 21 bp, Artificial sequence
  SiRNA target sequence
ttgaaaaagttaatcaattga

SEQ ID NO: 41904 - DNA, 21 bp, Artificial sequence
  SiRNA target sequence
tgaaaaagttaatcaattgaa

SEQ ID NO: 41905 - DNA, 21 bp, Artificial sequence
  SiRNA target sequence
gaaaaagttaatcaattgaaa

SEQ ID NO: 41906 - DNA, 21 bp, Artificial sequence
  SiRNA target sequence
aaaaagttaatcaattgaaaa

SEQ ID NO: 41907 - DNA, 21 bp, Artificial sequence
  SiRNA target sequence
aaaagttaatcaattgaaaac

SEQ ID NO: 41908 - DNA, 21 bp, Artificial sequence
  SiRNA target sequence
aaagttaatcaattgaaaaca

SEQ ID NO: 41909 - DNA, 21 bp, Artificial sequence
  SiRNA target sequence
aagttaatcaattgaaaacac

SEQ ID NO: 41910 - DNA, 21 bp, Artificial sequence
  SiRNA target sequence
agttaatcaattgaaaacacg

SEQ ID NO: 41911 - DNA, 21 bp, Artificial sequence
  SiRNA target sequence
gttaatcaattgaaaacacga

SEQ ID NO: 41912 - DNA, 21 bp, Artificial sequence
  SiRNA target sequence
ttaatcaattgaaaacacgag

SEQ ID NO: 41913 - DNA, 21 bp, Artificial sequence
  SiRNA target sequence
taatcaattgaaaacacgagt

SEQ ID NO: 41914 - DNA, 21 bp, Artificial sequence
  SiRNA target sequence
aatcaattgaaaacacgagta

SEQ ID NO: 41915 - DNA, 21 bp, Artificial sequence
  SiRNA target sequence
atcaattgaaaacacgagtat

SEQ ID NO: 41916 - DNA, 21 bp, Artificial sequence
  SiRNA target sequence
tcaattgaaaacacgagtatt

SEQ ID NO: 41917 - DNA, 21 bp, Artificial sequence
  SiRNA target sequence
caattgaaaacacgagtattc

SEQ ID NO: 41918 - DNA, 21 bp, Artificial sequence
  SiRNA target sequence
aattgaaaacacgagtattct

SEQ ID NO: 41919 - DNA, 21 bp, Artificial sequence
  SiRNA target sequence
attgaaaacacgagtattctc

SEQ ID NO: 41920 - DNA, 21 bp, Artificial sequence
  SiRNA target sequence
ttgaaaacacgagtattctca

SEQ ID NO: 41921 - DNA, 21 bp, Artificial sequence
  SiRNA target sequence
tgaaaacacgagtattctcaa

SEQ ID NO: 41922 - DNA, 21 bp, Artificial sequence
  SiRNA target sequence
gaaaacacgagtattctcaaa

SEQ ID NO: 41923 - DNA, 21 bp, Artificial sequence
  SiRNA target sequence
aaaacacgagtattctcaaat

SEQ ID NO: 41924 - DNA, 21 bp, Artificial sequence
  SiRNA target sequence
aaacacgagtattctcaaatg

SEQ ID NO: 41925 - DNA, 21 bp, Artificial sequence
  SiRNA target sequence
aacacgagtattctcaaatgg

SEQ ID NO: 41926 - DNA, 21 bp, Artificial sequence
  SiRNA target sequence
acacgagtattctcaaatgga

SEQ ID NO: 41927 - DNA, 21 bp, Artificial sequence
  SiRNA target sequence
cacgagtattctcaaatggac

SEQ ID NO: 41928 - DNA, 21 bp, Artificial sequence
  SiRNA target sequence
acgagtattctcaaatggacc

SEQ ID NO: 41929 - DNA, 21 bp, Artificial sequence
  SiRNA target sequence
cgagtattctcaaatggacca

SEQ ID NO: 41930 - DNA, 21 bp, Artificial sequence
  SiRNA target sequence
gagtattctcaaatggaccaa

SEQ ID NO: 41931 - DNA, 21 bp, Artificial sequence
  SiRNA target sequence
agtattctcaaatggaccaat

SEQ ID NO: 41932 - DNA, 21 bp, Artificial sequence
  SiRNA target sequence
gtattctcaaatggaccaatg

SEQ ID NO: 41933 - DNA, 21 bp, Artificial sequence
  SiRNA target sequence
tattctcaaatggaccaatgg

SEQ ID NO: 41934 - DNA, 21 bp, Artificial sequence
  SiRNA target sequence
attctcaaatggaccaatgga

SEQ ID NO: 41935 - DNA, 21 bp, Artificial sequence
  SiRNA target sequence
ttctcaaatggaccaatggac

SEQ ID NO: 41936 - DNA, 21 bp, Artificial sequence
  SiRNA target sequence
tctcaaatggaccaatggact

SEQ ID NO: 41937 - DNA, 21 bp, Artificial sequence
  SiRNA target sequence
ctcaaatggaccaatggactt

SEQ ID NO: 41938 - DNA, 21 bp, Artificial sequence
  SiRNA target sequence
tcaaatggaccaatggacttc

SEQ ID NO: 41939 - DNA, 21 bp, Artificial sequence
  SiRNA target sequence
caaatggaccaatggacttct

SEQ ID NO: 41940 - DNA, 21 bp, Artificial sequence
  SiRNA target sequence
aaatggaccaatggacttctc

SEQ ID NO: 41941 - DNA, 21 bp, Artificial sequence
  SiRNA target sequence
aatggaccaatggacttctca

SEQ ID NO: 41942 - DNA, 21 bp, Artificial sequence
  SiRNA target sequence
atggaccaatggacttctcaa

SEQ ID NO: 41943 - DNA, 21 bp, Artificial sequence
  SiRNA target sequence
tggaccaatggacttctcaat

SEQ ID NO: 41944 - DNA, 21 bp, Artificial sequence
  SiRNA target sequence
ggaccaatggacttctcaatt

SEQ ID NO: 41945 - DNA, 21 bp, Artificial sequence
  SiRNA target sequence
gaccaatggacttctcaattg

SEQ ID NO: 41946 - DNA, 21 bp, Artificial sequence
  SiRNA target sequence
accaatggacttctcaattgc

SEQ ID NO: 41947 - DNA, 21 bp, Artificial sequence
  SiRNA target sequence
ccaatggacttctcaattgcg

SEQ ID NO: 41948 - DNA, 21 bp, Artificial sequence
  SiRNA target sequence
caatggacttctcaattgcgt

SEQ ID NO: 41949 - DNA, 21 bp, Artificial sequence
  SiRNA target sequence
aatggacttctcaattgcgtt

SEQ ID NO: 41950 - DNA, 21 bp, Artificial sequence
  SiRNA target sequence
atggacttctcaattgcgttt

SEQ ID NO: 41951 - DNA, 21 bp, Artificial sequence
  SiRNA target sequence
tggacttctcaattgcgtttc

SEQ ID NO: 41952 - DNA, 21 bp, Artificial sequence
  SiRNA target sequence
ggacttctcaattgcgtttcg

SEQ ID NO: 41953 - DNA, 21 bp, Artificial sequence
  SiRNA target sequence
gacttctcaattgcgtttcga

SEQ ID NO: 41954 - DNA, 21 bp, Artificial sequence
  SiRNA target sequence
acttctcaattgcgtttcgaa

SEQ ID NO: 41955 - DNA, 21 bp, Artificial sequence
  SiRNA target sequence
cttctcaattgcgtttcgaat

SEQ ID NO: 41956 - DNA, 21 bp, Artificial sequence
  SiRNA target sequence
ttctcaattgcgtttcgaatg

SEQ ID NO: 41957 - DNA, 21 bp, Artificial sequence
  SiRNA target sequence
tctcaattgcgtttcgaatgt

SEQ ID NO: 41958 - DNA, 21 bp, Artificial sequence
  SiRNA target sequence
ctcaattgcgtttcgaatgta

SEQ ID NO: 41959 - DNA, 21 bp, Artificial sequence
  SiRNA target sequence
tcaattgcgtttcgaatgtat

SEQ ID NO: 41960 - DNA, 21 bp, Artificial sequence
  SiRNA target sequence
caattgcgtttcgaatgtatt

SEQ ID NO: 41961 - DNA, 21 bp, Artificial sequence
  SiRNA target sequence
aattgcgtttcgaatgtatta

SEQ ID NO: 41962 - DNA, 21 bp, Artificial sequence
  SiRNA target sequence
attgcgtttcgaatgtattat

SEQ ID NO: 41963 - DNA, 21 bp, Artificial sequence
  SiRNA target sequence
ttgcgtttcgaatgtattatt

SEQ ID NO: 41964 - DNA, 21 bp, Artificial sequence
  SiRNA target sequence
tgcgtttcgaatgtattattt

SEQ ID NO: 41965 - DNA, 21 bp, Artificial sequence
  SiRNA target sequence
gcgtttcgaatgtattatttg

SEQ ID NO: 41966 - DNA, 21 bp, Artificial sequence
  SiRNA target sequence
cgtttcgaatgtattatttgg

SEQ ID NO: 41967 - DNA, 21 bp, Artificial sequence
  SiRNA target sequence
gtttcgaatgtattatttggg

SEQ ID NO: 41968 - DNA, 21 bp, Artificial sequence
  SiRNA target sequence
tttcgaatgtattatttgggc

SEQ ID NO: 41969 - DNA, 21 bp, Artificial sequence
  SiRNA target sequence
ttcgaatgtattatttgggct

SEQ ID NO: 41970 - DNA, 21 bp, Artificial sequence
  SiRNA target sequence
tcgaatgtattatttgggctt

SEQ ID NO: 41971 - DNA, 21 bp, Artificial sequence
  SiRNA target sequence
cgaatgtattatttgggcttt

SEQ ID NO: 41972 - DNA, 21 bp, Artificial sequence
  SiRNA target sequence
gaatgtattatttgggcttta

SEQ ID NO: 41973 - DNA, 21 bp, Artificial sequence
  SiRNA target sequence
aatgtattatttgggctttat

SEQ ID NO: 41974 - DNA, 21 bp, Artificial sequence
  SiRNA target sequence
atgtattatttgggctttata

SEQ ID NO: 41975 - DNA, 21 bp, Artificial sequence
  SiRNA target sequence
tgtattatttgggctttatag

SEQ ID NO: 41976 - DNA, 21 bp, Artificial sequence
  SiRNA target sequence
gtattatttgggctttatagc

SEQ ID NO: 41977 - DNA, 21 bp, Artificial sequence
  SiRNA target sequence
tattatttgggctttatagct

SEQ ID NO: 41978 - DNA, 21 bp, Artificial sequence
  SiRNA target sequence
attatttgggctttatagctc

SEQ ID NO: 41979 - DNA, 21 bp, Artificial sequence
  SiRNA target sequence
ttatttgggctttatagctca

SEQ ID NO: 41980 - DNA, 21 bp, Artificial sequence
  SiRNA target sequence
tatttgggctttatagctcat

SEQ ID NO: 41981 - DNA, 21 bp, Artificial sequence
  SiRNA target sequence
atttgggctttatagctcatt

SEQ ID NO: 41982 - DNA, 21 bp, Artificial sequence
  SiRNA target sequence
tttgggctttatagctcattt

SEQ ID NO: 41983 - DNA, 21 bp, Artificial sequence
  SiRNA target sequence
ttgggctttatagctcatttg

SEQ ID NO: 41984 - DNA, 21 bp, Artificial sequence
  SiRNA target sequence
tgggctttatagctcatttga

SEQ ID NO: 41985 - DNA, 21 bp, Artificial sequence
  SiRNA target sequence
gggctttatagctcatttgat

SEQ ID NO: 41986 - DNA, 21 bp, Artificial sequence
  SiRNA target sequence
ggctttatagctcatttgatg

SEQ ID NO: 41987 - DNA, 21 bp, Artificial sequence
  SiRNA target sequence
gctttatagctcatttgatgg

SEQ ID NO: 41988 - DNA, 21 bp, Artificial sequence
  SiRNA target sequence
ctttatagctcatttgatgga

SEQ ID NO: 41989 - DNA, 21 bp, Artificial sequence
  SiRNA target sequence
tttatagctcatttgatggag

SEQ ID NO: 41990 - DNA, 21 bp, Artificial sequence
  SiRNA target sequence
ttatagctcatttgatggaga

SEQ ID NO: 41991 - DNA, 21 bp, Artificial sequence
  SiRNA target sequence
tatagctcatttgatggagaa

SEQ ID NO: 41992 - DNA, 21 bp, Artificial sequence
  SiRNA target sequence
atagctcatttgatggagaat

SEQ ID NO: 41993 - DNA, 21 bp, Artificial sequence
  SiRNA target sequence
tagctcatttgatggagaatc

SEQ ID NO: 41994 - DNA, 21 bp, Artificial sequence
  SiRNA target sequence
agctcatttgatggagaatcg

SEQ ID NO: 41995 - DNA, 21 bp, Artificial sequence
  SiRNA target sequence
gctcatttgatggagaatcga

SEQ ID NO: 41996 - DNA, 21 bp, Artificial sequence
  SiRNA target sequence
ctcatttgatggagaatcgaa

SEQ ID NO: 41997 - DNA, 21 bp, Artificial sequence
  SiRNA target sequence
tcatttgatggagaatcgaat

SEQ ID NO: 41998 - DNA, 21 bp, Artificial sequence
  SiRNA target sequence
catttgatggagaatcgaatt

SEQ ID NO: 41999 - DNA, 21 bp, Artificial sequence
  SiRNA target sequence
atttgatggagaatcgaattg

SEQ ID NO: 42000 - DNA, 21 bp, Artificial sequence
  SiRNA target sequence
tttgatggagaatcgaattgc

SEQ ID NO: 42001 - DNA, 21 bp, Artificial sequence
  SiRNA target sequence
ttgatggagaatcgaattgca

SEQ ID NO: 42002 - DNA, 21 bp, Artificial sequence
  SiRNA target sequence
tgatggagaatcgaattgcaa

SEQ ID NO: 42003 - DNA, 21 bp, Artificial sequence
  SiRNA target sequence
gatggagaatcgaattgcaaa

SEQ ID NO: 42004 - DNA, 21 bp, Artificial sequence
  SiRNA target sequence
atggagaatcgaattgcaaat

SEQ ID NO: 42005 - DNA, 21 bp, Artificial sequence
  SiRNA target sequence
tggagaatcgaattgcaaatg

SEQ ID NO: 42006 - DNA, 21 bp, Artificial sequence
  SiRNA target sequence
ggagaatcgaattgcaaatga

SEQ ID NO: 42007 - DNA, 21 bp, Artificial sequence
  SiRNA target sequence
gagaatcgaattgcaaatgaa

SEQ ID NO: 42008 - DNA, 21 bp, Artificial sequence
  SiRNA target sequence
agaatcgaattgcaaatgaag

SEQ ID NO: 42009 - DNA, 21 bp, Artificial sequence
  SiRNA target sequence
gaatcgaattgcaaatgaagt

SEQ ID NO: 42010 - DNA, 21 bp, Artificial sequence
  SiRNA target sequence
aatcgaattgcaaatgaagtg

SEQ ID NO: 42011 - DNA, 21 bp, Artificial sequence
  SiRNA target sequence
atcgaattgcaaatgaagtgt

SEQ ID NO: 42012 - DNA, 21 bp, Artificial sequence
  SiRNA target sequence
tcgaattgcaaatgaagtgtc

SEQ ID NO: 42013 - DNA, 21 bp, Artificial sequence
  SiRNA target sequence
cgaattgcaaatgaagtgtct

SEQ ID NO: 42014 - DNA, 21 bp, Artificial sequence
  SiRNA target sequence
gaattgcaaatgaagtgtcta

SEQ ID NO: 42015 - DNA, 21 bp, Artificial sequence
  SiRNA target sequence
aattgcaaatgaagtgtctat

SEQ ID NO: 42016 - DNA, 21 bp, Artificial sequence
  SiRNA target sequence
attgcaaatgaagtgtctatt

SEQ ID NO: 42017 - DNA, 21 bp, Artificial sequence
  SiRNA target sequence
ttgcaaatgaagtgtctattg

SEQ ID NO: 42018 - DNA, 21 bp, Artificial sequence
  SiRNA target sequence
tgcaaatgaagtgtctattgg

SEQ ID NO: 42019 - DNA, 21 bp, Artificial sequence
  SiRNA target sequence
gcaaatgaagtgtctattgga

SEQ ID NO: 42020 - DNA, 21 bp, Artificial sequence
  SiRNA target sequence
caaatgaagtgtctattggaa

SEQ ID NO: 42021 - DNA, 21 bp, Artificial sequence
  SiRNA target sequence
aaatgaagtgtctattggaac

SEQ ID NO: 42022 - DNA, 21 bp, Artificial sequence
  SiRNA target sequence
aatgaagtgtctattggaacg

SEQ ID NO: 42023 - DNA, 21 bp, Artificial sequence
  SiRNA target sequence
atgaagtgtctattggaacga

SEQ ID NO: 42024 - DNA, 21 bp, Artificial sequence
  SiRNA target sequence
tgaagtgtctattggaacgaa

SEQ ID NO: 42025 - DNA, 21 bp, Artificial sequence
  SiRNA target sequence
gaagtgtctattggaacgaat

SEQ ID NO: 42026 - DNA, 21 bp, Artificial sequence
  SiRNA target sequence
aagtgtctattggaacgaatg

SEQ ID NO: 42027 - DNA, 21 bp, Artificial sequence
  SiRNA target sequence
agtgtctattggaacgaatgt

SEQ ID NO: 42028 - DNA, 21 bp, Artificial sequence
  SiRNA target sequence
gtgtctattggaacgaatgtt

SEQ ID NO: 42029 - DNA, 21 bp, Artificial sequence
  SiRNA target sequence
tgtctattggaacgaatgttt

SEQ ID NO: 42030 - DNA, 21 bp, Artificial sequence
  SiRNA target sequence
gtctattggaacgaatgttta

SEQ ID NO: 42031 - DNA, 21 bp, Artificial sequence
  SiRNA target sequence
tctattggaacgaatgtttat

SEQ ID NO: 42032 - DNA, 21 bp, Artificial sequence
  SiRNA target sequence
ctattggaacgaatgtttatt

SEQ ID NO: 42033 - DNA, 21 bp, Artificial sequence
  SiRNA target sequence
tattggaacgaatgtttattc

SEQ ID NO: 42034 - DNA, 21 bp, Artificial sequence
  SiRNA target sequence
attggaacgaatgtttattca

SEQ ID NO: 42035 - DNA, 21 bp, Artificial sequence
  SiRNA target sequence
ttggaacgaatgtttattcac

SEQ ID NO: 42036 - DNA, 21 bp, Artificial sequence
  SiRNA target sequence
tggaacgaatgtttattcaca

SEQ ID NO: 42037 - DNA, 21 bp, Artificial sequence
  SiRNA target sequence
ggaacgaatgtttattcacaa

SEQ ID NO: 42038 - DNA, 21 bp, Artificial sequence
  SiRNA target sequence
gaacgaatgtttattcacaag

SEQ ID NO: 42039 - DNA, 21 bp, Artificial sequence
  SiRNA target sequence
aacgaatgtttattcacaaga

SEQ ID NO: 42040 - DNA, 21 bp, Artificial sequence
  SiRNA target sequence
acgaatgtttattcacaagac

SEQ ID NO: 42041 - DNA, 21 bp, Artificial sequence
  SiRNA target sequence
cgaatgtttattcacaagact

SEQ ID NO: 42042 - DNA, 21 bp, Artificial sequence
  SiRNA target sequence
gaatgtttattcacaagactg

SEQ ID NO: 42043 - DNA, 21 bp, Artificial sequence
  SiRNA target sequence
aatgtttattcacaagactgg

SEQ ID NO: 42044 - DNA, 21 bp, Artificial sequence
  SiRNA target sequence
atgtttattcacaagactgga

SEQ ID NO: 42045 - DNA, 21 bp, Artificial sequence
  SiRNA target sequence
tgtttattcacaagactggag

SEQ ID NO: 42046 - DNA, 21 bp, Artificial sequence
  SiRNA target sequence
gtttattcacaagactggagt

SEQ ID NO: 42047 - DNA, 21 bp, Artificial sequence
  SiRNA target sequence
tttattcacaagactggagta

SEQ ID NO: 42048 - DNA, 21 bp, Artificial sequence
  SiRNA target sequence
ttattcacaagactggagtaa

SEQ ID NO: 42049 - DNA, 21 bp, Artificial sequence
  SiRNA target sequence
tattcacaagactggagtaaa

SEQ ID NO: 42050 - DNA, 21 bp, Artificial sequence
  SiRNA target sequence
attcacaagactggagtaaaa

SEQ ID NO: 42051 - DNA, 21 bp, Artificial sequence
  SiRNA target sequence
ttcacaagactggagtaaaac

SEQ ID NO: 42052 - DNA, 21 bp, Artificial sequence
  SiRNA target sequence
tcacaagactggagtaaaact

SEQ ID NO: 42053 - DNA, 21 bp, Artificial sequence
  SiRNA target sequence
cacaagactggagtaaaactg

SEQ ID NO: 42054 - DNA, 21 bp, Artificial sequence
  SiRNA target sequence
acaagactggagtaaaactgt

SEQ ID NO: 42055 - DNA, 21 bp, Artificial sequence
  SiRNA target sequence
caagactggagtaaaactgtt

SEQ ID NO: 42056 - DNA, 21 bp, Artificial sequence
  SiRNA target sequence
aagactggagtaaaactgtta

SEQ ID NO: 42057 - DNA, 21 bp, Artificial sequence
  SiRNA target sequence
agactggagtaaaactgttag

SEQ ID NO: 42058 - DNA, 21 bp, Artificial sequence
  SiRNA target sequence
gactggagtaaaactgttagg

SEQ ID NO: 42059 - DNA, 21 bp, Artificial sequence
  SiRNA target sequence
actggagtaaaactgttagga

SEQ ID NO: 42060 - DNA, 21 bp, Artificial sequence
  SiRNA target sequence
ctggagtaaaactgttaggaa

SEQ ID NO: 42061 - DNA, 21 bp, Artificial sequence
  SiRNA target sequence
tggagtaaaactgttaggaaa

SEQ ID NO: 42062 - DNA, 21 bp, Artificial sequence
  SiRNA target sequence
ggagtaaaactgttaggaaat

SEQ ID NO: 42063 - DNA, 21 bp, Artificial sequence
  SiRNA target sequence
gagtaaaactgttaggaaatt

SEQ ID NO: 42064 - DNA, 21 bp, Artificial sequence
  SiRNA target sequence
agtaaaactgttaggaaatta

SEQ ID NO: 42065 - DNA, 21 bp, Artificial sequence
  SiRNA target sequence
gtaaaactgttaggaaattaa

SEQ ID NO: 42066 - DNA, 21 bp, Artificial sequence
  SiRNA target sequence
taaaactgttaggaaattaac

SEQ ID NO: 42067 - DNA, 21 bp, Artificial sequence
  SiRNA target sequence
aaaactgttaggaaattaacc

SEQ ID NO: 42068 - DNA, 21 bp, Artificial sequence
  SiRNA target sequence
aaactgttaggaaattaacca

SEQ ID NO: 42069 - DNA, 21 bp, Artificial sequence
  SiRNA target sequence
aactgttaggaaattaaccaa

SEQ ID NO: 42070 - DNA, 21 bp, Artificial sequence
  SiRNA target sequence
actgttaggaaattaaccaaa

SEQ ID NO: 42071 - DNA, 21 bp, Artificial sequence
  SiRNA target sequence
ctgttaggaaattaaccaaat

SEQ ID NO: 42072 - DNA, 21 bp, Artificial sequence
  SiRNA target sequence
tgttaggaaattaaccaaatt

SEQ ID NO: 42073 - DNA, 21 bp, Artificial sequence
  SiRNA target sequence
gttaggaaattaaccaaattt

SEQ ID NO: 42074 - DNA, 21 bp, Artificial sequence
  SiRNA target sequence
ttaggaaattaaccaaatttg

SEQ ID NO: 42075 - DNA, 21 bp, Artificial sequence
  SiRNA target sequence
taggaaattaaccaaatttgg

SEQ ID NO: 42076 - DNA, 21 bp, Artificial sequence
  SiRNA target sequence
aggaaattaaccaaatttgga

SEQ ID NO: 42077 - DNA, 21 bp, Artificial sequence
  SiRNA target sequence
ggaaattaaccaaatttggaa

SEQ ID NO: 42078 - DNA, 21 bp, Artificial sequence
  SiRNA target sequence
gaaattaaccaaatttggaaa

SEQ ID NO: 42079 - DNA, 21 bp, Artificial sequence
  SiRNA target sequence
aaattaaccaaatttggaaat

SEQ ID NO: 42080 - DNA, 21 bp, Artificial sequence
  SiRNA target sequence
aattaaccaaatttggaaata

SEQ ID NO: 42081 - DNA, 21 bp, Artificial sequence
  SiRNA target sequence
attaaccaaatttggaaataa

SEQ ID NO: 42082 - DNA, 21 bp, Artificial sequence
  SiRNA target sequence
ttaaccaaatttggaaataaa

SEQ ID NO: 42083 - DNA, 21 bp, Artificial sequence
  SiRNA target sequence
taaccaaatttggaaataaag

SEQ ID NO: 42084 - DNA, 21 bp, Artificial sequence
  SiRNA target sequence
aaccaaatttggaaataaagt

SEQ ID NO: 42085 - DNA, 21 bp, Artificial sequence
  SiRNA target sequence
accaaatttggaaataaagta

SEQ ID NO: 42086 - DNA, 21 bp, Artificial sequence
  SiRNA target sequence
ccaaatttggaaataaagtaa

SEQ ID NO: 42087 - DNA, 21 bp, Artificial sequence
  SiRNA target sequence
caaatttggaaataaagtaat

SEQ ID NO: 42088 - DNA, 21 bp, Artificial sequence
  SiRNA target sequence
aaatttggaaataaagtaatt

SEQ ID NO: 42089 - DNA, 21 bp, Artificial sequence
  SiRNA target sequence
aatttggaaataaagtaattg

SEQ ID NO: 42090 - DNA, 21 bp, Artificial sequence
  SiRNA target sequence
atttggaaataaagtaattgc

SEQ ID NO: 42091 - DNA, 21 bp, Artificial sequence
  SiRNA target sequence
tttggaaataaagtaattgct

SEQ ID NO: 42092 - DNA, 21 bp, Artificial sequence
  SiRNA target sequence
ttggaaataaagtaattgctg

SEQ ID NO: 42093 - DNA, 21 bp, Artificial sequence
  SiRNA target sequence
tggaaataaagtaattgctgg

SEQ ID NO: 42094 - DNA, 21 bp, Artificial sequence
  SiRNA target sequence
ggaaataaagtaattgctggt

SEQ ID NO: 42095 - DNA, 21 bp, Artificial sequence
  SiRNA target sequence
gaaataaagtaattgctggtg

SEQ ID NO: 42096 - DNA, 21 bp, Artificial sequence
  SiRNA target sequence
aaataaagtaattgctggtga

SEQ ID NO: 42097 - DNA, 21 bp, Artificial sequence
  SiRNA target sequence
aataaagtaattgctggtgat

SEQ ID NO: 42098 - DNA, 21 bp, Artificial sequence
  SiRNA target sequence
ataaagtaattgctggtgatt

SEQ ID NO: 42099 - DNA, 21 bp, Artificial sequence
  SiRNA target sequence
taaagtaattgctggtgattt

SEQ ID NO: 42100 - DNA, 21 bp, Artificial sequence
  SiRNA target sequence
aaagtaattgctggtgatttt

SEQ ID NO: 42101 - DNA, 21 bp, Artificial sequence
  SiRNA target sequence
aagtaattgctggtgattttt

SEQ ID NO: 42102 - DNA, 21 bp, Artificial sequence
  SiRNA target sequence
agtaattgctggtgatttttc

SEQ ID NO: 42103 - DNA, 21 bp, Artificial sequence
  SiRNA target sequence
gtaattgctggtgatttttca

SEQ ID NO: 42104 - DNA, 21 bp, Artificial sequence
  SiRNA target sequence
taattgctggtgatttttcaa

SEQ ID NO: 42105 - DNA, 21 bp, Artificial sequence
  SiRNA target sequence
aattgctggtgatttttcaac

SEQ ID NO: 42106 - DNA, 21 bp, Artificial sequence
  SiRNA target sequence
attgctggtgatttttcaact

SEQ ID NO: 42107 - DNA, 21 bp, Artificial sequence
  SiRNA target sequence
ttgctggtgatttttcaactt

SEQ ID NO: 42108 - DNA, 21 bp, Artificial sequence
  SiRNA target sequence
tgctggtgatttttcaacttt

SEQ ID NO: 42109 - DNA, 21 bp, Artificial sequence
  SiRNA target sequence
gctggtgatttttcaactttt

SEQ ID NO: 42110 - DNA, 21 bp, Artificial sequence
  SiRNA target sequence
ctggtgatttttcaacttttg

SEQ ID NO: 42111 - DNA, 21 bp, Artificial sequence
  SiRNA target sequence
tggtgatttttcaacttttga

SEQ ID NO: 42112 - DNA, 21 bp, Artificial sequence
  SiRNA target sequence
ggtgatttttcaacttttgat

SEQ ID NO: 42113 - DNA, 21 bp, Artificial sequence
  SiRNA target sequence
gtgatttttcaacttttgatg

SEQ ID NO: 42114 - DNA, 21 bp, Artificial sequence
  SiRNA target sequence
tgatttttcaacttttgatgg

SEQ ID NO: 42115 - DNA, 21 bp, Artificial sequence
  SiRNA target sequence
gatttttcaacttttgatgga

SEQ ID NO: 42116 - DNA, 21 bp, Artificial sequence
  SiRNA target sequence
atttttcaacttttgatggat

SEQ ID NO: 42117 - DNA, 21 bp, Artificial sequence
  SiRNA target sequence
tttttcaacttttgatggatc

SEQ ID NO: 42118 - DNA, 21 bp, Artificial sequence
  SiRNA target sequence
ttttcaacttttgatggatca

SEQ ID NO: 42119 - DNA, 21 bp, Artificial sequence
  SiRNA target sequence
tttcaacttttgatggatcac

SEQ ID NO: 42120 - DNA, 21 bp, Artificial sequence
  SiRNA target sequence
ttcaacttttgatggatcact

SEQ ID NO: 42121 - DNA, 21 bp, Artificial sequence
  SiRNA target sequence
tcaacttttgatggatcacta

SEQ ID NO: 42122 - DNA, 21 bp, Artificial sequence
  SiRNA target sequence
caacttttgatggatcactaa

SEQ ID NO: 42123 - DNA, 21 bp, Artificial sequence
  SiRNA target sequence
aacttttgatggatcactaaa

SEQ ID NO: 42124 - DNA, 21 bp, Artificial sequence
  SiRNA target sequence
acttttgatggatcactaaac

SEQ ID NO: 42125 - DNA, 21 bp, Artificial sequence
  SiRNA target sequence
cttttgatggatcactaaacg

SEQ ID NO: 42126 - DNA, 21 bp, Artificial sequence
  SiRNA target sequence
ttttgatggatcactaaacgt

SEQ ID NO: 42127 - DNA, 21 bp, Artificial sequence
  SiRNA target sequence
tttgatggatcactaaacgtt

SEQ ID NO: 42128 - DNA, 21 bp, Artificial sequence
  SiRNA target sequence
ttgatggatcactaaacgttt

SEQ ID NO: 42129 - DNA, 21 bp, Artificial sequence
  SiRNA target sequence
tgatggatcactaaacgtttg

SEQ ID NO: 42130 - DNA, 21 bp, Artificial sequence
  SiRNA target sequence
gatggatcactaaacgtttgc

SEQ ID NO: 42131 - DNA, 21 bp, Artificial sequence
  SiRNA target sequence
atggatcactaaacgtttgca

SEQ ID NO: 42132 - DNA, 21 bp, Artificial sequence
  SiRNA target sequence
tggatcactaaacgtttgcat

SEQ ID NO: 42133 - DNA, 21 bp, Artificial sequence
  SiRNA target sequence
ggatcactaaacgtttgcatt

SEQ ID NO: 42134 - DNA, 21 bp, Artificial sequence
  SiRNA target sequence
gatcactaaacgtttgcatta

SEQ ID NO: 42135 - DNA, 21 bp, Artificial sequence
  SiRNA target sequence
atcactaaacgtttgcattat

SEQ ID NO: 42136 - DNA, 21 bp, Artificial sequence
  SiRNA target sequence
tcactaaacgtttgcattatg

SEQ ID NO: 42137 - DNA, 21 bp, Artificial sequence
  SiRNA target sequence
cactaaacgtttgcattatgg

SEQ ID NO: 42138 - DNA, 21 bp, Artificial sequence
  SiRNA target sequence
actaaacgtttgcattatgga

SEQ ID NO: 42139 - DNA, 21 bp, Artificial sequence
  SiRNA target sequence
ctaaacgtttgcattatggaa

SEQ ID NO: 42140 - DNA, 21 bp, Artificial sequence
  SiRNA target sequence
taaacgtttgcattatggaaa

SEQ ID NO: 42141 - DNA, 21 bp, Artificial sequence
  SiRNA target sequence
aaacgtttgcattatggaaaa

SEQ ID NO: 42142 - DNA, 21 bp, Artificial sequence
  SiRNA target sequence
aacgtttgcattatggaaaaa

SEQ ID NO: 42143 - DNA, 21 bp, Artificial sequence
  SiRNA target sequence
acgtttgcattatggaaaaat

SEQ ID NO: 42144 - DNA, 21 bp, Artificial sequence
  SiRNA target sequence
cgtttgcattatggaaaaatt

SEQ ID NO: 42145 - DNA, 21 bp, Artificial sequence
  SiRNA target sequence
gtttgcattatggaaaaattt

SEQ ID NO: 42146 - DNA, 21 bp, Artificial sequence
  SiRNA target sequence
tttgcattatggaaaaatttg

SEQ ID NO: 42147 - DNA, 21 bp, Artificial sequence
  SiRNA target sequence
ttgcattatggaaaaatttgc

SEQ ID NO: 42148 - DNA, 21 bp, Artificial sequence
  SiRNA target sequence
tgcattatggaaaaatttgca

SEQ ID NO: 42149 - DNA, 21 bp, Artificial sequence
  SiRNA target sequence
gcattatggaaaaatttgcag

SEQ ID NO: 42150 - DNA, 21 bp, Artificial sequence
  SiRNA target sequence
cattatggaaaaatttgcaga

SEQ ID NO: 42151 - DNA, 21 bp, Artificial sequence
  SiRNA target sequence
attatggaaaaatttgcagat

SEQ ID NO: 42152 - DNA, 21 bp, Artificial sequence
  SiRNA target sequence
ttatggaaaaatttgcagatt

SEQ ID NO: 42153 - DNA, 21 bp, Artificial sequence
  SiRNA target sequence
tatggaaaaatttgcagattt

SEQ ID NO: 42154 - DNA, 21 bp, Artificial sequence
  SiRNA target sequence
atggaaaaatttgcagattta

SEQ ID NO: 42155 - DNA, 21 bp, Artificial sequence
  SiRNA target sequence
tggaaaaatttgcagatttag

SEQ ID NO: 42156 - DNA, 21 bp, Artificial sequence
  SiRNA target sequence
ggaaaaatttgcagatttagc

SEQ ID NO: 42157 - DNA, 21 bp, Artificial sequence
  SiRNA target sequence
gaaaaatttgcagatttagct

SEQ ID NO: 42158 - DNA, 21 bp, Artificial sequence
  SiRNA target sequence
aaaaatttgcagatttagcta

SEQ ID NO: 42159 - DNA, 21 bp, Artificial sequence
  SiRNA target sequence
aaaatttgcagatttagctaa

SEQ ID NO: 42160 - DNA, 21 bp, Artificial sequence
  SiRNA target sequence
aaatttgcagatttagctaat

SEQ ID NO: 42161 - DNA, 21 bp, Artificial sequence
  SiRNA target sequence
aatttgcagatttagctaatg

SEQ ID NO: 42162 - DNA, 21 bp, Artificial sequence
  SiRNA target sequence
atttgcagatttagctaatga

SEQ ID NO: 42163 - DNA, 21 bp, Artificial sequence
  SiRNA target sequence
tttgcagatttagctaatgag

SEQ ID NO: 42164 - DNA, 21 bp, Artificial sequence
  SiRNA target sequence
ttgcagatttagctaatgagt

SEQ ID NO: 42165 - DNA, 21 bp, Artificial sequence
  SiRNA target sequence
tgcagatttagctaatgagtt

SEQ ID NO: 42166 - DNA, 21 bp, Artificial sequence
  SiRNA target sequence
gcagatttagctaatgagttt

SEQ ID NO: 42167 - DNA, 21 bp, Artificial sequence
  SiRNA target sequence
cagatttagctaatgagtttt

SEQ ID NO: 42168 - DNA, 21 bp, Artificial sequence
  SiRNA target sequence
agatttagctaatgagtttta

SEQ ID NO: 42169 - DNA, 21 bp, Artificial sequence
  SiRNA target sequence
gatttagctaatgagttttac

SEQ ID NO: 42170 - DNA, 21 bp, Artificial sequence
  SiRNA target sequence
atttagctaatgagttttacg

SEQ ID NO: 42171 - DNA, 21 bp, Artificial sequence
  SiRNA target sequence
tttagctaatgagttttacga

SEQ ID NO: 42172 - DNA, 21 bp, Artificial sequence
  SiRNA target sequence
ttagctaatgagttttacgat

SEQ ID NO: 42173 - DNA, 21 bp, Artificial sequence
  SiRNA target sequence
tagctaatgagttttacgatg

SEQ ID NO: 42174 - DNA, 21 bp, Artificial sequence
  SiRNA target sequence
agctaatgagttttacgatga

SEQ ID NO: 42175 - DNA, 21 bp, Artificial sequence
  SiRNA target sequence
gctaatgagttttacgatgat

SEQ ID NO: 42176 - DNA, 21 bp, Artificial sequence
  SiRNA target sequence
ctaatgagttttacgatgatg

SEQ ID NO: 42177 - DNA, 21 bp, Artificial sequence
  SiRNA target sequence
taatgagttttacgatgatgg

SEQ ID NO: 42178 - DNA, 21 bp, Artificial sequence
  SiRNA target sequence
aatgagttttacgatgatgga

SEQ ID NO: 42179 - DNA, 21 bp, Artificial sequence
  SiRNA target sequence
atgagttttacgatgatggac

SEQ ID NO: 42180 - DNA, 21 bp, Artificial sequence
  SiRNA target sequence
tgagttttacgatgatggacc

SEQ ID NO: 42181 - DNA, 21 bp, Artificial sequence
  SiRNA target sequence
gagttttacgatgatggacca

SEQ ID NO: 42182 - DNA, 21 bp, Artificial sequence
  SiRNA target sequence
agttttacgatgatggaccag

SEQ ID NO: 42183 - DNA, 21 bp, Artificial sequence
  SiRNA target sequence
gttttacgatgatggaccaga

SEQ ID NO: 42184 - DNA, 21 bp, Artificial sequence
  SiRNA target sequence
ttttacgatgatggaccagaa

SEQ ID NO: 42185 - DNA, 21 bp, Artificial sequence
  SiRNA target sequence
tttacgatgatggaccagaaa

SEQ ID NO: 42186 - DNA, 21 bp, Artificial sequence
  SiRNA target sequence
ttacgatgatggaccagaaaa

SEQ ID NO: 42187 - DNA, 21 bp, Artificial sequence
  SiRNA target sequence
tacgatgatggaccagaaaat

SEQ ID NO: 42188 - DNA, 21 bp, Artificial sequence
  SiRNA target sequence
acgatgatggaccagaaaatg

SEQ ID NO: 42189 - DNA, 21 bp, Artificial sequence
  SiRNA target sequence
cgatgatggaccagaaaatgc

SEQ ID NO: 42190 - DNA, 21 bp, Artificial sequence
  SiRNA target sequence
gatgatggaccagaaaatgct

SEQ ID NO: 42191 - DNA, 21 bp, Artificial sequence
  SiRNA target sequence
atgatggaccagaaaatgctt

SEQ ID NO: 42192 - DNA, 21 bp, Artificial sequence
  SiRNA target sequence
tgatggaccagaaaatgcttt

SEQ ID NO: 42193 - DNA, 21 bp, Artificial sequence
  SiRNA target sequence
gatggaccagaaaatgctttg

SEQ ID NO: 42194 - DNA, 21 bp, Artificial sequence
  SiRNA target sequence
atggaccagaaaatgctttga

SEQ ID NO: 42195 - DNA, 21 bp, Artificial sequence
  SiRNA target sequence
tggaccagaaaatgctttgat

SEQ ID NO: 42196 - DNA, 21 bp, Artificial sequence
  SiRNA target sequence
ggaccagaaaatgctttgatc

SEQ ID NO: 42197 - DNA, 21 bp, Artificial sequence
  SiRNA target sequence
gaccagaaaatgctttgatcc

SEQ ID NO: 42198 - DNA, 21 bp, Artificial sequence
  SiRNA target sequence
accagaaaatgctttgatccg

SEQ ID NO: 42199 - DNA, 21 bp, Artificial sequence
  SiRNA target sequence
ccagaaaatgctttgatccgt

SEQ ID NO: 42200 - DNA, 21 bp, Artificial sequence
  SiRNA target sequence
cagaaaatgctttgatccgtc

SEQ ID NO: 42201 - DNA, 21 bp, Artificial sequence
  SiRNA target sequence
agaaaatgctttgatccgtca

SEQ ID NO: 42202 - DNA, 21 bp, Artificial sequence
  SiRNA target sequence
gaaaatgctttgatccgtcat

SEQ ID NO: 42203 - DNA, 21 bp, Artificial sequence
  SiRNA target sequence
aaaatgctttgatccgtcatg

SEQ ID NO: 42204 - DNA, 21 bp, Artificial sequence
  SiRNA target sequence
aaatgctttgatccgtcatgt

SEQ ID NO: 42205 - DNA, 21 bp, Artificial sequence
  SiRNA target sequence
aatgctttgatccgtcatgta

SEQ ID NO: 42206 - DNA, 21 bp, Artificial sequence
  SiRNA target sequence
atgctttgatccgtcatgtat

SEQ ID NO: 42207 - DNA, 21 bp, Artificial sequence
  SiRNA target sequence
tgctttgatccgtcatgtatt

SEQ ID NO: 42208 - DNA, 21 bp, Artificial sequence
  SiRNA target sequence
gctttgatccgtcatgtatta

SEQ ID NO: 42209 - DNA, 21 bp, Artificial sequence
  SiRNA target sequence
ctttgatccgtcatgtattat

SEQ ID NO: 42210 - DNA, 21 bp, Artificial sequence
  SiRNA target sequence
tttgatccgtcatgtattatt

SEQ ID NO: 42211 - DNA, 21 bp, Artificial sequence
  SiRNA target sequence
ttgatccgtcatgtattattg

SEQ ID NO: 42212 - DNA, 21 bp, Artificial sequence
  SiRNA target sequence
tgatccgtcatgtattattgg

SEQ ID NO: 42213 - DNA, 21 bp, Artificial sequence
  SiRNA target sequence
gatccgtcatgtattattggt

SEQ ID NO: 42214 - DNA, 21 bp, Artificial sequence
  SiRNA target sequence
atccgtcatgtattattggtg

SEQ ID NO: 42215 - DNA, 21 bp, Artificial sequence
  SiRNA target sequence
tccgtcatgtattattggtgg

SEQ ID NO: 42216 - DNA, 21 bp, Artificial sequence
  SiRNA target sequence
ccgtcatgtattattggtgga

SEQ ID NO: 42217 - DNA, 21 bp, Artificial sequence
  SiRNA target sequence
cgtcatgtattattggtggat

SEQ ID NO: 42218 - DNA, 21 bp, Artificial sequence
  SiRNA target sequence
gtcatgtattattggtggatg

SEQ ID NO: 42219 - DNA, 21 bp, Artificial sequence
  SiRNA target sequence
tcatgtattattggtggatgt

SEQ ID NO: 42220 - DNA, 21 bp, Artificial sequence
  SiRNA target sequence
catgtattattggtggatgtg

SEQ ID NO: 42221 - DNA, 21 bp, Artificial sequence
  SiRNA target sequence
atgtattattggtggatgtgt

SEQ ID NO: 42222 - DNA, 21 bp, Artificial sequence
  SiRNA target sequence
tgtattattggtggatgtgta

SEQ ID NO: 42223 - DNA, 21 bp, Artificial sequence
  SiRNA target sequence
gtattattggtggatgtgtac

SEQ ID NO: 42224 - DNA, 21 bp, Artificial sequence
  SiRNA target sequence
tattattggtggatgtgtaca

SEQ ID NO: 42225 - DNA, 21 bp, Artificial sequence
  SiRNA target sequence
attattggtggatgtgtacaa

SEQ ID NO: 42226 - DNA, 21 bp, Artificial sequence
  SiRNA target sequence
ttattggtggatgtgtacaat

SEQ ID NO: 42227 - DNA, 21 bp, Artificial sequence
  SiRNA target sequence
tattggtggatgtgtacaatt

SEQ ID NO: 42228 - DNA, 21 bp, Artificial sequence
  SiRNA target sequence
attggtggatgtgtacaattc

SEQ ID NO: 42229 - DNA, 21 bp, Artificial sequence
  SiRNA target sequence
ttggtggatgtgtacaattct

SEQ ID NO: 42230 - DNA, 21 bp, Artificial sequence
  SiRNA target sequence
tggtggatgtgtacaattctg

SEQ ID NO: 42231 - DNA, 21 bp, Artificial sequence
  SiRNA target sequence
ggtggatgtgtacaattctgt

SEQ ID NO: 42232 - DNA, 21 bp, Artificial sequence
  SiRNA target sequence
gtggatgtgtacaattctgtg

SEQ ID NO: 42233 - DNA, 21 bp, Artificial sequence
  SiRNA target sequence
tggatgtgtacaattctgtgc

SEQ ID NO: 42234 - DNA, 21 bp, Artificial sequence
  SiRNA target sequence
ggatgtgtacaattctgtgca

SEQ ID NO: 42235 - DNA, 21 bp, Artificial sequence
  SiRNA target sequence
gatgtgtacaattctgtgcat

SEQ ID NO: 42236 - DNA, 21 bp, Artificial sequence
  SiRNA target sequence
atgtgtacaattctgtgcata

SEQ ID NO: 42237 - DNA, 21 bp, Artificial sequence
  SiRNA target sequence
tgtgtacaattctgtgcatat

SEQ ID NO: 42238 - DNA, 21 bp, Artificial sequence
  SiRNA target sequence
gtgtacaattctgtgcatatt

SEQ ID NO: 42239 - DNA, 21 bp, Artificial sequence
  SiRNA target sequence
tgtacaattctgtgcatattt

SEQ ID NO: 42240 - DNA, 21 bp, Artificial sequence
  SiRNA target sequence
gtacaattctgtgcatatttg

SEQ ID NO: 42241 - DNA, 21 bp, Artificial sequence
  SiRNA target sequence
tacaattctgtgcatatttgt

SEQ ID NO: 42242 - DNA, 21 bp, Artificial sequence
  SiRNA target sequence
acaattctgtgcatatttgta

SEQ ID NO: 42243 - DNA, 21 bp, Artificial sequence
  SiRNA target sequence
caattctgtgcatatttgtaa

SEQ ID NO: 42244 - DNA, 21 bp, Artificial sequence
  SiRNA target sequence
aattctgtgcatatttgtaat

SEQ ID NO: 42245 - DNA, 21 bp, Artificial sequence
  SiRNA target sequence
attctgtgcatatttgtaatg

SEQ ID NO: 42246 - DNA, 21 bp, Artificial sequence
  SiRNA target sequence
ttctgtgcatatttgtaatga

SEQ ID NO: 42247 - DNA, 21 bp, Artificial sequence
  SiRNA target sequence
tctgtgcatatttgtaatgac

SEQ ID NO: 42248 - DNA, 21 bp, Artificial sequence
  SiRNA target sequence
ctgtgcatatttgtaatgact

SEQ ID NO: 42249 - DNA, 21 bp, Artificial sequence
  SiRNA target sequence
tgtgcatatttgtaatgactc

SEQ ID NO: 42250 - DNA, 21 bp, Artificial sequence
  SiRNA target sequence
gtgcatatttgtaatgactca

SEQ ID NO: 42251 - DNA, 21 bp, Artificial sequence
  SiRNA target sequence
tgcatatttgtaatgactcag

SEQ ID NO: 42252 - DNA, 21 bp, Artificial sequence
  SiRNA target sequence
gcatatttgtaatgactcagt

SEQ ID NO: 42253 - DNA, 21 bp, Artificial sequence
  SiRNA target sequence
catatttgtaatgactcagta

SEQ ID NO: 42254 - DNA, 21 bp, Artificial sequence
  SiRNA target sequence
atatttgtaatgactcagtat

SEQ ID NO: 42255 - DNA, 21 bp, Artificial sequence
  SiRNA target sequence
tatttgtaatgactcagtata

SEQ ID NO: 42256 - DNA, 21 bp, Artificial sequence
  SiRNA target sequence
atttgtaatgactcagtatac

SEQ ID NO: 42257 - DNA, 21 bp, Artificial sequence
  SiRNA target sequence
tttgtaatgactcagtataca

SEQ ID NO: 42258 - DNA, 21 bp, Artificial sequence
  SiRNA target sequence
ttgtaatgactcagtatacat

SEQ ID NO: 42259 - DNA, 21 bp, Artificial sequence
  SiRNA target sequence
tgtaatgactcagtatacatg

SEQ ID NO: 42260 - DNA, 21 bp, Artificial sequence
  SiRNA target sequence
gtaatgactcagtatacatga

SEQ ID NO: 42261 - DNA, 21 bp, Artificial sequence
  SiRNA target sequence
taatgactcagtatacatgat

SEQ ID NO: 42262 - DNA, 21 bp, Artificial sequence
  SiRNA target sequence
aatgactcagtatacatgatg

SEQ ID NO: 42263 - DNA, 21 bp, Artificial sequence
  SiRNA target sequence
atgactcagtatacatgatga

SEQ ID NO: 42264 - DNA, 21 bp, Artificial sequence
  SiRNA target sequence
tgactcagtatacatgatgac

SEQ ID NO: 42265 - DNA, 21 bp, Artificial sequence
  SiRNA target sequence
gactcagtatacatgatgact

SEQ ID NO: 42266 - DNA, 21 bp, Artificial sequence
  SiRNA target sequence
actcagtatacatgatgactc

SEQ ID NO: 42267 - DNA, 21 bp, Artificial sequence
  SiRNA target sequence
ctcagtatacatgatgactca

SEQ ID NO: 42268 - DNA, 21 bp, Artificial sequence
  SiRNA target sequence
tcagtatacatgatgactcat

SEQ ID NO: 42269 - DNA, 21 bp, Artificial sequence
  SiRNA target sequence
cagtatacatgatgactcata

SEQ ID NO: 42270 - DNA, 21 bp, Artificial sequence
  SiRNA target sequence
agtatacatgatgactcatag

SEQ ID NO: 42271 - DNA, 21 bp, Artificial sequence
  SiRNA target sequence
gtatacatgatgactcatagc

SEQ ID NO: 42272 - DNA, 21 bp, Artificial sequence
  SiRNA target sequence
tatacatgatgactcatagcc

SEQ ID NO: 42273 - DNA, 21 bp, Artificial sequence
  SiRNA target sequence
atacatgatgactcatagcca

SEQ ID NO: 42274 - DNA, 21 bp, Artificial sequence
  SiRNA target sequence
tacatgatgactcatagccaa

SEQ ID NO: 42275 - DNA, 21 bp, Artificial sequence
  SiRNA target sequence
acatgatgactcatagccaac

SEQ ID NO: 42276 - DNA, 21 bp, Artificial sequence
  SiRNA target sequence
catgatgactcatagccaacc

SEQ ID NO: 42277 - DNA, 21 bp, Artificial sequence
  SiRNA target sequence
atgatgactcatagccaaccc

SEQ ID NO: 42278 - DNA, 21 bp, Artificial sequence
  SiRNA target sequence
tgatgactcatagccaaccca

SEQ ID NO: 42279 - DNA, 21 bp, Artificial sequence
  SiRNA target sequence
gatgactcatagccaacccac

SEQ ID NO: 42280 - DNA, 21 bp, Artificial sequence
  SiRNA target sequence
atgactcatagccaacccaca

SEQ ID NO: 42281 - DNA, 21 bp, Artificial sequence
  SiRNA target sequence
tacgtacaattttgacgcttc

SEQ ID NO: 42282 - DNA, 21 bp, Artificial sequence
  SiRNA target sequence
acgtacaattttgacgcttcg

SEQ ID NO: 42283 - DNA, 21 bp, Artificial sequence
  SiRNA target sequence
cgtacaattttgacgcttcgt

SEQ ID NO: 42284 - DNA, 21 bp, Artificial sequence
  SiRNA target sequence
gtacaattttgacgcttcgtt

SEQ ID NO: 42285 - DNA, 21 bp, Artificial sequence
  SiRNA target sequence
tacaattttgacgcttcgttc

SEQ ID NO: 42286 - DNA, 21 bp, Artificial sequence
  SiRNA target sequence
acaattttgacgcttcgttca

SEQ ID NO: 42287 - DNA, 21 bp, Artificial sequence
  SiRNA target sequence
caattttgacgcttcgttcat

SEQ ID NO: 42288 - DNA, 21 bp, Artificial sequence
  SiRNA target sequence
aattttgacgcttcgttcatg

SEQ ID NO: 42289 - DNA, 21 bp, Artificial sequence
  SiRNA target sequence
attttgacgcttcgttcatgc

SEQ ID NO: 42290 - DNA, 21 bp, Artificial sequence
  SiRNA target sequence
ttttgacgcttcgttcatgca

SEQ ID NO: 42291 - DNA, 21 bp, Artificial sequence
  SiRNA target sequence
tttgacgcttcgttcatgcaa

SEQ ID NO: 42292 - DNA, 21 bp, Artificial sequence
  SiRNA target sequence
ttgacgcttcgttcatgcaac

SEQ ID NO: 42293 - DNA, 21 bp, Artificial sequence
  SiRNA target sequence
tgacgcttcgttcatgcaaca

SEQ ID NO: 42294 - DNA, 21 bp, Artificial sequence
  SiRNA target sequence
gacgcttcgttcatgcaacaa

SEQ ID NO: 42295 - DNA, 21 bp, Artificial sequence
  SiRNA target sequence
acgcttcgttcatgcaacaat

SEQ ID NO: 42296 - DNA, 21 bp, Artificial sequence
  SiRNA target sequence
cgcttcgttcatgcaacaatg

SEQ ID NO: 42297 - DNA, 21 bp, Artificial sequence
  SiRNA target sequence
gcttcgttcatgcaacaatga

SEQ ID NO: 42298 - DNA, 21 bp, Artificial sequence
  SiRNA target sequence
cttcgttcatgcaacaatgaa

SEQ ID NO: 42299 - DNA, 21 bp, Artificial sequence
  SiRNA target sequence
ttcgttcatgcaacaatgaac

SEQ ID NO: 42300 - DNA, 21 bp, Artificial sequence
  SiRNA target sequence
tcgttcatgcaacaatgaact

SEQ ID NO: 42301 - DNA, 21 bp, Artificial sequence
  SiRNA target sequence
cgttcatgcaacaatgaactc

SEQ ID NO: 42302 - DNA, 21 bp, Artificial sequence
  SiRNA target sequence
gttcatgcaacaatgaactca

SEQ ID NO: 42303 - DNA, 21 bp, Artificial sequence
  SiRNA target sequence
ttcatgcaacaatgaactcac

SEQ ID NO: 42304 - DNA, 21 bp, Artificial sequence
  SiRNA target sequence
tcatgcaacaatgaactcaca

SEQ ID NO: 42305 - DNA, 21 bp, Artificial sequence
  SiRNA target sequence
catgcaacaatgaactcacat

SEQ ID NO: 42306 - DNA, 21 bp, Artificial sequence
  SiRNA target sequence
atgcaacaatgaactcacatg

SEQ ID NO: 42307 - DNA, 21 bp, Artificial sequence
  SiRNA target sequence
tgcaacaatgaactcacatgt

SEQ ID NO: 42308 - DNA, 21 bp, Artificial sequence
  SiRNA target sequence
gcaacaatgaactcacatgtg

SEQ ID NO: 42309 - DNA, 21 bp, Artificial sequence
  SiRNA target sequence
caacaatgaactcacatgtgg

SEQ ID NO: 42310 - DNA, 21 bp, Artificial sequence
  SiRNA target sequence
aacaatgaactcacatgtggc

SEQ ID NO: 42311 - DNA, 21 bp, Artificial sequence
  SiRNA target sequence
acaatgaactcacatgtggcg

SEQ ID NO: 42312 - DNA, 21 bp, Artificial sequence
  SiRNA target sequence
caatgaactcacatgtggcgc

SEQ ID NO: 42313 - DNA, 21 bp, Artificial sequence
  SiRNA target sequence
aatgaactcacatgtggcgct

SEQ ID NO: 42314 - DNA, 21 bp, Artificial sequence
  SiRNA target sequence
atgaactcacatgtggcgctc

SEQ ID NO: 42315 - DNA, 21 bp, Artificial sequence
  SiRNA target sequence
tgaactcacatgtggcgctcg

SEQ ID NO: 42316 - DNA, 21 bp, Artificial sequence
  SiRNA target sequence
gaactcacatgtggcgctcgg

SEQ ID NO: 42317 - DNA, 21 bp, Artificial sequence
  SiRNA target sequence
aactcacatgtggcgctcggt

SEQ ID NO: 42318 - DNA, 21 bp, Artificial sequence
  SiRNA target sequence
actcacatgtggcgctcggta

SEQ ID NO: 42319 - DNA, 21 bp, Artificial sequence
  SiRNA target sequence
ctcacatgtggcgctcggtag

SEQ ID NO: 42320 - DNA, 21 bp, Artificial sequence
  SiRNA target sequence
tcacatgtggcgctcggtagt

SEQ ID NO: 42321 - DNA, 21 bp, Artificial sequence
  SiRNA target sequence
cacatgtggcgctcggtagta

SEQ ID NO: 42322 - DNA, 21 bp, Artificial sequence
  SiRNA target sequence
acatgtggcgctcggtagtaa

SEQ ID NO: 42323 - DNA, 21 bp, Artificial sequence
  SiRNA target sequence
catgtggcgctcggtagtaac

SEQ ID NO: 42324 - DNA, 21 bp, Artificial sequence
  SiRNA target sequence
atgtggcgctcggtagtaacc

SEQ ID NO: 42325 - DNA, 21 bp, Artificial sequence
  SiRNA target sequence
tgtggcgctcggtagtaacca

SEQ ID NO: 42326 - DNA, 21 bp, Artificial sequence
  SiRNA target sequence
gtggcgctcggtagtaaccag

SEQ ID NO: 42327 - DNA, 21 bp, Artificial sequence
  SiRNA target sequence
tggcgctcggtagtaaccaga

SEQ ID NO: 42328 - DNA, 21 bp, Artificial sequence
  SiRNA target sequence
ggcgctcggtagtaaccagag

SEQ ID NO: 42329 - DNA, 21 bp, Artificial sequence
  SiRNA target sequence
gcgctcggtagtaaccagagg

SEQ ID NO: 42330 - DNA, 21 bp, Artificial sequence
  SiRNA target sequence
cgctcggtagtaaccagaggg

SEQ ID NO: 42331 - DNA, 21 bp, Artificial sequence
  SiRNA target sequence
gctcggtagtaaccagagggg

SEQ ID NO: 42332 - DNA, 21 bp, Artificial sequence
  SiRNA target sequence
ctcggtagtaaccagaggggc

SEQ ID NO: 42333 - DNA, 21 bp, Artificial sequence
  SiRNA target sequence
tcggtagtaaccagaggggcg

SEQ ID NO: 42334 - DNA, 21 bp, Artificial sequence
  SiRNA target sequence
cggtagtaaccagaggggcgt

SEQ ID NO: 42335 - DNA, 21 bp, Artificial sequence
  SiRNA target sequence
ggtagtaaccagaggggcgtc

SEQ ID NO: 42336 - DNA, 21 bp, Artificial sequence
  SiRNA target sequence
gtagtaaccagaggggcgtca

SEQ ID NO: 42337 - DNA, 21 bp, Artificial sequence
  SiRNA target sequence
tagtaaccagaggggcgtcat

SEQ ID NO: 42338 - DNA, 21 bp, Artificial sequence
  SiRNA target sequence
agtaaccagaggggcgtcatt

SEQ ID NO: 42339 - DNA, 21 bp, Artificial sequence
  SiRNA target sequence
gtaaccagaggggcgtcattc

SEQ ID NO: 42340 - DNA, 21 bp, Artificial sequence
  SiRNA target sequence
taaccagaggggcgtcattcc

SEQ ID NO: 42341 - DNA, 21 bp, Artificial sequence
  SiRNA target sequence
aaccagaggggcgtcattccc

SEQ ID NO: 42342 - DNA, 21 bp, Artificial sequence
  SiRNA target sequence
accagaggggcgtcattcccc

SEQ ID NO: 42343 - DNA, 21 bp, Artificial sequence
  SiRNA target sequence
ccagaggggcgtcattccccc

SEQ ID NO: 42344 - DNA, 21 bp, Artificial sequence
  SiRNA target sequence
cagaggggcgtcattcccccg

SEQ ID NO: 42345 - DNA, 21 bp, Artificial sequence
  SiRNA target sequence
agaggggcgtcattcccccgt

SEQ ID NO: 42346 - DNA, 21 bp, Artificial sequence
  SiRNA target sequence
gaggggcgtcattcccccgta

SEQ ID NO: 42347 - DNA, 21 bp, Artificial sequence
  SiRNA target sequence
aggggcgtcattcccccgtat

SEQ ID NO: 42348 - DNA, 21 bp, Artificial sequence
  SiRNA target sequence
ggggcgtcattcccccgtatg

SEQ ID NO: 42349 - DNA, 21 bp, Artificial sequence
  SiRNA target sequence
gggcgtcattcccccgtatgg

SEQ ID NO: 42350 - DNA, 21 bp, Artificial sequence
  SiRNA target sequence
ggcgtcattcccccgtatgga

SEQ ID NO: 42351 - DNA, 21 bp, Artificial sequence
  SiRNA target sequence
gcgtcattcccccgtatggag

SEQ ID NO: 42352 - DNA, 21 bp, Artificial sequence
  SiRNA target sequence
cgtcattcccccgtatggagt

SEQ ID NO: 42353 - DNA, 21 bp, Artificial sequence
  SiRNA target sequence
gtcattcccccgtatggagtg

SEQ ID NO: 42354 - DNA, 21 bp, Artificial sequence
  SiRNA target sequence
tcattcccccgtatggagtgg

SEQ ID NO: 42355 - DNA, 21 bp, Artificial sequence
  SiRNA target sequence
cattcccccgtatggagtgga

SEQ ID NO: 42356 - DNA, 21 bp, Artificial sequence
  SiRNA target sequence
attcccccgtatggagtggag

SEQ ID NO: 42357 - DNA, 21 bp, Artificial sequence
  SiRNA target sequence
ttcccccgtatggagtggaga

SEQ ID NO: 42358 - DNA, 21 bp, Artificial sequence
  SiRNA target sequence
tcccccgtatggagtggagaa

SEQ ID NO: 42359 - DNA, 21 bp, Artificial sequence
  SiRNA target sequence
cccccgtatggagtggagaat

SEQ ID NO: 42360 - DNA, 21 bp, Artificial sequence
  SiRNA target sequence
ccccgtatggagtggagaata

SEQ ID NO: 42361 - DNA, 21 bp, Artificial sequence
  SiRNA target sequence
cccgtatggagtggagaatat

SEQ ID NO: 42362 - DNA, 21 bp, Artificial sequence
  SiRNA target sequence
ccgtatggagtggagaatata

SEQ ID NO: 42363 - DNA, 21 bp, Artificial sequence
  SiRNA target sequence
cgtatggagtggagaatataa

SEQ ID NO: 42364 - DNA, 21 bp, Artificial sequence
  SiRNA target sequence
gtatggagtggagaatataag

SEQ ID NO: 42365 - DNA, 21 bp, Artificial sequence
  SiRNA target sequence
tatggagtggagaatataagc

SEQ ID NO: 42366 - DNA, 21 bp, Artificial sequence
  SiRNA target sequence
atggagtggagaatataagct

SEQ ID NO: 42367 - DNA, 21 bp, Artificial sequence
  SiRNA target sequence
tggagtggagaatataagcta

SEQ ID NO: 42368 - DNA, 21 bp, Artificial sequence
  SiRNA target sequence
ggagtggagaatataagctac

SEQ ID NO: 42369 - DNA, 21 bp, Artificial sequence
  SiRNA target sequence
gagtggagaatataagctacc

SEQ ID NO: 42370 - DNA, 21 bp, Artificial sequence
  SiRNA target sequence
agtggagaatataagctaccg

SEQ ID NO: 42371 - DNA, 21 bp, Artificial sequence
  SiRNA target sequence
gtggagaatataagctaccga

SEQ ID NO: 42372 - DNA, 21 bp, Artificial sequence
  SiRNA target sequence
tggagaatataagctaccgac

SEQ ID NO: 42373 - DNA, 21 bp, Artificial sequence
  SiRNA target sequence
ggagaatataagctaccgact

SEQ ID NO: 42374 - DNA, 21 bp, Artificial sequence
  SiRNA target sequence
gagaatataagctaccgactc

SEQ ID NO: 42375 - DNA, 21 bp, Artificial sequence
  SiRNA target sequence
agaatataagctaccgactcg

SEQ ID NO: 42376 - DNA, 21 bp, Artificial sequence
  SiRNA target sequence
gaatataagctaccgactcga

SEQ ID NO: 42377 - DNA, 21 bp, Artificial sequence
  SiRNA target sequence
aatataagctaccgactcgag

SEQ ID NO: 42378 - DNA, 21 bp, Artificial sequence
  SiRNA target sequence
atataagctaccgactcgagc

SEQ ID NO: 42379 - DNA, 21 bp, Artificial sequence
  SiRNA target sequence
tataagctaccgactcgagct

SEQ ID NO: 42380 - DNA, 21 bp, Artificial sequence
  SiRNA target sequence
ataagctaccgactcgagctg

SEQ ID NO: 42381 - DNA, 21 bp, Artificial sequence
  SiRNA target sequence
taagctaccgactcgagctgt

SEQ ID NO: 42382 - DNA, 21 bp, Artificial sequence
  SiRNA target sequence
aagctaccgactcgagctgta

SEQ ID NO: 42383 - DNA, 21 bp, Artificial sequence
  SiRNA target sequence
agctaccgactcgagctgtag

SEQ ID NO: 42384 - DNA, 21 bp, Artificial sequence
  SiRNA target sequence
gctaccgactcgagctgtaga

SEQ ID NO: 42385 - DNA, 21 bp, Artificial sequence
  SiRNA target sequence
ctaccgactcgagctgtagaa

SEQ ID NO: 42386 - DNA, 21 bp, Artificial sequence
  SiRNA target sequence
taccgactcgagctgtagaat

SEQ ID NO: 42387 - DNA, 21 bp, Artificial sequence
  SiRNA target sequence
accgactcgagctgtagaata

SEQ ID NO: 42388 - DNA, 21 bp, Artificial sequence
  SiRNA target sequence
ccgactcgagctgtagaataa

SEQ ID NO: 42389 - DNA, 21 bp, Artificial sequence
  SiRNA target sequence
cgactcgagctgtagaataat

SEQ ID NO: 42390 - DNA, 21 bp, Artificial sequence
  SiRNA target sequence
gactcgagctgtagaataatt

SEQ ID NO: 42391 - DNA, 21 bp, Artificial sequence
  SiRNA target sequence
actcgagctgtagaataattc

SEQ ID NO: 42392 - DNA, 21 bp, Artificial sequence
  SiRNA target sequence
ctcgagctgtagaataattca

SEQ ID NO: 42393 - DNA, 21 bp, Artificial sequence
  SiRNA target sequence
tcgagctgtagaataattcag

SEQ ID NO: 42394 - DNA, 21 bp, Artificial sequence
  SiRNA target sequence
cgagctgtagaataattcagc

SEQ ID NO: 42395 - DNA, 21 bp, Artificial sequence
  SiRNA target sequence
gagctgtagaataattcagca

SEQ ID NO: 42396 - DNA, 21 bp, Artificial sequence
  SiRNA target sequence
agctgtagaataattcagcaa

SEQ ID NO: 42397 - DNA, 21 bp, Artificial sequence
  SiRNA target sequence
gctgtagaataattcagcaac

SEQ ID NO: 42398 - DNA, 21 bp, Artificial sequence
  SiRNA target sequence
ctgtagaataattcagcaact

SEQ ID NO: 42399 - DNA, 21 bp, Artificial sequence
  SiRNA target sequence
tgtagaataattcagcaactt

SEQ ID NO: 42400 - DNA, 21 bp, Artificial sequence
  SiRNA target sequence
gtagaataattcagcaactta

SEQ ID NO: 42401 - DNA, 21 bp, Artificial sequence
  SiRNA target sequence
tagaataattcagcaacttat

SEQ ID NO: 42402 - DNA, 21 bp, Artificial sequence
  SiRNA target sequence
agaataattcagcaacttata

SEQ ID NO: 42403 - DNA, 21 bp, Artificial sequence
  SiRNA target sequence
gaataattcagcaacttataa

SEQ ID NO: 42404 - DNA, 21 bp, Artificial sequence
  SiRNA target sequence
aataattcagcaacttataac

SEQ ID NO: 42405 - DNA, 21 bp, Artificial sequence
  SiRNA target sequence
ataattcagcaacttataacg

SEQ ID NO: 42406 - DNA, 21 bp, Artificial sequence
  SiRNA target sequence
taattcagcaacttataacga

SEQ ID NO: 42407 - DNA, 21 bp, Artificial sequence
  SiRNA target sequence
aattcagcaacttataacgaa

SEQ ID NO: 42408 - DNA, 21 bp, Artificial sequence
  SiRNA target sequence
attcagcaacttataacgaac

SEQ ID NO: 42409 - DNA, 21 bp, Artificial sequence
  SiRNA target sequence
ttcagcaacttataacgaaca

SEQ ID NO: 42410 - DNA, 21 bp, Artificial sequence
  SiRNA target sequence
tcagcaacttataacgaacac

SEQ ID NO: 42411 - DNA, 21 bp, Artificial sequence
  SiRNA target sequence
cagcaacttataacgaacacg

SEQ ID NO: 42412 - DNA, 21 bp, Artificial sequence
  SiRNA target sequence
agcaacttataacgaacacga

SEQ ID NO: 42413 - DNA, 21 bp, Artificial sequence
  SiRNA target sequence
gcaacttataacgaacacgaa

SEQ ID NO: 42414 - DNA, 21 bp, Artificial sequence
  SiRNA target sequence
caacttataacgaacacgaat

SEQ ID NO: 42415 - DNA, 21 bp, Artificial sequence
  SiRNA target sequence
aacttataacgaacacgaatt

SEQ ID NO: 42416 - DNA, 21 bp, Artificial sequence
  SiRNA target sequence
acttataacgaacacgaattt

SEQ ID NO: 42417 - DNA, 21 bp, Artificial sequence
  SiRNA target sequence
cttataacgaacacgaatttt

SEQ ID NO: 42418 - DNA, 21 bp, Artificial sequence
  SiRNA target sequence
ttataacgaacacgaatttta

SEQ ID NO: 42419 - DNA, 21 bp, Artificial sequence
  SiRNA target sequence
tataacgaacacgaattttag

SEQ ID NO: 42420 - DNA, 21 bp, Artificial sequence
  SiRNA target sequence
ataacgaacacgaattttagt

SEQ ID NO: 42421 - DNA, 21 bp, Artificial sequence
  SiRNA target sequence
taacgaacacgaattttagtc

SEQ ID NO: 42422 - DNA, 21 bp, Artificial sequence
  SiRNA target sequence
aacgaacacgaattttagtcg

SEQ ID NO: 42423 - DNA, 21 bp, Artificial sequence
  SiRNA target sequence
acgaacacgaattttagtcga

SEQ ID NO: 42424 - DNA, 21 bp, Artificial sequence
  SiRNA target sequence
cgaacacgaattttagtcgac

SEQ ID NO: 42425 - DNA, 21 bp, Artificial sequence
  SiRNA target sequence
gaacacgaattttagtcgacg

SEQ ID NO: 42426 - DNA, 21 bp, Artificial sequence
  SiRNA target sequence
aacacgaattttagtcgacga

SEQ ID NO: 42427 - DNA, 21 bp, Artificial sequence
  SiRNA target sequence
acacgaattttagtcgacgaa

SEQ ID NO: 42428 - DNA, 21 bp, Artificial sequence
  SiRNA target sequence
cacgaattttagtcgacgaaa

SEQ ID NO: 42429 - DNA, 21 bp, Artificial sequence
  SiRNA target sequence
acgaattttagtcgacgaaac

SEQ ID NO: 42430 - DNA, 21 bp, Artificial sequence
  SiRNA target sequence
cgaattttagtcgacgaaacc

SEQ ID NO: 42431 - DNA, 21 bp, Artificial sequence
  SiRNA target sequence
gaattttagtcgacgaaacca

SEQ ID NO: 42432 - DNA, 21 bp, Artificial sequence
  SiRNA target sequence
aattttagtcgacgaaaccat

SEQ ID NO: 42433 - DNA, 21 bp, Artificial sequence
  SiRNA target sequence
attttagtcgacgaaaccatt

SEQ ID NO: 42434 - DNA, 21 bp, Artificial sequence
  SiRNA target sequence
ttttagtcgacgaaaccattt

SEQ ID NO: 42435 - DNA, 21 bp, Artificial sequence
  SiRNA target sequence
tttagtcgacgaaaccatttt

SEQ ID NO: 42436 - DNA, 21 bp, Artificial sequence
  SiRNA target sequence
ttagtcgacgaaaccatttta

SEQ ID NO: 42437 - DNA, 21 bp, Artificial sequence
  SiRNA target sequence
tagtcgacgaaaccattttag

SEQ ID NO: 42438 - DNA, 21 bp, Artificial sequence
  SiRNA target sequence
agtcgacgaaaccattttagc

SEQ ID NO: 42439 - DNA, 21 bp, Artificial sequence
  SiRNA target sequence
gtcgacgaaaccattttagcc

SEQ ID NO: 42440 - DNA, 21 bp, Artificial sequence
  SiRNA target sequence
tcgacgaaaccattttagcct

SEQ ID NO: 42441 - DNA, 21 bp, Artificial sequence
  SiRNA target sequence
cgacgaaaccattttagcctt

SEQ ID NO: 42442 - DNA, 21 bp, Artificial sequence
  SiRNA target sequence
gacgaaaccattttagccttt

SEQ ID NO: 42443 - DNA, 21 bp, Artificial sequence
  SiRNA target sequence
acgaaaccattttagccttta

SEQ ID NO: 42444 - DNA, 21 bp, Artificial sequence
  SiRNA target sequence
cgaaaccattttagcctttaa

SEQ ID NO: 42445 - DNA, 21 bp, Artificial sequence
  SiRNA target sequence
gaaaccattttagcctttaat

SEQ ID NO: 42446 - DNA, 21 bp, Artificial sequence
  SiRNA target sequence
aaaccattttagcctttaatt

SEQ ID NO: 42447 - DNA, 21 bp, Artificial sequence
  SiRNA target sequence
aaccattttagcctttaattc

SEQ ID NO: 42448 - DNA, 21 bp, Artificial sequence
  SiRNA target sequence
accattttagcctttaattct

SEQ ID NO: 42449 - DNA, 21 bp, Artificial sequence
  SiRNA target sequence
ccattttagcctttaattcta

SEQ ID NO: 42450 - DNA, 21 bp, Artificial sequence
  SiRNA target sequence
cattttagcctttaattctat

SEQ ID NO: 42451 - DNA, 21 bp, Artificial sequence
  SiRNA target sequence
attttagcctttaattctatg

SEQ ID NO: 42452 - DNA, 21 bp, Artificial sequence
  SiRNA target sequence
ttttagcctttaattctatga

SEQ ID NO: 42453 - DNA, 21 bp, Artificial sequence
  SiRNA target sequence
tttagcctttaattctatgat

SEQ ID NO: 42454 - DNA, 21 bp, Artificial sequence
  SiRNA target sequence
ttagcctttaattctatgatt

SEQ ID NO: 42455 - DNA, 21 bp, Artificial sequence
  SiRNA target sequence
tagcctttaattctatgattt

SEQ ID NO: 42456 - DNA, 21 bp, Artificial sequence
  SiRNA target sequence
agcctttaattctatgatttg

SEQ ID NO: 42457 - DNA, 21 bp, Artificial sequence
  SiRNA target sequence
gcctttaattctatgatttga

SEQ ID NO: 42458 - DNA, 21 bp, Artificial sequence
  SiRNA target sequence
cctttaattctatgatttgat

SEQ ID NO: 42459 - DNA, 21 bp, Artificial sequence
  SiRNA target sequence
ctttaattctatgatttgatt

SEQ ID NO: 42460 - DNA, 21 bp, Artificial sequence
  SiRNA target sequence
tttaattctatgatttgatta

SEQ ID NO: 42461 - DNA, 21 bp, Artificial sequence
  SiRNA target sequence
ttaattctatgatttgattat

SEQ ID NO: 42462 - DNA, 21 bp, Artificial sequence
  SiRNA target sequence
taattctatgatttgattata

SEQ ID NO: 42463 - DNA, 21 bp, Artificial sequence
  SiRNA target sequence
aattctatgatttgattataa

SEQ ID NO: 42464 - DNA, 21 bp, Artificial sequence
  SiRNA target sequence
attctatgatttgattataat

SEQ ID NO: 42465 - DNA, 21 bp, Artificial sequence
  SiRNA target sequence
ttctatgatttgattataatg

SEQ ID NO: 42466 - DNA, 21 bp, Artificial sequence
  SiRNA target sequence
tctatgatttgattataatga

SEQ ID NO: 42467 - DNA, 21 bp, Artificial sequence
  SiRNA target sequence
ctatgatttgattataatgat

SEQ ID NO: 42468 - DNA, 21 bp, Artificial sequence
  SiRNA target sequence
tatgatttgattataatgata

SEQ ID NO: 42469 - DNA, 21 bp, Artificial sequence
  SiRNA target sequence
atgatttgattataatgataa

SEQ ID NO: 42470 - DNA, 21 bp, Artificial sequence
  SiRNA target sequence
tgatttgattataatgataaa

SEQ ID NO: 42471 - DNA, 21 bp, Artificial sequence
  SiRNA target sequence
gatttgattataatgataaac

SEQ ID NO: 42472 - DNA, 21 bp, Artificial sequence
  SiRNA target sequence
atttgattataatgataaaca

SEQ ID NO: 42473 - DNA, 21 bp, Artificial sequence
  SiRNA target sequence
tttgattataatgataaacag

SEQ ID NO: 42474 - DNA, 21 bp, Artificial sequence
  SiRNA target sequence
ttgattataatgataaacagc

SEQ ID NO: 42475 - DNA, 21 bp, Artificial sequence
  SiRNA target sequence
tgattataatgataaacagct

SEQ ID NO: 42476 - DNA, 21 bp, Artificial sequence
  SiRNA target sequence
gattataatgataaacagctc

SEQ ID NO: 42477 - DNA, 21 bp, Artificial sequence
  SiRNA target sequence
attataatgataaacagctca

SEQ ID NO: 42478 - DNA, 21 bp, Artificial sequence
  SiRNA target sequence
ttataatgataaacagctcat

SEQ ID NO: 42479 - DNA, 21 bp, Artificial sequence
  SiRNA target sequence
tataatgataaacagctcatg

SEQ ID NO: 42480 - DNA, 21 bp, Artificial sequence
  SiRNA target sequence
ataatgataaacagctcatgt

SEQ ID NO: 42481 - DNA, 21 bp, Artificial sequence
  SiRNA target sequence
taatgataaacagctcatgta

SEQ ID NO: 42482 - DNA, 21 bp, Artificial sequence
  SiRNA target sequence
aatgataaacagctcatgtaa

SEQ ID NO: 42483 - DNA, 21 bp, Artificial sequence
  SiRNA target sequence
atgataaacagctcatgtaac

SEQ ID NO: 42484 - DNA, 21 bp, Artificial sequence
  SiRNA target sequence
tgataaacagctcatgtaact

SEQ ID NO: 42485 - DNA, 21 bp, Artificial sequence
  SiRNA target sequence
gataaacagctcatgtaactg

SEQ ID NO: 42486 - DNA, 21 bp, Artificial sequence
  SiRNA target sequence
ataaacagctcatgtaactgt

SEQ ID NO: 42487 - DNA, 21 bp, Artificial sequence
  SiRNA target sequence
taaacagctcatgtaactgtc

SEQ ID NO: 42488 - DNA, 21 bp, Artificial sequence
  SiRNA target sequence
aaacagctcatgtaactgtct

SEQ ID NO: 42489 - DNA, 21 bp, Artificial sequence
  SiRNA target sequence
aacagctcatgtaactgtcta

SEQ ID NO: 42490 - DNA, 21 bp, Artificial sequence
  SiRNA target sequence
acagctcatgtaactgtctaa

SEQ ID NO: 42491 - DNA, 21 bp, Artificial sequence
  SiRNA target sequence
cagctcatgtaactgtctaaa

SEQ ID NO: 42492 - DNA, 21 bp, Artificial sequence
  SiRNA target sequence
agctcatgtaactgtctaaac

SEQ ID NO: 42493 - DNA, 21 bp, Artificial sequence
  SiRNA target sequence
gctcatgtaactgtctaaact

SEQ ID NO: 42494 - DNA, 21 bp, Artificial sequence
  SiRNA target sequence
ctcatgtaactgtctaaacta

SEQ ID NO: 42495 - DNA, 21 bp, Artificial sequence
  SiRNA target sequence
tcatgtaactgtctaaactac

SEQ ID NO: 42496 - DNA, 21 bp, Artificial sequence
  SiRNA target sequence
catgtaactgtctaaactaca

SEQ ID NO: 42497 - DNA, 21 bp, Artificial sequence
  SiRNA target sequence
atgtaactgtctaaactacat

SEQ ID NO: 42498 - DNA, 21 bp, Artificial sequence
  SiRNA target sequence
tgtaactgtctaaactacata

SEQ ID NO: 42499 - DNA, 21 bp, Artificial sequence
  SiRNA target sequence
gtaactgtctaaactacataa

SEQ ID NO: 42500 - DNA, 21 bp, Artificial sequence
  SiRNA target sequence
taactgtctaaactacataaa

SEQ ID NO: 42501 - DNA, 21 bp, Artificial sequence
  SiRNA target sequence
aactgtctaaactacataaat

SEQ ID NO: 42502 - DNA, 21 bp, Artificial sequence
  SiRNA target sequence
actgtctaaactacataaata

SEQ ID NO: 42503 - DNA, 21 bp, Artificial sequence
  SiRNA target sequence
ctgtctaaactacataaatac

SEQ ID NO: 42504 - DNA, 21 bp, Artificial sequence
  SiRNA target sequence
tgtctaaactacataaataca

SEQ ID NO: 42505 - DNA, 21 bp, Artificial sequence
  SiRNA target sequence
gtctaaactacataaatacaa

SEQ ID NO: 42506 - DNA, 21 bp, Artificial sequence
  SiRNA target sequence
tctaaactacataaatacaac

SEQ ID NO: 42507 - DNA, 21 bp, Artificial sequence
  SiRNA target sequence
ctaaactacataaatacaact

SEQ ID NO: 42508 - DNA, 21 bp, Artificial sequence
  SiRNA target sequence
taaactacataaatacaactg

SEQ ID NO: 42509 - DNA, 21 bp, Artificial sequence
  SiRNA target sequence
aaactacataaatacaactgg

SEQ ID NO: 42510 - DNA, 21 bp, Artificial sequence
  SiRNA target sequence
aactacataaatacaactgga

SEQ ID NO: 42511 - DNA, 21 bp, Artificial sequence
  SiRNA target sequence
actacataaatacaactggat

SEQ ID NO: 42512 - DNA, 21 bp, Artificial sequence
  SiRNA target sequence
ctacataaatacaactggatt

SEQ ID NO: 42513 - DNA, 21 bp, Artificial sequence
  SiRNA target sequence
tacataaatacaactggatta

SEQ ID NO: 42514 - DNA, 21 bp, Artificial sequence
  SiRNA target sequence
acataaatacaactggattac

SEQ ID NO: 42515 - DNA, 21 bp, Artificial sequence
  SiRNA target sequence
cataaatacaactggattacg

SEQ ID NO: 42516 - DNA, 21 bp, Artificial sequence
  SiRNA target sequence
ataaatacaactggattacga

SEQ ID NO: 42517 - DNA, 21 bp, Artificial sequence
  SiRNA target sequence
taaatacaactggattacgaa

SEQ ID NO: 42518 - DNA, 21 bp, Artificial sequence
  SiRNA target sequence
aaatacaactggattacgaac

SEQ ID NO: 42519 - DNA, 21 bp, Artificial sequence
  SiRNA target sequence
aatacaactggattacgaacc

SEQ ID NO: 42520 - DNA, 21 bp, Artificial sequence
  SiRNA target sequence
atacaactggattacgaacct

SEQ ID NO: 42521 - DNA, 21 bp, Artificial sequence
  SiRNA target sequence
tacaactggattacgaacctt

SEQ ID NO: 42522 - DNA, 21 bp, Artificial sequence
  SiRNA target sequence
acaactggattacgaaccttt

SEQ ID NO: 42523 - DNA, 21 bp, Artificial sequence
  SiRNA target sequence
caactggattacgaaccttta

SEQ ID NO: 42524 - DNA, 21 bp, Artificial sequence
  SiRNA target sequence
aactggattacgaacctttaa

SEQ ID NO: 42525 - DNA, 21 bp, Artificial sequence
  SiRNA target sequence
actggattacgaacctttaag

SEQ ID NO: 42526 - DNA, 21 bp, Artificial sequence
  SiRNA target sequence
ctggattacgaacctttaagt

SEQ ID NO: 42527 - DNA, 21 bp, Artificial sequence
  SiRNA target sequence
tggattacgaacctttaagta

SEQ ID NO: 42528 - DNA, 21 bp, Artificial sequence
  SiRNA target sequence
ggattacgaacctttaagtaa

SEQ ID NO: 42529 - DNA, 21 bp, Artificial sequence
  SiRNA target sequence
gattacgaacctttaagtaac

SEQ ID NO: 42530 - DNA, 21 bp, Artificial sequence
  SiRNA target sequence
attacgaacctttaagtaact

SEQ ID NO: 42531 - DNA, 21 bp, Artificial sequence
  SiRNA target sequence
ttacgaacctttaagtaacta

SEQ ID NO: 42532 - DNA, 21 bp, Artificial sequence
  SiRNA target sequence
tacgaacctttaagtaactat

SEQ ID NO: 42533 - DNA, 21 bp, Artificial sequence
  SiRNA target sequence
acgaacctttaagtaactatc

SEQ ID NO: 42534 - DNA, 21 bp, Artificial sequence
  SiRNA target sequence
cgaacctttaagtaactatct

SEQ ID NO: 42535 - DNA, 21 bp, Artificial sequence
  SiRNA target sequence
gaacctttaagtaactatctt

SEQ ID NO: 42536 - DNA, 21 bp, Artificial sequence
  SiRNA target sequence
aacctttaagtaactatctta

SEQ ID NO: 42537 - DNA, 21 bp, Artificial sequence
  SiRNA target sequence
acctttaagtaactatcttag

SEQ ID NO: 42538 - DNA, 21 bp, Artificial sequence
  SiRNA target sequence
cctttaagtaactatcttaga

SEQ ID NO: 42539 - DNA, 21 bp, Artificial sequence
  SiRNA target sequence
ctttaagtaactatcttagat

SEQ ID NO: 42540 - DNA, 21 bp, Artificial sequence
  SiRNA target sequence
tttaagtaactatcttagatg

SEQ ID NO: 42541 - DNA, 21 bp, Artificial sequence
  SiRNA target sequence
ttaagtaactatcttagatga

SEQ ID NO: 42542 - DNA, 21 bp, Artificial sequence
  SiRNA target sequence
taagtaactatcttagatgaa

SEQ ID NO: 42543 - DNA, 21 bp, Artificial sequence
  SiRNA target sequence
aagtaactatcttagatgaag

SEQ ID NO: 42544 - DNA, 21 bp, Artificial sequence
  SiRNA target sequence
agtaactatcttagatgaagt

SEQ ID NO: 42545 - DNA, 21 bp, Artificial sequence
  SiRNA target sequence
gtaactatcttagatgaagtc

SEQ ID NO: 42546 - DNA, 21 bp, Artificial sequence
  SiRNA target sequence
taactatcttagatgaagtct

SEQ ID NO: 42547 - DNA, 21 bp, Artificial sequence
  SiRNA target sequence
aactatcttagatgaagtcta

SEQ ID NO: 42548 - DNA, 21 bp, Artificial sequence
  SiRNA target sequence
actatcttagatgaagtctag

SEQ ID NO: 42549 - DNA, 21 bp, Artificial sequence
  SiRNA target sequence
ctatcttagatgaagtctagt

SEQ ID NO: 42550 - DNA, 21 bp, Artificial sequence
  SiRNA target sequence
tatcttagatgaagtctagta

SEQ ID NO: 42551 - DNA, 21 bp, Artificial sequence
  SiRNA target sequence
atcttagatgaagtctagtag

SEQ ID NO: 42552 - DNA, 21 bp, Artificial sequence
  SiRNA target sequence
tcttagatgaagtctagtagt

SEQ ID NO: 42553 - DNA, 21 bp, Artificial sequence
  SiRNA target sequence
cttagatgaagtctagtagtc

SEQ ID NO: 42554 - DNA, 21 bp, Artificial sequence
  SiRNA target sequence
ttagatgaagtctagtagtct

SEQ ID NO: 42555 - DNA, 21 bp, Artificial sequence
  SiRNA target sequence
tagatgaagtctagtagtctc

SEQ ID NO: 42556 - DNA, 21 bp, Artificial sequence
  SiRNA target sequence
agatgaagtctagtagtctcc

SEQ ID NO: 42557 - DNA, 21 bp, Artificial sequence
  SiRNA target sequence
gatgaagtctagtagtctccc

SEQ ID NO: 42558 - DNA, 21 bp, Artificial sequence
  SiRNA target sequence
atgaagtctagtagtctccca

SEQ ID NO: 42559 - DNA, 21 bp, Artificial sequence
  SiRNA target sequence
tgaagtctagtagtctcccaa

SEQ ID NO: 42560 - DNA, 21 bp, Artificial sequence
  SiRNA target sequence
gaagtctagtagtctcccaat

SEQ ID NO: 42561 - DNA, 21 bp, Artificial sequence
  SiRNA target sequence
aagtctagtagtctcccaata

SEQ ID NO: 42562 - DNA, 21 bp, Artificial sequence
  SiRNA target sequence
agtctagtagtctcccaatat

SEQ ID NO: 42563 - DNA, 21 bp, Artificial sequence
  SiRNA target sequence
gtctagtagtctcccaatatt

SEQ ID NO: 42564 - DNA, 21 bp, Artificial sequence
  SiRNA target sequence
tctagtagtctcccaatattt

SEQ ID NO: 42565 - DNA, 21 bp, Artificial sequence
  SiRNA target sequence
ctagtagtctcccaatatttc

SEQ ID NO: 42566 - DNA, 21 bp, Artificial sequence
  SiRNA target sequence
tagtagtctcccaatatttcc

SEQ ID NO: 42567 - DNA, 21 bp, Artificial sequence
  SiRNA target sequence
agtagtctcccaatatttccg

SEQ ID NO: 42568 - DNA, 21 bp, Artificial sequence
  SiRNA target sequence
gtagtctcccaatatttccgt

SEQ ID NO: 42569 - DNA, 21 bp, Artificial sequence
  SiRNA target sequence
tagtctcccaatatttccgtg

SEQ ID NO: 42570 - DNA, 21 bp, Artificial sequence
  SiRNA target sequence
agtctcccaatatttccgtga

SEQ ID NO: 42571 - DNA, 21 bp, Artificial sequence
  SiRNA target sequence
gtctcccaatatttccgtgaa

SEQ ID NO: 42572 - DNA, 21 bp, Artificial sequence
  SiRNA target sequence
tctcccaatatttccgtgaaa

SEQ ID NO: 42573 - DNA, 21 bp, Artificial sequence
  SiRNA target sequence
ctcccaatatttccgtgaaaa

SEQ ID NO: 42574 - DNA, 21 bp, Artificial sequence
  SiRNA target sequence
tcccaatatttccgtgaaaag

SEQ ID NO: 42575 - DNA, 21 bp, Artificial sequence
  SiRNA target sequence
cccaatatttccgtgaaaaga

SEQ ID NO: 42576 - DNA, 21 bp, Artificial sequence
  SiRNA target sequence
ccaatatttccgtgaaaagaa

SEQ ID NO: 42577 - DNA, 21 bp, Artificial sequence
  SiRNA target sequence
caatatttccgtgaaaagaat

SEQ ID NO: 42578 - DNA, 21 bp, Artificial sequence
  SiRNA target sequence
aatatttccgtgaaaagaatg

SEQ ID NO: 42579 - DNA, 21 bp, Artificial sequence
  SiRNA target sequence
atatttccgtgaaaagaatga

SEQ ID NO: 42580 - DNA, 21 bp, Artificial sequence
  SiRNA target sequence
tatttccgtgaaaagaatgag

SEQ ID NO: 42581 - DNA, 21 bp, Artificial sequence
  SiRNA target sequence
atttccgtgaaaagaatgagg

SEQ ID NO: 42582 - DNA, 21 bp, Artificial sequence
  SiRNA target sequence
tttccgtgaaaagaatgaggg

SEQ ID NO: 42583 - DNA, 21 bp, Artificial sequence
  SiRNA target sequence
ttccgtgaaaagaatgaggga

SEQ ID NO: 42584 - DNA, 21 bp, Artificial sequence
  SiRNA target sequence
tccgtgaaaagaatgagggac

SEQ ID NO: 42585 - DNA, 21 bp, Artificial sequence
  SiRNA target sequence
ccgtgaaaagaatgagggacg

SEQ ID NO: 42586 - DNA, 21 bp, Artificial sequence
  SiRNA target sequence
cgtgaaaagaatgagggacga

SEQ ID NO: 42587 - DNA, 21 bp, Artificial sequence
  SiRNA target sequence
gtgaaaagaatgagggacgag

SEQ ID NO: 42588 - DNA, 21 bp, Artificial sequence
  SiRNA target sequence
tgaaaagaatgagggacgaga

SEQ ID NO: 42589 - DNA, 21 bp, Artificial sequence
  SiRNA target sequence
gaaaagaatgagggacgagat

SEQ ID NO: 42590 - DNA, 21 bp, Artificial sequence
  SiRNA target sequence
aaaagaatgagggacgagata

SEQ ID NO: 42591 - DNA, 21 bp, Artificial sequence
  SiRNA target sequence
aaagaatgagggacgagatag

SEQ ID NO: 42592 - DNA, 21 bp, Artificial sequence
  SiRNA target sequence
aagaatgagggacgagatagc

SEQ ID NO: 42593 - DNA, 21 bp, Artificial sequence
  SiRNA target sequence
agaatgagggacgagatagct

SEQ ID NO: 42594 - DNA, 21 bp, Artificial sequence
  SiRNA target sequence
gaatgagggacgagatagctc

SEQ ID NO: 42595 - DNA, 21 bp, Artificial sequence
  SiRNA target sequence
aatgagggacgagatagctct

SEQ ID NO: 42596 - DNA, 21 bp, Artificial sequence
  SiRNA target sequence
atgagggacgagatagctcta

SEQ ID NO: 42597 - DNA, 21 bp, Artificial sequence
  SiRNA target sequence
tgagggacgagatagctctat

SEQ ID NO: 42598 - DNA, 21 bp, Artificial sequence
  SiRNA target sequence
gagggacgagatagctctatt

SEQ ID NO: 42599 - DNA, 21 bp, Artificial sequence
  SiRNA target sequence
agggacgagatagctctattt

SEQ ID NO: 42600 - DNA, 21 bp, Artificial sequence
  SiRNA target sequence
gggacgagatagctctattta

SEQ ID NO: 42601 - DNA, 21 bp, Artificial sequence
  SiRNA target sequence
ggacgagatagctctatttaa

SEQ ID NO: 42602 - DNA, 21 bp, Artificial sequence
  SiRNA target sequence
gacgagatagctctatttaaa

SEQ ID NO: 42603 - DNA, 21 bp, Artificial sequence
  SiRNA target sequence
acgagatagctctatttaaag

SEQ ID NO: 42604 - DNA, 21 bp, Artificial sequence
  SiRNA target sequence
cgagatagctctatttaaaga

SEQ ID NO: 42605 - DNA, 21 bp, Artificial sequence
  SiRNA target sequence
gagatagctctatttaaagac

SEQ ID NO: 42606 - DNA, 21 bp, Artificial sequence
  SiRNA target sequence
agatagctctatttaaagacg

SEQ ID NO: 42607 - DNA, 21 bp, Artificial sequence
  SiRNA target sequence
gatagctctatttaaagacgt

SEQ ID NO: 42608 - DNA, 21 bp, Artificial sequence
  SiRNA target sequence
atagctctatttaaagacgtg

SEQ ID NO: 42609 - DNA, 21 bp, Artificial sequence
  SiRNA target sequence
tagctctatttaaagacgtga

SEQ ID NO: 42610 - DNA, 21 bp, Artificial sequence
  SiRNA target sequence
agctctatttaaagacgtgag

SEQ ID NO: 42611 - DNA, 21 bp, Artificial sequence
  SiRNA target sequence
gctctatttaaagacgtgagg

SEQ ID NO: 42612 - DNA, 21 bp, Artificial sequence
  SiRNA target sequence
ctctatttaaagacgtgaggc

SEQ ID NO: 42613 - DNA, 21 bp, Artificial sequence
  SiRNA target sequence
tctatttaaagacgtgaggct

SEQ ID NO: 42614 - DNA, 21 bp, Artificial sequence
  SiRNA target sequence
ctatttaaagacgtgaggctt

SEQ ID NO: 42615 - DNA, 21 bp, Artificial sequence
  SiRNA target sequence
tatttaaagacgtgaggcttt

SEQ ID NO: 42616 - DNA, 21 bp, Artificial sequence
  SiRNA target sequence
atttaaagacgtgaggcttta

SEQ ID NO: 42617 - DNA, 21 bp, Artificial sequence
  SiRNA target sequence
tttaaagacgtgaggctttaa

SEQ ID NO: 42618 - DNA, 21 bp, Artificial sequence
  SiRNA target sequence
ttaaagacgtgaggctttaaa

SEQ ID NO: 42619 - DNA, 21 bp, Artificial sequence
  SiRNA target sequence
taaagacgtgaggctttaaat

SEQ ID NO: 42620 - DNA, 21 bp, Artificial sequence
  SiRNA target sequence
aaagacgtgaggctttaaatt

SEQ ID NO: 42621 - DNA, 21 bp, Artificial sequence
  SiRNA target sequence
aagacgtgaggctttaaattc

SEQ ID NO: 42622 - DNA, 21 bp, Artificial sequence
  SiRNA target sequence
agacgtgaggctttaaattct

SEQ ID NO: 42623 - DNA, 21 bp, Artificial sequence
  SiRNA target sequence
gacgtgaggctttaaattctg

SEQ ID NO: 42624 - DNA, 21 bp, Artificial sequence
  SiRNA target sequence
acgtgaggctttaaattctga

SEQ ID NO: 42625 - DNA, 21 bp, Artificial sequence
  SiRNA target sequence
cgtgaggctttaaattctgat

SEQ ID NO: 42626 - DNA, 21 bp, Artificial sequence
  SiRNA target sequence
gtgaggctttaaattctgata

SEQ ID NO: 42627 - DNA, 21 bp, Artificial sequence
  SiRNA target sequence
tgaggctttaaattctgataa

SEQ ID NO: 42628 - DNA, 21 bp, Artificial sequence
  SiRNA target sequence
gaggctttaaattctgataaa

SEQ ID NO: 42629 - DNA, 21 bp, Artificial sequence
  SiRNA target sequence
aggctttaaattctgataaat

SEQ ID NO: 42630 - DNA, 21 bp, Artificial sequence
  SiRNA target sequence
ggctttaaattctgataaata

SEQ ID NO: 42631 - DNA, 21 bp, Artificial sequence
  SiRNA target sequence
gctttaaattctgataaatac

SEQ ID NO: 42632 - DNA, 21 bp, Artificial sequence
  SiRNA target sequence
ctttaaattctgataaataca

SEQ ID NO: 42633 - DNA, 21 bp, Artificial sequence
  SiRNA target sequence
tttaaattctgataaatacat

SEQ ID NO: 42634 - DNA, 21 bp, Artificial sequence
  SiRNA target sequence
ttaaattctgataaatacatt

SEQ ID NO: 42635 - DNA, 21 bp, Artificial sequence
  SiRNA target sequence
taaattctgataaatacatta

SEQ ID NO: 42636 - DNA, 21 bp, Artificial sequence
  SiRNA target sequence
aaattctgataaatacattac

SEQ ID NO: 42637 - DNA, 21 bp, Artificial sequence
  SiRNA target sequence
aattctgataaatacattacc

SEQ ID NO: 42638 - DNA, 21 bp, Artificial sequence
  SiRNA target sequence
attctgataaatacattacct

SEQ ID NO: 42639 - DNA, 21 bp, Artificial sequence
  SiRNA target sequence
ttctgataaatacattacctg

SEQ ID NO: 42640 - DNA, 21 bp, Artificial sequence
  SiRNA target sequence
tctgataaatacattacctga

SEQ ID NO: 42641 - DNA, 21 bp, Artificial sequence
  SiRNA target sequence
ctgataaatacattacctgag

SEQ ID NO: 42642 - DNA, 21 bp, Artificial sequence
  SiRNA target sequence
tgataaatacattacctgaga

SEQ ID NO: 42643 - DNA, 21 bp, Artificial sequence
  SiRNA target sequence
gataaatacattacctgagaa

SEQ ID NO: 42644 - DNA, 21 bp, Artificial sequence
  SiRNA target sequence
ataaatacattacctgagaat

SEQ ID NO: 42645 - DNA, 21 bp, Artificial sequence
  SiRNA target sequence
taaatacattacctgagaatt

SEQ ID NO: 42646 - DNA, 21 bp, Artificial sequence
  SiRNA target sequence
aaatacattacctgagaattc

SEQ ID NO: 42647 - DNA, 21 bp, Artificial sequence
  SiRNA target sequence
aatacattacctgagaattcc

SEQ ID NO: 42648 - DNA, 21 bp, Artificial sequence
  SiRNA target sequence
atacattacctgagaattcct

SEQ ID NO: 42649 - DNA, 21 bp, Artificial sequence
  SiRNA target sequence
tacattacctgagaattcctc

SEQ ID NO: 42650 - DNA, 21 bp, Artificial sequence
  SiRNA target sequence
acattacctgagaattcctcc

SEQ ID NO: 42651 - DNA, 21 bp, Artificial sequence
  SiRNA target sequence
cattacctgagaattcctcct

SEQ ID NO: 42652 - DNA, 21 bp, Artificial sequence
  SiRNA target sequence
attacctgagaattcctcctt

SEQ ID NO: 42653 - DNA, 21 bp, Artificial sequence
  SiRNA target sequence
ttacctgagaattcctccttt

SEQ ID NO: 42654 - DNA, 21 bp, Artificial sequence
  SiRNA target sequence
tacctgagaattcctccttta

SEQ ID NO: 42655 - DNA, 21 bp, Artificial sequence
  SiRNA target sequence
acctgagaattcctcctttag

SEQ ID NO: 42656 - DNA, 21 bp, Artificial sequence
  SiRNA target sequence
cctgagaattcctcctttagg

SEQ ID NO: 42657 - DNA, 21 bp, Artificial sequence
  SiRNA target sequence
ctgagaattcctcctttagga

SEQ ID NO: 42658 - DNA, 21 bp, Artificial sequence
  SiRNA target sequence
tgagaattcctcctttaggag

SEQ ID NO: 42659 - DNA, 21 bp, Artificial sequence
  SiRNA target sequence
gagaattcctcctttaggagt

SEQ ID NO: 42660 - DNA, 21 bp, Artificial sequence
  SiRNA target sequence
agaattcctcctttaggagtt

SEQ ID NO: 42661 - DNA, 21 bp, Artificial sequence
  SiRNA target sequence
gaattcctcctttaggagtta

SEQ ID NO: 42662 - DNA, 21 bp, Artificial sequence
  SiRNA target sequence
aattcctcctttaggagttag

SEQ ID NO: 42663 - DNA, 21 bp, Artificial sequence
  SiRNA target sequence
attcctcctttaggagttaga

SEQ ID NO: 42664 - DNA, 21 bp, Artificial sequence
  SiRNA target sequence
ttcctcctttaggagttagaa

SEQ ID NO: 42665 - DNA, 21 bp, Artificial sequence
  SiRNA target sequence
tcctcctttaggagttagaat

SEQ ID NO: 42666 - DNA, 21 bp, Artificial sequence
  SiRNA target sequence
cctcctttaggagttagaatt

SEQ ID NO: 42667 - DNA, 21 bp, Artificial sequence
  SiRNA target sequence
ctcctttaggagttagaattt

SEQ ID NO: 42668 - DNA, 21 bp, Artificial sequence
  SiRNA target sequence
tcctttaggagttagaatttg

SEQ ID NO: 42669 - DNA, 21 bp, Artificial sequence
  SiRNA target sequence
cctttaggagttagaatttga

SEQ ID NO: 42670 - DNA, 21 bp, Artificial sequence
  SiRNA target sequence
ctttaggagttagaatttgaa

SEQ ID NO: 42671 - DNA, 21 bp, Artificial sequence
  SiRNA target sequence
tttaggagttagaatttgaaa

SEQ ID NO: 42672 - DNA, 21 bp, Artificial sequence
  SiRNA target sequence
ttaggagttagaatttgaaaa

SEQ ID NO: 42673 - DNA, 21 bp, Artificial sequence
  SiRNA target sequence
taggagttagaatttgaaaag

SEQ ID NO: 42674 - DNA, 21 bp, Artificial sequence
  SiRNA target sequence
aggagttagaatttgaaaaga

SEQ ID NO: 42675 - DNA, 21 bp, Artificial sequence
  SiRNA target sequence
ggagttagaatttgaaaagat

SEQ ID NO: 42676 - DNA, 21 bp, Artificial sequence
  SiRNA target sequence
gagttagaatttgaaaagatt

SEQ ID NO: 42677 - DNA, 21 bp, Artificial sequence
  SiRNA target sequence
agttagaatttgaaaagatta

SEQ ID NO: 42678 - DNA, 21 bp, Artificial sequence
  SiRNA target sequence
gttagaatttgaaaagattag

SEQ ID NO: 42679 - DNA, 21 bp, Artificial sequence
  SiRNA target sequence
ttagaatttgaaaagattagt

SEQ ID NO: 42680 - DNA, 21 bp, Artificial sequence
  SiRNA target sequence
tagaatttgaaaagattagta

SEQ ID NO: 42681 - DNA, 21 bp, Artificial sequence
  SiRNA target sequence
agaatttgaaaagattagtac

SEQ ID NO: 42682 - DNA, 21 bp, Artificial sequence
  SiRNA target sequence
gaatttgaaaagattagtacc

SEQ ID NO: 42683 - DNA, 21 bp, Artificial sequence
  SiRNA target sequence
aatttgaaaagattagtacct

SEQ ID NO: 42684 - DNA, 21 bp, Artificial sequence
  SiRNA target sequence
atttgaaaagattagtaccta

SEQ ID NO: 42685 - DNA, 21 bp, Artificial sequence
  SiRNA target sequence
tttgaaaagattagtacctat

SEQ ID NO: 42686 - DNA, 21 bp, Artificial sequence
  SiRNA target sequence
ttgaaaagattagtacctata

SEQ ID NO: 42687 - DNA, 21 bp, Artificial sequence
  SiRNA target sequence
tgaaaagattagtacctatac

SEQ ID NO: 42688 - DNA, 21 bp, Artificial sequence
  SiRNA target sequence
gaaaagattagtacctatact

SEQ ID NO: 42689 - DNA, 21 bp, Artificial sequence
  SiRNA target sequence
aaaagattagtacctatactt

SEQ ID NO: 42690 - DNA, 21 bp, Artificial sequence
  SiRNA target sequence
aaagattagtacctatactta

SEQ ID NO: 42691 - DNA, 21 bp, Artificial sequence
  SiRNA target sequence
aagattagtacctatacttaa

SEQ ID NO: 42692 - DNA, 21 bp, Artificial sequence
  SiRNA target sequence
agattagtacctatacttaat

SEQ ID NO: 42693 - DNA, 21 bp, Artificial sequence
  SiRNA target sequence
gattagtacctatacttaata

SEQ ID NO: 42694 - DNA, 21 bp, Artificial sequence
  SiRNA target sequence
attagtacctatacttaatag

SEQ ID NO: 42695 - DNA, 21 bp, Artificial sequence
  SiRNA target sequence
ttagtacctatacttaataga

SEQ ID NO: 42696 - DNA, 21 bp, Artificial sequence
  SiRNA target sequence
tagtacctatacttaatagaa

SEQ ID NO: 42697 - DNA, 21 bp, Artificial sequence
  SiRNA target sequence
agtacctatacttaatagaat

SEQ ID NO: 42698 - DNA, 21 bp, Artificial sequence
  SiRNA target sequence
gtacctatacttaatagaatt

SEQ ID NO: 42699 - DNA, 21 bp, Artificial sequence
  SiRNA target sequence
tacctatacttaatagaattt

SEQ ID NO: 42700 - DNA, 21 bp, Artificial sequence
  SiRNA target sequence
acctatacttaatagaattta

SEQ ID NO: 42701 - DNA, 21 bp, Artificial sequence
  SiRNA target sequence
cctatacttaatagaatttaa

SEQ ID NO: 42702 - DNA, 21 bp, Artificial sequence
  SiRNA target sequence
ctatacttaatagaatttaaa

SEQ ID NO: 42703 - DNA, 21 bp, Artificial sequence
  SiRNA target sequence
tatacttaatagaatttaaat

SEQ ID NO: 42704 - DNA, 21 bp, Artificial sequence
  SiRNA target sequence
atacttaatagaatttaaata

SEQ ID NO: 42705 - DNA, 21 bp, Artificial sequence
  SiRNA target sequence
tacttaatagaatttaaatat

SEQ ID NO: 42706 - DNA, 21 bp, Artificial sequence
  SiRNA target sequence
acttaatagaatttaaatatg

SEQ ID NO: 42707 - DNA, 21 bp, Artificial sequence
  SiRNA target sequence
cttaatagaatttaaatatgt

SEQ ID NO: 42708 - DNA, 21 bp, Artificial sequence
  SiRNA target sequence
ttaatagaatttaaatatgtt

SEQ ID NO: 42709 - DNA, 21 bp, Artificial sequence
  SiRNA target sequence
taatagaatttaaatatgtta

SEQ ID NO: 42710 - DNA, 21 bp, Artificial sequence
  SiRNA target sequence
aatagaatttaaatatgttaa

SEQ ID NO: 42711 - DNA, 21 bp, Artificial sequence
  SiRNA target sequence
atagaatttaaatatgttaat

SEQ ID NO: 42712 - DNA, 21 bp, Artificial sequence
  SiRNA target sequence
tagaatttaaatatgttaata

SEQ ID NO: 42713 - DNA, 21 bp, Artificial sequence
  SiRNA target sequence
agaatttaaatatgttaataa

SEQ ID NO: 42714 - DNA, 21 bp, Artificial sequence
  SiRNA target sequence
gaatttaaatatgttaataat

SEQ ID NO: 42715 - DNA, 21 bp, Artificial sequence
  SiRNA target sequence
aatttaaatatgttaataatg

SEQ ID NO: 42716 - DNA, 21 bp, Artificial sequence
  SiRNA target sequence
atttaaatatgttaataatgc

SEQ ID NO: 42717 - DNA, 21 bp, Artificial sequence
  SiRNA target sequence
tttaaatatgttaataatgct

SEQ ID NO: 42718 - DNA, 21 bp, Artificial sequence
  SiRNA target sequence
ttaaatatgttaataatgctg

SEQ ID NO: 42719 - DNA, 21 bp, Artificial sequence
  SiRNA target sequence
taaatatgttaataatgctga

SEQ ID NO: 42720 - DNA, 21 bp, Artificial sequence
  SiRNA target sequence
aaatatgttaataatgctgaa

SEQ ID NO: 42721 - DNA, 21 bp, Artificial sequence
  SiRNA target sequence
aatatgttaataatgctgaag

SEQ ID NO: 42722 - DNA, 21 bp, Artificial sequence
  SiRNA target sequence
atatgttaataatgctgaaga

SEQ ID NO: 42723 - DNA, 21 bp, Artificial sequence
  SiRNA target sequence
tatgttaataatgctgaagac

SEQ ID NO: 42724 - DNA, 21 bp, Artificial sequence
  SiRNA target sequence
atgttaataatgctgaagaca

SEQ ID NO: 42725 - DNA, 21 bp, Artificial sequence
  SiRNA target sequence
tgttaataatgctgaagacaa

SEQ ID NO: 42726 - DNA, 21 bp, Artificial sequence
  SiRNA target sequence
gttaataatgctgaagacaag

SEQ ID NO: 42727 - DNA, 21 bp, Artificial sequence
  SiRNA target sequence
ttaataatgctgaagacaagt

SEQ ID NO: 42728 - DNA, 21 bp, Artificial sequence
  SiRNA target sequence
taataatgctgaagacaagta

SEQ ID NO: 42729 - DNA, 21 bp, Artificial sequence
  SiRNA target sequence
aataatgctgaagacaagtat

SEQ ID NO: 42730 - DNA, 21 bp, Artificial sequence
  SiRNA target sequence
ataatgctgaagacaagtatt

SEQ ID NO: 42731 - DNA, 21 bp, Artificial sequence
  SiRNA target sequence
taatgctgaagacaagtattt

SEQ ID NO: 42732 - DNA, 21 bp, Artificial sequence
  SiRNA target sequence
aatgctgaagacaagtatttc

SEQ ID NO: 42733 - DNA, 21 bp, Artificial sequence
  SiRNA target sequence
atgctgaagacaagtatttcg

SEQ ID NO: 42734 - DNA, 21 bp, Artificial sequence
  SiRNA target sequence
tgctgaagacaagtatttcga

SEQ ID NO: 42735 - DNA, 21 bp, Artificial sequence
  SiRNA target sequence
gctgaagacaagtatttcgat

SEQ ID NO: 42736 - DNA, 21 bp, Artificial sequence
  SiRNA target sequence
ctgaagacaagtatttcgatt

SEQ ID NO: 42737 - DNA, 21 bp, Artificial sequence
  SiRNA target sequence
tgaagacaagtatttcgatta

SEQ ID NO: 42738 - DNA, 21 bp, Artificial sequence
  SiRNA target sequence
gaagacaagtatttcgattat

SEQ ID NO: 42739 - DNA, 21 bp, Artificial sequence
  SiRNA target sequence
aagacaagtatttcgattatt

SEQ ID NO: 42740 - DNA, 21 bp, Artificial sequence
  SiRNA target sequence
agacaagtatttcgattatta

SEQ ID NO: 42741 - DNA, 21 bp, Artificial sequence
  SiRNA target sequence
gacaagtatttcgattattaa

SEQ ID NO: 42742 - DNA, 21 bp, Artificial sequence
  SiRNA target sequence
acaagtatttcgattattaac

SEQ ID NO: 42743 - DNA, 21 bp, Artificial sequence
  SiRNA target sequence
caagtatttcgattattaacc

SEQ ID NO: 42744 - DNA, 21 bp, Artificial sequence
  SiRNA target sequence
aagtatttcgattattaacct

SEQ ID NO: 42745 - DNA, 21 bp, Artificial sequence
  SiRNA target sequence
agtatttcgattattaacctc

SEQ ID NO: 42746 - DNA, 21 bp, Artificial sequence
  SiRNA target sequence
gtatttcgattattaacctct

SEQ ID NO: 42747 - DNA, 21 bp, Artificial sequence
  SiRNA target sequence
tatttcgattattaacctcta

SEQ ID NO: 42748 - DNA, 21 bp, Artificial sequence
  SiRNA target sequence
atttcgattattaacctctat

SEQ ID NO: 42749 - DNA, 21 bp, Artificial sequence
  SiRNA target sequence
tttcgattattaacctctata

SEQ ID NO: 42750 - DNA, 21 bp, Artificial sequence
  SiRNA target sequence
ttcgattattaacctctatat

SEQ ID NO: 42751 - DNA, 21 bp, Artificial sequence
  SiRNA target sequence
tcgattattaacctctatatt

SEQ ID NO: 42752 - DNA, 21 bp, Artificial sequence
  SiRNA target sequence
cgattattaacctctatattt

SEQ ID NO: 42753 - DNA, 21 bp, Artificial sequence
  SiRNA target sequence
gattattaacctctatatttc

SEQ ID NO: 42754 - DNA, 21 bp, Artificial sequence
  SiRNA target sequence
attattaacctctatatttct

SEQ ID NO: 42755 - DNA, 21 bp, Artificial sequence
  SiRNA target sequence
ttattaacctctatatttcta

SEQ ID NO: 42756 - DNA, 21 bp, Artificial sequence
  SiRNA target sequence
tattaacctctatatttctat

SEQ ID NO: 42757 - DNA, 21 bp, Artificial sequence
  SiRNA target sequence
attaacctctatatttctata

SEQ ID NO: 42758 - DNA, 21 bp, Artificial sequence
  SiRNA target sequence
ttaacctctatatttctatat

SEQ ID NO: 42759 - DNA, 21 bp, Artificial sequence
  SiRNA target sequence
taacctctatatttctatata

SEQ ID NO: 42760 - DNA, 21 bp, Artificial sequence
  SiRNA target sequence
aacctctatatttctatataa

SEQ ID NO: 42761 - DNA, 21 bp, Artificial sequence
  SiRNA target sequence
acctctatatttctatataaa

SEQ ID NO: 42762 - DNA, 21 bp, Artificial sequence
  SiRNA target sequence
cctctatatttctatataaag

SEQ ID NO: 42763 - DNA, 21 bp, Artificial sequence
  SiRNA target sequence
ctctatatttctatataaagt

SEQ ID NO: 42764 - DNA, 21 bp, Artificial sequence
  SiRNA target sequence
tctatatttctatataaagta

SEQ ID NO: 42765 - DNA, 21 bp, Artificial sequence
  SiRNA target sequence
ctatatttctatataaagtat

SEQ ID NO: 42766 - DNA, 21 bp, Artificial sequence
  SiRNA target sequence
tatatttctatataaagtatc

SEQ ID NO: 42767 - DNA, 21 bp, Artificial sequence
  SiRNA target sequence
atatttctatataaagtatct

SEQ ID NO: 42768 - DNA, 21 bp, Artificial sequence
  SiRNA target sequence
tatttctatataaagtatctg

SEQ ID NO: 42769 - DNA, 21 bp, Artificial sequence
  SiRNA target sequence
atttctatataaagtatctgt

SEQ ID NO: 42770 - DNA, 21 bp, Artificial sequence
  SiRNA target sequence
tttctatataaagtatctgtg

SEQ ID NO: 42771 - DNA, 21 bp, Artificial sequence
  SiRNA target sequence
ttctatataaagtatctgtga

SEQ ID NO: 42772 - DNA, 21 bp, Artificial sequence
  SiRNA target sequence
tctatataaagtatctgtgag

SEQ ID NO: 42773 - DNA, 21 bp, Artificial sequence
  SiRNA target sequence
ctatataaagtatctgtgagt

SEQ ID NO: 42774 - DNA, 21 bp, Artificial sequence
  SiRNA target sequence
tatataaagtatctgtgagtc

SEQ ID NO: 42775 - DNA, 21 bp, Artificial sequence
  SiRNA target sequence
atataaagtatctgtgagtct

SEQ ID NO: 42776 - DNA, 21 bp, Artificial sequence
  SiRNA target sequence
tataaagtatctgtgagtctc

SEQ ID NO: 42777 - DNA, 21 bp, Artificial sequence
  SiRNA target sequence
ataaagtatctgtgagtctca

SEQ ID NO: 42778 - DNA, 21 bp, Artificial sequence
  SiRNA target sequence
taaagtatctgtgagtctcag

SEQ ID NO: 42779 - DNA, 21 bp, Artificial sequence
  SiRNA target sequence
aaagtatctgtgagtctcagt

SEQ ID NO: 42780 - DNA, 21 bp, Artificial sequence
  SiRNA target sequence
aagtatctgtgagtctcagtg

SEQ ID NO: 42781 - DNA, 21 bp, Artificial sequence
  SiRNA target sequence
agtatctgtgagtctcagtgg

SEQ ID NO: 42782 - DNA, 21 bp, Artificial sequence
  SiRNA target sequence
gtatctgtgagtctcagtgga

SEQ ID NO: 42783 - DNA, 21 bp, Artificial sequence
  SiRNA target sequence
tatctgtgagtctcagtggac

SEQ ID NO: 42784 - DNA, 21 bp, Artificial sequence
  SiRNA target sequence
atctgtgagtctcagtggaca

SEQ ID NO: 42785 - DNA, 21 bp, Artificial sequence
  SiRNA target sequence
tctgtgagtctcagtggacat

SEQ ID NO: 42786 - DNA, 21 bp, Artificial sequence
  SiRNA target sequence
ctgtgagtctcagtggacatc

SEQ ID NO: 42787 - DNA, 21 bp, Artificial sequence
  SiRNA target sequence
tgtgagtctcagtggacatca

SEQ ID NO: 42788 - DNA, 21 bp, Artificial sequence
  SiRNA target sequence
gtgagtctcagtggacatcac

SEQ ID NO: 42789 - DNA, 21 bp, Artificial sequence
  SiRNA target sequence
tgagtctcagtggacatcaca

SEQ ID NO: 42790 - DNA, 21 bp, Artificial sequence
  SiRNA target sequence
gagtctcagtggacatcacag

SEQ ID NO: 42791 - DNA, 21 bp, Artificial sequence
  SiRNA target sequence
agtctcagtggacatcacagt

SEQ ID NO: 42792 - DNA, 21 bp, Artificial sequence
  SiRNA target sequence
gtctcagtggacatcacagta

SEQ ID NO: 42793 - DNA, 21 bp, Artificial sequence
  SiRNA target sequence
tctcagtggacatcacagtaa

SEQ ID NO: 42794 - DNA, 21 bp, Artificial sequence
  SiRNA target sequence
ctcagtggacatcacagtaag

SEQ ID NO: 42795 - DNA, 21 bp, Artificial sequence
  SiRNA target sequence
tcagtggacatcacagtaagg

SEQ ID NO: 42796 - DNA, 21 bp, Artificial sequence
  SiRNA target sequence
cagtggacatcacagtaaggt

SEQ ID NO: 42797 - DNA, 21 bp, Artificial sequence
  SiRNA target sequence
agtggacatcacagtaaggtc

SEQ ID NO: 42798 - DNA, 21 bp, Artificial sequence
  SiRNA target sequence
gtggacatcacagtaaggtcg

SEQ ID NO: 42799 - DNA, 21 bp, Artificial sequence
  SiRNA target sequence
tggacatcacagtaaggtcgc

SEQ ID NO: 42800 - DNA, 21 bp, Artificial sequence
  SiRNA target sequence
ggacatcacagtaaggtcgca

SEQ ID NO: 42801 - DNA, 21 bp, Artificial sequence
  SiRNA target sequence
gacatcacagtaaggtcgcag

SEQ ID NO: 42802 - DNA, 21 bp, Artificial sequence
  SiRNA target sequence
acatcacagtaaggtcgcagt

SEQ ID NO: 42803 - DNA, 21 bp, Artificial sequence
  SiRNA target sequence
catcacagtaaggtcgcagtt

SEQ ID NO: 42804 - DNA, 21 bp, Artificial sequence
  SiRNA target sequence
atcacagtaaggtcgcagtta

SEQ ID NO: 42805 - DNA, 21 bp, Artificial sequence
  SiRNA target sequence
tcacagtaaggtcgcagttaa

SEQ ID NO: 42806 - DNA, 21 bp, Artificial sequence
  SiRNA target sequence
cacagtaaggtcgcagttaac

SEQ ID NO: 42807 - DNA, 21 bp, Artificial sequence
  SiRNA target sequence
acagtaaggtcgcagttaact

SEQ ID NO: 42808 - DNA, 21 bp, Artificial sequence
  SiRNA target sequence
cagtaaggtcgcagttaactt

SEQ ID NO: 42809 - DNA, 21 bp, Artificial sequence
  SiRNA target sequence
agtaaggtcgcagttaacttg

SEQ ID NO: 42810 - DNA, 21 bp, Artificial sequence
  SiRNA target sequence
gtaaggtcgcagttaacttgt

SEQ ID NO: 42811 - DNA, 21 bp, Artificial sequence
  SiRNA target sequence
taaggtcgcagttaacttgta

SEQ ID NO: 42812 - DNA, 21 bp, Artificial sequence
  SiRNA target sequence
aaggtcgcagttaacttgtaa

SEQ ID NO: 42813 - DNA, 21 bp, Artificial sequence
  SiRNA target sequence
aggtcgcagttaacttgtaat

SEQ ID NO: 42814 - DNA, 21 bp, Artificial sequence
  SiRNA target sequence
ggtcgcagttaacttgtaatc

SEQ ID NO: 42815 - DNA, 21 bp, Artificial sequence
  SiRNA target sequence
gtcgcagttaacttgtaatct

SEQ ID NO: 42816 - DNA, 21 bp, Artificial sequence
  SiRNA target sequence
tcgcagttaacttgtaatctt

SEQ ID NO: 42817 - DNA, 21 bp, Artificial sequence
  SiRNA target sequence
cgcagttaacttgtaatcttt

SEQ ID NO: 42818 - DNA, 21 bp, Artificial sequence
  SiRNA target sequence
gcagttaacttgtaatctttt

SEQ ID NO: 42819 - DNA, 21 bp, Artificial sequence
  SiRNA target sequence
cagttaacttgtaatcttttc

SEQ ID NO: 42820 - DNA, 21 bp, Artificial sequence
  SiRNA target sequence
agttaacttgtaatcttttca

SEQ ID NO: 42821 - DNA, 21 bp, Artificial sequence
  SiRNA target sequence
gttaacttgtaatcttttcat

SEQ ID NO: 42822 - DNA, 21 bp, Artificial sequence
  SiRNA target sequence
ttaacttgtaatcttttcatt

SEQ ID NO: 42823 - DNA, 21 bp, Artificial sequence
  SiRNA target sequence
taacttgtaatcttttcattc

SEQ ID NO: 42824 - DNA, 21 bp, Artificial sequence
  SiRNA target sequence
aacttgtaatcttttcattcc

SEQ ID NO: 42825 - DNA, 21 bp, Artificial sequence
  SiRNA target sequence
acttgtaatcttttcattcct

SEQ ID NO: 42826 - DNA, 21 bp, Artificial sequence
  SiRNA target sequence
cttgtaatcttttcattcctg

SEQ ID NO: 42827 - DNA, 21 bp, Artificial sequence
  SiRNA target sequence
ttgtaatcttttcattcctgt

SEQ ID NO: 42828 - DNA, 21 bp, Artificial sequence
  SiRNA target sequence
tgtaatcttttcattcctgtg

SEQ ID NO: 42829 - DNA, 21 bp, Artificial sequence
  SiRNA target sequence
gtaatcttttcattcctgtgt

SEQ ID NO: 42830 - DNA, 21 bp, Artificial sequence
  SiRNA target sequence
taatcttttcattcctgtgtc

SEQ ID NO: 42831 - DNA, 21 bp, Artificial sequence
  SiRNA target sequence
aatcttttcattcctgtgtcg

SEQ ID NO: 42832 - DNA, 21 bp, Artificial sequence
  SiRNA target sequence
atcttttcattcctgtgtcgg

SEQ ID NO: 42833 - DNA, 21 bp, Artificial sequence
  SiRNA target sequence
tcttttcattcctgtgtcgga

SEQ ID NO: 42834 - DNA, 21 bp, Artificial sequence
  SiRNA target sequence
cttttcattcctgtgtcggag

SEQ ID NO: 42835 - DNA, 21 bp, Artificial sequence
  SiRNA target sequence
ttttcattcctgtgtcggagc

SEQ ID NO: 42836 - DNA, 21 bp, Artificial sequence
  SiRNA target sequence
tttcattcctgtgtcggagca

SEQ ID NO: 42837 - DNA, 21 bp, Artificial sequence
  SiRNA target sequence
ttcattcctgtgtcggagcag

SEQ ID NO: 42838 - DNA, 21 bp, Artificial sequence
  SiRNA target sequence
tcattcctgtgtcggagcagt

SEQ ID NO: 42839 - DNA, 21 bp, Artificial sequence
  SiRNA target sequence
cattcctgtgtcggagcagtg

SEQ ID NO: 42840 - DNA, 21 bp, Artificial sequence
  SiRNA target sequence
attcctgtgtcggagcagtgg

SEQ ID NO: 42841 - DNA, 21 bp, Artificial sequence
  SiRNA target sequence
ttcctgtgtcggagcagtggt

SEQ ID NO: 42842 - DNA, 21 bp, Artificial sequence
  SiRNA target sequence
tcctgtgtcggagcagtggta

SEQ ID NO: 42843 - DNA, 21 bp, Artificial sequence
  SiRNA target sequence
cctgtgtcggagcagtggtaa

SEQ ID NO: 42844 - DNA, 21 bp, Artificial sequence
  SiRNA target sequence
ctgtgtcggagcagtggtaat

SEQ ID NO: 42845 - DNA, 21 bp, Artificial sequence
  SiRNA target sequence
tgtgtcggagcagtggtaatg

SEQ ID NO: 42846 - DNA, 21 bp, Artificial sequence
  SiRNA target sequence
gtgtcggagcagtggtaatgg

SEQ ID NO: 42847 - DNA, 21 bp, Artificial sequence
  SiRNA target sequence
tgtcggagcagtggtaatgga

SEQ ID NO: 42848 - DNA, 21 bp, Artificial sequence
  SiRNA target sequence
gtcggagcagtggtaatggag

SEQ ID NO: 42849 - DNA, 21 bp, Artificial sequence
  SiRNA target sequence
tcggagcagtggtaatggagc

SEQ ID NO: 42850 - DNA, 21 bp, Artificial sequence
  SiRNA target sequence
cggagcagtggtaatggagcc

SEQ ID NO: 42851 - DNA, 21 bp, Artificial sequence
  SiRNA target sequence
ggagcagtggtaatggagccg

SEQ ID NO: 42852 - DNA, 21 bp, Artificial sequence
  SiRNA target sequence
gagcagtggtaatggagccgg

SEQ ID NO: 42853 - DNA, 21 bp, Artificial sequence
  SiRNA target sequence
agcagtggtaatggagccgga

SEQ ID NO: 42854 - DNA, 21 bp, Artificial sequence
  SiRNA target sequence
gcagtggtaatggagccggac

SEQ ID NO: 42855 - DNA, 21 bp, Artificial sequence
  SiRNA target sequence
cagtggtaatggagccggacg

SEQ ID NO: 42856 - DNA, 21 bp, Artificial sequence
  SiRNA target sequence
agtggtaatggagccggacga

SEQ ID NO: 42857 - DNA, 21 bp, Artificial sequence
  SiRNA target sequence
gtggtaatggagccggacgat

SEQ ID NO: 42858 - DNA, 21 bp, Artificial sequence
  SiRNA target sequence
tggtaatggagccggacgatt

SEQ ID NO: 42859 - DNA, 21 bp, Artificial sequence
  SiRNA target sequence
ggtaatggagccggacgattt

SEQ ID NO: 42860 - DNA, 21 bp, Artificial sequence
  SiRNA target sequence
gtaatggagccggacgatttc

SEQ ID NO: 42861 - DNA, 21 bp, Artificial sequence
  SiRNA target sequence
taatggagccggacgatttcg

SEQ ID NO: 42862 - DNA, 21 bp, Artificial sequence
  SiRNA target sequence
aatggagccggacgatttcgc

SEQ ID NO: 42863 - DNA, 21 bp, Artificial sequence
  SiRNA target sequence
atggagccggacgatttcgcc

SEQ ID NO: 42864 - DNA, 21 bp, Artificial sequence
  SiRNA target sequence
tggagccggacgatttcgcca

SEQ ID NO: 42865 - DNA, 21 bp, Artificial sequence
  SiRNA target sequence
ggagccggacgatttcgccaa

SEQ ID NO: 42866 - DNA, 21 bp, Artificial sequence
  SiRNA target sequence
gagccggacgatttcgccaaa

SEQ ID NO: 42867 - DNA, 21 bp, Artificial sequence
  SiRNA target sequence
agccggacgatttcgccaaaa

SEQ ID NO: 42868 - DNA, 21 bp, Artificial sequence
  SiRNA target sequence
gccggacgatttcgccaaaac

SEQ ID NO: 42869 - DNA, 21 bp, Artificial sequence
  SiRNA target sequence
ccggacgatttcgccaaaaca

SEQ ID NO: 42870 - DNA, 21 bp, Artificial sequence
  SiRNA target sequence
cggacgatttcgccaaaacat

SEQ ID NO: 42871 - DNA, 21 bp, Artificial sequence
  SiRNA target sequence
ggacgatttcgccaaaacatg

SEQ ID NO: 42872 - DNA, 21 bp, Artificial sequence
  SiRNA target sequence
gacgatttcgccaaaacatgt

SEQ ID NO: 42873 - DNA, 21 bp, Artificial sequence
  SiRNA target sequence
acgatttcgccaaaacatgtt

SEQ ID NO: 42874 - DNA, 21 bp, Artificial sequence
  SiRNA target sequence
cgatttcgccaaaacatgttt

SEQ ID NO: 42875 - DNA, 21 bp, Artificial sequence
  SiRNA target sequence
gatttcgccaaaacatgtttt

SEQ ID NO: 42876 - DNA, 21 bp, Artificial sequence
  SiRNA target sequence
atttcgccaaaacatgttttc

SEQ ID NO: 42877 - DNA, 21 bp, Artificial sequence
  SiRNA target sequence
tttcgccaaaacatgttttct

SEQ ID NO: 42878 - DNA, 21 bp, Artificial sequence
  SiRNA target sequence
ttcgccaaaacatgttttctt

SEQ ID NO: 42879 - DNA, 21 bp, Artificial sequence
  SiRNA target sequence
tcgccaaaacatgttttcttc

SEQ ID NO: 42880 - DNA, 21 bp, Artificial sequence
  SiRNA target sequence
cgccaaaacatgttttcttca

SEQ ID NO: 42881 - DNA, 21 bp, Artificial sequence
  SiRNA target sequence
gccaaaacatgttttcttcaa

SEQ ID NO: 42882 - DNA, 21 bp, Artificial sequence
  SiRNA target sequence
ccaaaacatgttttcttcaac

SEQ ID NO: 42883 - DNA, 21 bp, Artificial sequence
  SiRNA target sequence
caaaacatgttttcttcaact

SEQ ID NO: 42884 - DNA, 21 bp, Artificial sequence
  SiRNA target sequence
aaaacatgttttcttcaactc

SEQ ID NO: 42885 - DNA, 21 bp, Artificial sequence
  SiRNA target sequence
aaacatgttttcttcaactca

SEQ ID NO: 42886 - DNA, 21 bp, Artificial sequence
  SiRNA target sequence
aacatgttttcttcaactcaa

SEQ ID NO: 42887 - DNA, 21 bp, Artificial sequence
  SiRNA target sequence
acatgttttcttcaactcaac

SEQ ID NO: 42888 - DNA, 21 bp, Artificial sequence
  SiRNA target sequence
catgttttcttcaactcaaca

SEQ ID NO: 42889 - DNA, 21 bp, Artificial sequence
  SiRNA target sequence
atgttttcttcaactcaacaa

SEQ ID NO: 42890 - DNA, 21 bp, Artificial sequence
  SiRNA target sequence
tgttttcttcaactcaacaaa

SEQ ID NO: 42891 - DNA, 21 bp, Artificial sequence
  SiRNA target sequence
gttttcttcaactcaacaaaa

SEQ ID NO: 42892 - DNA, 21 bp, Artificial sequence
  SiRNA target sequence
ttttcttcaactcaacaaaat

SEQ ID NO: 42893 - DNA, 21 bp, Artificial sequence
  SiRNA target sequence
tttcttcaactcaacaaaata

SEQ ID NO: 42894 - DNA, 21 bp, Artificial sequence
  SiRNA target sequence
ttcttcaactcaacaaaataa

SEQ ID NO: 42895 - DNA, 21 bp, Artificial sequence
  SiRNA target sequence
tcttcaactcaacaaaataac

SEQ ID NO: 42896 - DNA, 21 bp, Artificial sequence
  SiRNA target sequence
cttcaactcaacaaaataaca

SEQ ID NO: 42897 - DNA, 21 bp, Artificial sequence
  SiRNA target sequence
ttcaactcaacaaaataacaa

SEQ ID NO: 42898 - DNA, 21 bp, Artificial sequence
  SiRNA target sequence
tcaactcaacaaaataacaag

SEQ ID NO: 42899 - DNA, 21 bp, Artificial sequence
  SiRNA target sequence
caactcaacaaaataacaaga

SEQ ID NO: 42900 - DNA, 21 bp, Artificial sequence
  SiRNA target sequence
aactcaacaaaataacaagat

SEQ ID NO: 42901 - DNA, 21 bp, Artificial sequence
  SiRNA target sequence
actcaacaaaataacaagatg

SEQ ID NO: 42902 - DNA, 21 bp, Artificial sequence
  SiRNA target sequence
ctcaacaaaataacaagatga

SEQ ID NO: 42903 - DNA, 21 bp, Artificial sequence
  SiRNA target sequence
tcaacaaaataacaagatgac

SEQ ID NO: 42904 - DNA, 21 bp, Artificial sequence
  SiRNA target sequence
caacaaaataacaagatgaca

SEQ ID NO: 42905 - DNA, 21 bp, Artificial sequence
  SiRNA target sequence
aacaaaataacaagatgacaa

SEQ ID NO: 42906 - DNA, 21 bp, Artificial sequence
  SiRNA target sequence
acaaaataacaagatgacaaa

SEQ ID NO: 42907 - DNA, 21 bp, Artificial sequence
  SiRNA target sequence
caaaataacaagatgacaaaa

SEQ ID NO: 42908 - DNA, 21 bp, Artificial sequence
  SiRNA target sequence
aaaataacaagatgacaaaac

SEQ ID NO: 42909 - DNA, 21 bp, Artificial sequence
  SiRNA target sequence
aaataacaagatgacaaaaca

SEQ ID NO: 42910 - DNA, 21 bp, Artificial sequence
  SiRNA target sequence
aataacaagatgacaaaacaa

SEQ ID NO: 42911 - DNA, 21 bp, Artificial sequence
  SiRNA target sequence
ataacaagatgacaaaacaac

SEQ ID NO: 42912 - DNA, 21 bp, Artificial sequence
  SiRNA target sequence
taacaagatgacaaaacaacc

SEQ ID NO: 42913 - DNA, 21 bp, Artificial sequence
  SiRNA target sequence
aacaagatgacaaaacaacca

SEQ ID NO: 42914 - DNA, 21 bp, Artificial sequence
  SiRNA target sequence
acaagatgacaaaacaaccag

SEQ ID NO: 42915 - DNA, 21 bp, Artificial sequence
  SiRNA target sequence
caagatgacaaaacaaccagc

SEQ ID NO: 42916 - DNA, 21 bp, Artificial sequence
  SiRNA target sequence
aagatgacaaaacaaccagca

SEQ ID NO: 42917 - DNA, 21 bp, Artificial sequence
  SiRNA target sequence
agatgacaaaacaaccagcaa

SEQ ID NO: 42918 - DNA, 21 bp, Artificial sequence
  SiRNA target sequence
gatgacaaaacaaccagcaac

SEQ ID NO: 42919 - DNA, 21 bp, Artificial sequence
  SiRNA target sequence
atgacaaaacaaccagcaact

SEQ ID NO: 42920 - DNA, 21 bp, Artificial sequence
  SiRNA target sequence
tgacaaaacaaccagcaactt

SEQ ID NO: 42921 - DNA, 21 bp, Artificial sequence
  SiRNA target sequence
gacaaaacaaccagcaacttt

SEQ ID NO: 42922 - DNA, 21 bp, Artificial sequence
  SiRNA target sequence
acaaaacaaccagcaacttta

SEQ ID NO: 42923 - DNA, 21 bp, Artificial sequence
  SiRNA target sequence
caaaacaaccagcaactttaa

SEQ ID NO: 42924 - DNA, 21 bp, Artificial sequence
  SiRNA target sequence
aaaacaaccagcaactttaac

SEQ ID NO: 42925 - DNA, 21 bp, Artificial sequence
  SiRNA target sequence
aaacaaccagcaactttaacc

SEQ ID NO: 42926 - DNA, 21 bp, Artificial sequence
  SiRNA target sequence
aacaaccagcaactttaacct

SEQ ID NO: 42927 - DNA, 21 bp, Artificial sequence
  SiRNA target sequence
acaaccagcaactttaaccta

SEQ ID NO: 42928 - DNA, 21 bp, Artificial sequence
  SiRNA target sequence
caaccagcaactttaacctat

SEQ ID NO: 42929 - DNA, 21 bp, Artificial sequence
  SiRNA target sequence
aaccagcaactttaacctatc

SEQ ID NO: 42930 - DNA, 21 bp, Artificial sequence
  SiRNA target sequence
accagcaactttaacctatct

SEQ ID NO: 42931 - DNA, 21 bp, Artificial sequence
  SiRNA target sequence
ccagcaactttaacctatctt

SEQ ID NO: 42932 - DNA, 21 bp, Artificial sequence
  SiRNA target sequence
cagcaactttaacctatcttt

SEQ ID NO: 42933 - DNA, 21 bp, Artificial sequence
  SiRNA target sequence
agcaactttaacctatctttc

SEQ ID NO: 42934 - DNA, 21 bp, Artificial sequence
  SiRNA target sequence
gcaactttaacctatctttca

SEQ ID NO: 42935 - DNA, 21 bp, Artificial sequence
  SiRNA target sequence
caactttaacctatctttcaa

SEQ ID NO: 42936 - DNA, 21 bp, Artificial sequence
  SiRNA target sequence
aactttaacctatctttcaag

SEQ ID NO: 42937 - DNA, 21 bp, Artificial sequence
  SiRNA target sequence
actttaacctatctttcaagt

SEQ ID NO: 42938 - DNA, 21 bp, Artificial sequence
  SiRNA target sequence
ctttaacctatctttcaagta

SEQ ID NO: 42939 - DNA, 21 bp, Artificial sequence
  SiRNA target sequence
tttaacctatctttcaagtat

SEQ ID NO: 42940 - DNA, 21 bp, Artificial sequence
  SiRNA target sequence
ttaacctatctttcaagtatg

SEQ ID NO: 42941 - DNA, 21 bp, Artificial sequence
  SiRNA target sequence
taacctatctttcaagtatga

SEQ ID NO: 42942 - DNA, 21 bp, Artificial sequence
  SiRNA target sequence
aacctatctttcaagtatgaa

SEQ ID NO: 42943 - DNA, 21 bp, Artificial sequence
  SiRNA target sequence
acctatctttcaagtatgaag

SEQ ID NO: 42944 - DNA, 21 bp, Artificial sequence
  SiRNA target sequence
cctatctttcaagtatgaagg

SEQ ID NO: 42945 - DNA, 21 bp, Artificial sequence
  SiRNA target sequence
ctatctttcaagtatgaaggt

SEQ ID NO: 42946 - DNA, 21 bp, Artificial sequence
  SiRNA target sequence
tatctttcaagtatgaaggtg

SEQ ID NO: 42947 - DNA, 21 bp, Artificial sequence
  SiRNA target sequence
atctttcaagtatgaaggtga

SEQ ID NO: 42948 - DNA, 21 bp, Artificial sequence
  SiRNA target sequence
tctttcaagtatgaaggtgat

SEQ ID NO: 42949 - DNA, 21 bp, Artificial sequence
  SiRNA target sequence
ctttcaagtatgaaggtgatt

SEQ ID NO: 42950 - DNA, 21 bp, Artificial sequence
  SiRNA target sequence
tttcaagtatgaaggtgatta

SEQ ID NO: 42951 - DNA, 21 bp, Artificial sequence
  SiRNA target sequence
ttcaagtatgaaggtgattag

SEQ ID NO: 42952 - DNA, 21 bp, Artificial sequence
  SiRNA target sequence
tcaagtatgaaggtgattagt

SEQ ID NO: 42953 - DNA, 21 bp, Artificial sequence
  SiRNA target sequence
caagtatgaaggtgattagta

SEQ ID NO: 42954 - DNA, 21 bp, Artificial sequence
  SiRNA target sequence
aagtatgaaggtgattagtat

SEQ ID NO: 42955 - DNA, 21 bp, Artificial sequence
  SiRNA target sequence
agtatgaaggtgattagtatg

SEQ ID NO: 42956 - DNA, 21 bp, Artificial sequence
  SiRNA target sequence
gtatgaaggtgattagtatgc

SEQ ID NO: 42957 - DNA, 21 bp, Artificial sequence
  SiRNA target sequence
tatgaaggtgattagtatgcc

SEQ ID NO: 42958 - DNA, 21 bp, Artificial sequence
  SiRNA target sequence
atgaaggtgattagtatgcca

SEQ ID NO: 42959 - DNA, 21 bp, Artificial sequence
  SiRNA target sequence
tgaaggtgattagtatgccac

SEQ ID NO: 42960 - DNA, 21 bp, Artificial sequence
  SiRNA target sequence
gaaggtgattagtatgccacc

SEQ ID NO: 42961 - DNA, 21 bp, Artificial sequence
  SiRNA target sequence
aaggtgattagtatgccacca

SEQ ID NO: 42962 - DNA, 21 bp, Artificial sequence
  SiRNA target sequence
aggtgattagtatgccaccaa

SEQ ID NO: 42963 - DNA, 21 bp, Artificial sequence
  SiRNA target sequence
ggtgattagtatgccaccaag

SEQ ID NO: 42964 - DNA, 21 bp, Artificial sequence
  SiRNA target sequence
gtgattagtatgccaccaagt

SEQ ID NO: 42965 - DNA, 21 bp, Artificial sequence
  SiRNA target sequence
tgattagtatgccaccaagtg

SEQ ID NO: 42966 - DNA, 21 bp, Artificial sequence
  SiRNA target sequence
gattagtatgccaccaagtga

SEQ ID NO: 42967 - DNA, 21 bp, Artificial sequence
  SiRNA target sequence
attagtatgccaccaagtgaa

SEQ ID NO: 42968 - DNA, 21 bp, Artificial sequence
  SiRNA target sequence
ttagtatgccaccaagtgaat

SEQ ID NO: 42969 - DNA, 21 bp, Artificial sequence
  SiRNA target sequence
tagtatgccaccaagtgaatt

SEQ ID NO: 42970 - DNA, 21 bp, Artificial sequence
  SiRNA target sequence
agtatgccaccaagtgaattc

SEQ ID NO: 42971 - DNA, 21 bp, Artificial sequence
  SiRNA target sequence
gtatgccaccaagtgaattct

SEQ ID NO: 42972 - DNA, 21 bp, Artificial sequence
  SiRNA target sequence
tatgccaccaagtgaattctt

SEQ ID NO: 42973 - DNA, 21 bp, Artificial sequence
  SiRNA target sequence
atgccaccaagtgaattcttt

SEQ ID NO: 42974 - DNA, 21 bp, Artificial sequence
  SiRNA target sequence
tgccaccaagtgaattctttt

SEQ ID NO: 42975 - DNA, 21 bp, Artificial sequence
  SiRNA target sequence
gccaccaagtgaattcttttc

SEQ ID NO: 42976 - DNA, 21 bp, Artificial sequence
  SiRNA target sequence
ccaccaagtgaattcttttca

SEQ ID NO: 42977 - DNA, 21 bp, Artificial sequence
  SiRNA target sequence
caccaagtgaattcttttcac

SEQ ID NO: 42978 - DNA, 21 bp, Artificial sequence
  SiRNA target sequence
accaagtgaattcttttcact

SEQ ID NO: 42979 - DNA, 21 bp, Artificial sequence
  SiRNA target sequence
ccaagtgaattcttttcactt

SEQ ID NO: 42980 - DNA, 21 bp, Artificial sequence
  SiRNA target sequence
caagtgaattcttttcacttg

SEQ ID NO: 42981 - DNA, 21 bp, Artificial sequence
  SiRNA target sequence
aagtgaattcttttcacttga

SEQ ID NO: 42982 - DNA, 21 bp, Artificial sequence
  SiRNA target sequence
agtgaattcttttcacttgat

SEQ ID NO: 42983 - DNA, 21 bp, Artificial sequence
  SiRNA target sequence
gtgaattcttttcacttgatg

SEQ ID NO: 42984 - DNA, 21 bp, Artificial sequence
  SiRNA target sequence
tgaattcttttcacttgatga

SEQ ID NO: 42985 - DNA, 21 bp, Artificial sequence
  SiRNA target sequence
gaattcttttcacttgatgac

SEQ ID NO: 42986 - DNA, 21 bp, Artificial sequence
  SiRNA target sequence
aattcttttcacttgatgact

SEQ ID NO: 42987 - DNA, 21 bp, Artificial sequence
  SiRNA target sequence
attcttttcacttgatgactt

SEQ ID NO: 42988 - DNA, 21 bp, Artificial sequence
  SiRNA target sequence
ttcttttcacttgatgacttg

SEQ ID NO: 42989 - DNA, 21 bp, Artificial sequence
  SiRNA target sequence
tcttttcacttgatgacttgt

SEQ ID NO: 42990 - DNA, 21 bp, Artificial sequence
  SiRNA target sequence
cttttcacttgatgacttgtg

SEQ ID NO: 42991 - DNA, 21 bp, Artificial sequence
  SiRNA target sequence
ttttcacttgatgacttgtgt

SEQ ID NO: 42992 - DNA, 21 bp, Artificial sequence
  SiRNA target sequence
tttcacttgatgacttgtgtc

SEQ ID NO: 42993 - DNA, 21 bp, Artificial sequence
  SiRNA target sequence
ttcacttgatgacttgtgtcg

SEQ ID NO: 42994 - DNA, 21 bp, Artificial sequence
  SiRNA target sequence
tcacttgatgacttgtgtcgc

SEQ ID NO: 42995 - DNA, 21 bp, Artificial sequence
  SiRNA target sequence
cacttgatgacttgtgtcgcc

SEQ ID NO: 42996 - DNA, 21 bp, Artificial sequence
  SiRNA target sequence
acttgatgacttgtgtcgcca

SEQ ID NO: 42997 - DNA, 21 bp, Artificial sequence
  SiRNA target sequence
cttgatgacttgtgtcgccaa

SEQ ID NO: 42998 - DNA, 21 bp, Artificial sequence
  SiRNA target sequence
ttgatgacttgtgtcgccaac

SEQ ID NO: 42999 - DNA, 21 bp, Artificial sequence
  SiRNA target sequence
tgatgacttgtgtcgccaaca

SEQ ID NO: 43000 - DNA, 21 bp, Artificial sequence
  SiRNA target sequence
gatgacttgtgtcgccaacaa

SEQ ID NO: 43001 - DNA, 21 bp, Artificial sequence
  SiRNA target sequence
atgacttgtgtcgccaacaaa

SEQ ID NO: 43002 - DNA, 21 bp, Artificial sequence
  SiRNA target sequence
tgacttgtgtcgccaacaaat

SEQ ID NO: 43003 - DNA, 21 bp, Artificial sequence
  SiRNA target sequence
gacttgtgtcgccaacaaatt

SEQ ID NO: 43004 - DNA, 21 bp, Artificial sequence
  SiRNA target sequence
acttgtgtcgccaacaaattt

SEQ ID NO: 43005 - DNA, 21 bp, Artificial sequence
  SiRNA target sequence
cttgtgtcgccaacaaatttt

SEQ ID NO: 43006 - DNA, 21 bp, Artificial sequence
  SiRNA target sequence
ttgtgtcgccaacaaatttta

SEQ ID NO: 43007 - DNA, 21 bp, Artificial sequence
  SiRNA target sequence
tgtgtcgccaacaaattttaa

SEQ ID NO: 43008 - DNA, 21 bp, Artificial sequence
  SiRNA target sequence
gtgtcgccaacaaattttaaa

SEQ ID NO: 43009 - DNA, 21 bp, Artificial sequence
  SiRNA target sequence
tgtcgccaacaaattttaaag

SEQ ID NO: 43010 - DNA, 21 bp, Artificial sequence
  SiRNA target sequence
gtcgccaacaaattttaaaga

SEQ ID NO: 43011 - DNA, 21 bp, Artificial sequence
  SiRNA target sequence
tcgccaacaaattttaaagat

SEQ ID NO: 43012 - DNA, 21 bp, Artificial sequence
  SiRNA target sequence
cgccaacaaattttaaagatg

SEQ ID NO: 43013 - DNA, 21 bp, Artificial sequence
  SiRNA target sequence
gccaacaaattttaaagatgg

SEQ ID NO: 43014 - DNA, 21 bp, Artificial sequence
  SiRNA target sequence
ccaacaaattttaaagatggt

SEQ ID NO: 43015 - DNA, 21 bp, Artificial sequence
  SiRNA target sequence
caacaaattttaaagatggtt

SEQ ID NO: 43016 - DNA, 21 bp, Artificial sequence
  SiRNA target sequence
aacaaattttaaagatggttt

SEQ ID NO: 43017 - DNA, 21 bp, Artificial sequence
  SiRNA target sequence
acaaattttaaagatggttta

SEQ ID NO: 43018 - DNA, 21 bp, Artificial sequence
  SiRNA target sequence
caaattttaaagatggtttat

SEQ ID NO: 43019 - DNA, 21 bp, Artificial sequence
  SiRNA target sequence
aaattttaaagatggtttata

SEQ ID NO: 43020 - DNA, 21 bp, Artificial sequence
  SiRNA target sequence
aattttaaagatggtttatat

SEQ ID NO: 43021 - DNA, 21 bp, Artificial sequence
  SiRNA target sequence
attttaaagatggtttatatt

SEQ ID NO: 43022 - DNA, 21 bp, Artificial sequence
  SiRNA target sequence
ttttaaagatggtttatattg

SEQ ID NO: 43023 - DNA, 21 bp, Artificial sequence
  SiRNA target sequence
tttaaagatggtttatattga

SEQ ID NO: 43024 - DNA, 21 bp, Artificial sequence
  SiRNA target sequence
ttaaagatggtttatattgac

SEQ ID NO: 43025 - DNA, 21 bp, Artificial sequence
  SiRNA target sequence
taaagatggtttatattgacc

SEQ ID NO: 43026 - DNA, 21 bp, Artificial sequence
  SiRNA target sequence
aaagatggtttatattgacca

SEQ ID NO: 43027 - DNA, 21 bp, Artificial sequence
  SiRNA target sequence
aagatggtttatattgaccaa

SEQ ID NO: 43028 - DNA, 21 bp, Artificial sequence
  SiRNA target sequence
agatggtttatattgaccaat

SEQ ID NO: 43029 - DNA, 21 bp, Artificial sequence
  SiRNA target sequence
gatggtttatattgaccaata

SEQ ID NO: 43030 - DNA, 21 bp, Artificial sequence
  SiRNA target sequence
atggtttatattgaccaatac

SEQ ID NO: 43031 - DNA, 21 bp, Artificial sequence
  SiRNA target sequence
tggtttatattgaccaatacg

SEQ ID NO: 43032 - DNA, 21 bp, Artificial sequence
  SiRNA target sequence
ggtttatattgaccaatacgc

SEQ ID NO: 43033 - DNA, 21 bp, Artificial sequence
  SiRNA target sequence
gtttatattgaccaatacgct

SEQ ID NO: 43034 - DNA, 21 bp, Artificial sequence
  SiRNA target sequence
tttatattgaccaatacgctt

SEQ ID NO: 43035 - DNA, 21 bp, Artificial sequence
  SiRNA target sequence
ttatattgaccaatacgcttt

SEQ ID NO: 43036 - DNA, 21 bp, Artificial sequence
  SiRNA target sequence
tatattgaccaatacgctttt

SEQ ID NO: 43037 - DNA, 21 bp, Artificial sequence
  SiRNA target sequence
atattgaccaatacgcttttc

SEQ ID NO: 43038 - DNA, 21 bp, Artificial sequence
  SiRNA target sequence
tattgaccaatacgcttttca

SEQ ID NO: 43039 - DNA, 21 bp, Artificial sequence
  SiRNA target sequence
attgaccaatacgcttttcac

SEQ ID NO: 43040 - DNA, 21 bp, Artificial sequence
  SiRNA target sequence
ttgaccaatacgcttttcaca

SEQ ID NO: 43041 - DNA, 21 bp, Artificial sequence
  SiRNA target sequence
tgaccaatacgcttttcacat

SEQ ID NO: 43042 - DNA, 21 bp, Artificial sequence
  SiRNA target sequence
gaccaatacgcttttcacatg

SEQ ID NO: 43043 - DNA, 21 bp, Artificial sequence
  SiRNA target sequence
accaatacgcttttcacatgt

SEQ ID NO: 43044 - DNA, 21 bp, Artificial sequence
  SiRNA target sequence
ccaatacgcttttcacatgtt

SEQ ID NO: 43045 - DNA, 21 bp, Artificial sequence
  SiRNA target sequence
caatacgcttttcacatgtta

SEQ ID NO: 43046 - DNA, 21 bp, Artificial sequence
  SiRNA target sequence
aatacgcttttcacatgttac

SEQ ID NO: 43047 - DNA, 21 bp, Artificial sequence
  SiRNA target sequence
atacgcttttcacatgttaca

SEQ ID NO: 43048 - DNA, 21 bp, Artificial sequence
  SiRNA target sequence
tacgcttttcacatgttacat

SEQ ID NO: 43049 - DNA, 21 bp, Artificial sequence
  SiRNA target sequence
acgcttttcacatgttacatg

SEQ ID NO: 43050 - DNA, 21 bp, Artificial sequence
  SiRNA target sequence
cgcttttcacatgttacatga

SEQ ID NO: 43051 - DNA, 21 bp, Artificial sequence
  SiRNA target sequence
gcttttcacatgttacatgaa

SEQ ID NO: 43052 - DNA, 21 bp, Artificial sequence
  SiRNA target sequence
cttttcacatgttacatgaag

SEQ ID NO: 43053 - DNA, 21 bp, Artificial sequence
  SiRNA target sequence
ttttcacatgttacatgaaga

SEQ ID NO: 43054 - DNA, 21 bp, Artificial sequence
  SiRNA target sequence
tttcacatgttacatgaagac

SEQ ID NO: 43055 - DNA, 21 bp, Artificial sequence
  SiRNA target sequence
ttcacatgttacatgaagaca

SEQ ID NO: 43056 - DNA, 21 bp, Artificial sequence
  SiRNA target sequence
tcacatgttacatgaagacat

SEQ ID NO: 43057 - DNA, 21 bp, Artificial sequence
  SiRNA target sequence
cacatgttacatgaagacata

SEQ ID NO: 43058 - DNA, 21 bp, Artificial sequence
  SiRNA target sequence
acatgttacatgaagacataa

SEQ ID NO: 43059 - DNA, 21 bp, Artificial sequence
  SiRNA target sequence
catgttacatgaagacataaa

SEQ ID NO: 43060 - DNA, 21 bp, Artificial sequence
  SiRNA target sequence
atgttacatgaagacataaat

SEQ ID NO: 43061 - DNA, 21 bp, Artificial sequence
  SiRNA target sequence
tgttacatgaagacataaatt

SEQ ID NO: 43062 - DNA, 21 bp, Artificial sequence
  SiRNA target sequence
gttacatgaagacataaattg

SEQ ID NO: 43063 - DNA, 21 bp, Artificial sequence
  SiRNA target sequence
ttacatgaagacataaattgt

SEQ ID NO: 43064 - DNA, 21 bp, Artificial sequence
  SiRNA target sequence
tacatgaagacataaattgta

SEQ ID NO: 43065 - DNA, 21 bp, Artificial sequence
  SiRNA target sequence
acatgaagacataaattgtat

SEQ ID NO: 43066 - DNA, 21 bp, Artificial sequence
  SiRNA target sequence
catgaagacataaattgtata

SEQ ID NO: 43067 - DNA, 21 bp, Artificial sequence
  SiRNA target sequence
atgaagacataaattgtatag

SEQ ID NO: 43068 - DNA, 21 bp, Artificial sequence
  SiRNA target sequence
tgaagacataaattgtatagg

SEQ ID NO: 43069 - DNA, 21 bp, Artificial sequence
  SiRNA target sequence
gaagacataaattgtataggg

SEQ ID NO: 43070 - DNA, 21 bp, Artificial sequence
  SiRNA target sequence
aagacataaattgtatagggt

SEQ ID NO: 43071 - DNA, 21 bp, Artificial sequence
  SiRNA target sequence
agacataaattgtatagggtt

SEQ ID NO: 43072 - DNA, 21 bp, Artificial sequence
  SiRNA target sequence
gacataaattgtatagggttt

SEQ ID NO: 43073 - DNA, 21 bp, Artificial sequence
  SiRNA target sequence
acataaattgtatagggttta

SEQ ID NO: 43074 - DNA, 21 bp, Artificial sequence
  SiRNA target sequence
cataaattgtatagggtttac

SEQ ID NO: 43075 - DNA, 21 bp, Artificial sequence
  SiRNA target sequence
ataaattgtatagggtttact

SEQ ID NO: 43076 - DNA, 21 bp, Artificial sequence
  SiRNA target sequence
taaattgtatagggtttactc

SEQ ID NO: 43077 - DNA, 21 bp, Artificial sequence
  SiRNA target sequence
aaattgtatagggtttactct

SEQ ID NO: 43078 - DNA, 21 bp, Artificial sequence
  SiRNA target sequence
aattgtatagggtttactcta

SEQ ID NO: 43079 - DNA, 21 bp, Artificial sequence
  SiRNA target sequence
attgtatagggtttactctat

SEQ ID NO: 43080 - DNA, 21 bp, Artificial sequence
  SiRNA target sequence
ttgtatagggtttactctatc

SEQ ID NO: 43081 - DNA, 21 bp, Artificial sequence
  SiRNA target sequence
tgtatagggtttactctatca

SEQ ID NO: 43082 - DNA, 21 bp, Artificial sequence
  SiRNA target sequence
gtatagggtttactctatcaa

SEQ ID NO: 43083 - DNA, 21 bp, Artificial sequence
  SiRNA target sequence
tatagggtttactctatcaat

SEQ ID NO: 43084 - DNA, 21 bp, Artificial sequence
  SiRNA target sequence
atagggtttactctatcaatt

SEQ ID NO: 43085 - DNA, 21 bp, Artificial sequence
  SiRNA target sequence
tagggtttactctatcaattt

SEQ ID NO: 43086 - DNA, 21 bp, Artificial sequence
  SiRNA target sequence
agggtttactctatcaattta

SEQ ID NO: 43087 - DNA, 21 bp, Artificial sequence
  SiRNA target sequence
gggtttactctatcaatttat

SEQ ID NO: 43088 - DNA, 21 bp, Artificial sequence
  SiRNA target sequence
ggtttactctatcaatttatg

SEQ ID NO: 43089 - DNA, 21 bp, Artificial sequence
  SiRNA target sequence
gtttactctatcaatttatga

SEQ ID NO: 43090 - DNA, 21 bp, Artificial sequence
  SiRNA target sequence
tttactctatcaatttatgat

SEQ ID NO: 43091 - DNA, 21 bp, Artificial sequence
  SiRNA target sequence
ttactctatcaatttatgatg

SEQ ID NO: 43092 - DNA, 21 bp, Artificial sequence
  SiRNA target sequence
tactctatcaatttatgatga

SEQ ID NO: 43093 - DNA, 21 bp, Artificial sequence
  SiRNA target sequence
actctatcaatttatgatgaa

SEQ ID NO: 43094 - DNA, 21 bp, Artificial sequence
  SiRNA target sequence
ctctatcaatttatgatgaag

SEQ ID NO: 43095 - DNA, 21 bp, Artificial sequence
  SiRNA target sequence
tctatcaatttatgatgaaga

SEQ ID NO: 43096 - DNA, 21 bp, Artificial sequence
  SiRNA target sequence
ctatcaatttatgatgaagat

SEQ ID NO: 43097 - DNA, 21 bp, Artificial sequence
  SiRNA target sequence
tatcaatttatgatgaagata

SEQ ID NO: 43098 - DNA, 21 bp, Artificial sequence
  SiRNA target sequence
atcaatttatgatgaagataa

SEQ ID NO: 43099 - DNA, 21 bp, Artificial sequence
  SiRNA target sequence
tcaatttatgatgaagataaa

SEQ ID NO: 43100 - DNA, 21 bp, Artificial sequence
  SiRNA target sequence
caatttatgatgaagataaac

SEQ ID NO: 43101 - DNA, 21 bp, Artificial sequence
  SiRNA target sequence
aatttatgatgaagataaacg

SEQ ID NO: 43102 - DNA, 21 bp, Artificial sequence
  SiRNA target sequence
atttatgatgaagataaacga

SEQ ID NO: 43103 - DNA, 21 bp, Artificial sequence
  SiRNA target sequence
tttatgatgaagataaacgaa

SEQ ID NO: 43104 - DNA, 21 bp, Artificial sequence
  SiRNA target sequence
ttatgatgaagataaacgaat

SEQ ID NO: 43105 - DNA, 21 bp, Artificial sequence
  SiRNA target sequence
tatgatgaagataaacgaatg

SEQ ID NO: 43106 - DNA, 21 bp, Artificial sequence
  SiRNA target sequence
atgatgaagataaacgaatga

SEQ ID NO: 43107 - DNA, 21 bp, Artificial sequence
  SiRNA target sequence
tgatgaagataaacgaatgaa

SEQ ID NO: 43108 - DNA, 21 bp, Artificial sequence
  SiRNA target sequence
gatgaagataaacgaatgaag

SEQ ID NO: 43109 - DNA, 21 bp, Artificial sequence
  SiRNA target sequence
atgaagataaacgaatgaagg

SEQ ID NO: 43110 - DNA, 21 bp, Artificial sequence
  SiRNA target sequence
tgaagataaacgaatgaagga

SEQ ID NO: 43111 - DNA, 21 bp, Artificial sequence
  SiRNA target sequence
gaagataaacgaatgaaggac

SEQ ID NO: 43112 - DNA, 21 bp, Artificial sequence
  SiRNA target sequence
aagataaacgaatgaaggaca

SEQ ID NO: 43113 - DNA, 21 bp, Artificial sequence
  SiRNA target sequence
agataaacgaatgaaggacat

SEQ ID NO: 43114 - DNA, 21 bp, Artificial sequence
  SiRNA target sequence
gataaacgaatgaaggacata

SEQ ID NO: 43115 - DNA, 21 bp, Artificial sequence
  SiRNA target sequence
ataaacgaatgaaggacataa

SEQ ID NO: 43116 - DNA, 21 bp, Artificial sequence
  SiRNA target sequence
taaacgaatgaaggacataac

SEQ ID NO: 43117 - DNA, 21 bp, Artificial sequence
  SiRNA target sequence
aaacgaatgaaggacataact

SEQ ID NO: 43118 - DNA, 21 bp, Artificial sequence
  SiRNA target sequence
aacgaatgaaggacataactt

SEQ ID NO: 43119 - DNA, 21 bp, Artificial sequence
  SiRNA target sequence
acgaatgaaggacataactta

SEQ ID NO: 43120 - DNA, 21 bp, Artificial sequence
  SiRNA target sequence
cgaatgaaggacataacttat

SEQ ID NO: 43121 - DNA, 21 bp, Artificial sequence
  SiRNA target sequence
gaatgaaggacataacttatt

SEQ ID NO: 43122 - DNA, 21 bp, Artificial sequence
  SiRNA target sequence
aatgaaggacataacttattg

SEQ ID NO: 43123 - DNA, 21 bp, Artificial sequence
  SiRNA target sequence
atgaaggacataacttattgg

SEQ ID NO: 43124 - DNA, 21 bp, Artificial sequence
  SiRNA target sequence
tgaaggacataacttattggg

SEQ ID NO: 43125 - DNA, 21 bp, Artificial sequence
  SiRNA target sequence
gaaggacataacttattggga

SEQ ID NO: 43126 - DNA, 21 bp, Artificial sequence
  SiRNA target sequence
aaggacataacttattgggat

SEQ ID NO: 43127 - DNA, 21 bp, Artificial sequence
  SiRNA target sequence
aggacataacttattgggatc

SEQ ID NO: 43128 - DNA, 21 bp, Artificial sequence
  SiRNA target sequence
ggacataacttattgggatct

SEQ ID NO: 43129 - DNA, 21 bp, Artificial sequence
  SiRNA target sequence
gacataacttattgggatctg

SEQ ID NO: 43130 - DNA, 21 bp, Artificial sequence
  SiRNA target sequence
acataacttattgggatctga

SEQ ID NO: 43131 - DNA, 21 bp, Artificial sequence
  SiRNA target sequence
cataacttattgggatctgaa

SEQ ID NO: 43132 - DNA, 21 bp, Artificial sequence
  SiRNA target sequence
ataacttattgggatctgaat

SEQ ID NO: 43133 - DNA, 21 bp, Artificial sequence
  SiRNA target sequence
taacttattgggatctgaatt

SEQ ID NO: 43134 - DNA, 21 bp, Artificial sequence
  SiRNA target sequence
aacttattgggatctgaattg

SEQ ID NO: 43135 - DNA, 21 bp, Artificial sequence
  SiRNA target sequence
acttattgggatctgaattgt

SEQ ID NO: 43136 - DNA, 21 bp, Artificial sequence
  SiRNA target sequence
cttattgggatctgaattgtg

SEQ ID NO: 43137 - DNA, 21 bp, Artificial sequence
  SiRNA target sequence
ttattgggatctgaattgtga

SEQ ID NO: 43138 - DNA, 21 bp, Artificial sequence
  SiRNA target sequence
tattgggatctgaattgtgaa

SEQ ID NO: 43139 - DNA, 21 bp, Artificial sequence
  SiRNA target sequence
attgggatctgaattgtgaat

SEQ ID NO: 43140 - DNA, 21 bp, Artificial sequence
  SiRNA target sequence
ttgggatctgaattgtgaata

SEQ ID NO: 43141 - DNA, 21 bp, Artificial sequence
  SiRNA target sequence
tgggatctgaattgtgaatat

SEQ ID NO: 43142 - DNA, 21 bp, Artificial sequence
  SiRNA target sequence
gggatctgaattgtgaatatc

SEQ ID NO: 43143 - DNA, 21 bp, Artificial sequence
  SiRNA target sequence
ggatctgaattgtgaatatca

SEQ ID NO: 43144 - DNA, 21 bp, Artificial sequence
  SiRNA target sequence
gatctgaattgtgaatatcat

SEQ ID NO: 43145 - DNA, 21 bp, Artificial sequence
  SiRNA target sequence
atctgaattgtgaatatcatg

SEQ ID NO: 43146 - DNA, 21 bp, Artificial sequence
  SiRNA target sequence
tctgaattgtgaatatcatga

SEQ ID NO: 43147 - DNA, 21 bp, Artificial sequence
  SiRNA target sequence
ctgaattgtgaatatcatgaa

SEQ ID NO: 43148 - DNA, 21 bp, Artificial sequence
  SiRNA target sequence
tgaattgtgaatatcatgaaa

SEQ ID NO: 43149 - DNA, 21 bp, Artificial sequence
  SiRNA target sequence
gaattgtgaatatcatgaaaa

SEQ ID NO: 43150 - DNA, 21 bp, Artificial sequence
  SiRNA target sequence
aattgtgaatatcatgaaaat

SEQ ID NO: 43151 - DNA, 21 bp, Artificial sequence
  SiRNA target sequence
attgtgaatatcatgaaaatt

SEQ ID NO: 43152 - DNA, 21 bp, Artificial sequence
  SiRNA target sequence
ttgtgaatatcatgaaaattt

SEQ ID NO: 43153 - DNA, 21 bp, Artificial sequence
  SiRNA target sequence
tgtgaatatcatgaaaattta

SEQ ID NO: 43154 - DNA, 21 bp, Artificial sequence
  SiRNA target sequence
gtgaatatcatgaaaatttat

SEQ ID NO: 43155 - DNA, 21 bp, Artificial sequence
  SiRNA target sequence
tgaatatcatgaaaatttata

SEQ ID NO: 43156 - DNA, 21 bp, Artificial sequence
  SiRNA target sequence
gaatatcatgaaaatttatat

SEQ ID NO: 43157 - DNA, 21 bp, Artificial sequence
  SiRNA target sequence
aatatcatgaaaatttatatg

SEQ ID NO: 43158 - DNA, 21 bp, Artificial sequence
  SiRNA target sequence
atatcatgaaaatttatatga

SEQ ID NO: 43159 - DNA, 21 bp, Artificial sequence
  SiRNA target sequence
tatcatgaaaatttatatgat

SEQ ID NO: 43160 - DNA, 21 bp, Artificial sequence
  SiRNA target sequence
atcatgaaaatttatatgatg

SEQ ID NO: 43161 - DNA, 21 bp, Artificial sequence
  SiRNA target sequence
tcatgaaaatttatatgatgc

SEQ ID NO: 43162 - DNA, 21 bp, Artificial sequence
  SiRNA target sequence
catgaaaatttatatgatgca

SEQ ID NO: 43163 - DNA, 21 bp, Artificial sequence
  SiRNA target sequence
atgaaaatttatatgatgcac

SEQ ID NO: 43164 - DNA, 21 bp, Artificial sequence
  SiRNA target sequence
tgaaaatttatatgatgcact

SEQ ID NO: 43165 - DNA, 21 bp, Artificial sequence
  SiRNA target sequence
gaaaatttatatgatgcacta

SEQ ID NO: 43166 - DNA, 21 bp, Artificial sequence
  SiRNA target sequence
aaaatttatatgatgcactaa

SEQ ID NO: 43167 - DNA, 21 bp, Artificial sequence
  SiRNA target sequence
aaatttatatgatgcactaat

SEQ ID NO: 43168 - DNA, 21 bp, Artificial sequence
  SiRNA target sequence
aatttatatgatgcactaatg

SEQ ID NO: 43169 - DNA, 21 bp, Artificial sequence
  SiRNA target sequence
atttatatgatgcactaatgt

SEQ ID NO: 43170 - DNA, 21 bp, Artificial sequence
  SiRNA target sequence
tttatatgatgcactaatgtc

SEQ ID NO: 43171 - DNA, 21 bp, Artificial sequence
  SiRNA target sequence
ttatatgatgcactaatgtcg

SEQ ID NO: 43172 - DNA, 21 bp, Artificial sequence
  SiRNA target sequence
tatatgatgcactaatgtcgg

SEQ ID NO: 43173 - DNA, 21 bp, Artificial sequence
  SiRNA target sequence
atatgatgcactaatgtcggc

SEQ ID NO: 43174 - DNA, 21 bp, Artificial sequence
  SiRNA target sequence
tatgatgcactaatgtcggcc

SEQ ID NO: 43175 - DNA, 21 bp, Artificial sequence
  SiRNA target sequence
atgatgcactaatgtcggccg

SEQ ID NO: 43176 - DNA, 21 bp, Artificial sequence
  SiRNA target sequence
tgatgcactaatgtcggccga

SEQ ID NO: 43177 - DNA, 21 bp, Artificial sequence
  SiRNA target sequence
gatgcactaatgtcggccgaa

SEQ ID NO: 43178 - DNA, 21 bp, Artificial sequence
  SiRNA target sequence
atgcactaatgtcggccgaat

SEQ ID NO: 43179 - DNA, 21 bp, Artificial sequence
  SiRNA target sequence
tgcactaatgtcggccgaatt

SEQ ID NO: 43180 - DNA, 21 bp, Artificial sequence
  SiRNA target sequence
gcactaatgtcggccgaattt

SEQ ID NO: 43181 - DNA, 21 bp, Artificial sequence
  SiRNA target sequence
cactaatgtcggccgaatttg

SEQ ID NO: 43182 - DNA, 21 bp, Artificial sequence
  SiRNA target sequence
actaatgtcggccgaatttga

SEQ ID NO: 43183 - DNA, 21 bp, Artificial sequence
  SiRNA target sequence
ctaatgtcggccgaatttgaa

SEQ ID NO: 43184 - DNA, 21 bp, Artificial sequence
  SiRNA target sequence
taatgtcggccgaatttgaac

SEQ ID NO: 43185 - DNA, 21 bp, Artificial sequence
  SiRNA target sequence
aatgtcggccgaatttgaaca

SEQ ID NO: 43186 - DNA, 21 bp, Artificial sequence
  SiRNA target sequence
atgtcggccgaatttgaacaa

SEQ ID NO: 43187 - DNA, 21 bp, Artificial sequence
  SiRNA target sequence
tgtcggccgaatttgaacaag

SEQ ID NO: 43188 - DNA, 21 bp, Artificial sequence
  SiRNA target sequence
gtcggccgaatttgaacaagt

SEQ ID NO: 43189 - DNA, 21 bp, Artificial sequence
  SiRNA target sequence
tcggccgaatttgaacaagtt

SEQ ID NO: 43190 - DNA, 21 bp, Artificial sequence
  SiRNA target sequence
cggccgaatttgaacaagttt

SEQ ID NO: 43191 - DNA, 21 bp, Artificial sequence
  SiRNA target sequence
ggccgaatttgaacaagtttg

SEQ ID NO: 43192 - DNA, 21 bp, Artificial sequence
  SiRNA target sequence
gccgaatttgaacaagtttgg

SEQ ID NO: 43193 - DNA, 21 bp, Artificial sequence
  SiRNA target sequence
ccgaatttgaacaagtttggt

SEQ ID NO: 43194 - DNA, 21 bp, Artificial sequence
  SiRNA target sequence
cgaatttgaacaagtttggtt

SEQ ID NO: 43195 - DNA, 21 bp, Artificial sequence
  SiRNA target sequence
gaatttgaacaagtttggttt

SEQ ID NO: 43196 - DNA, 21 bp, Artificial sequence
  SiRNA target sequence
aatttgaacaagtttggttta

SEQ ID NO: 43197 - DNA, 21 bp, Artificial sequence
  SiRNA target sequence
atttgaacaagtttggtttac

SEQ ID NO: 43198 - DNA, 21 bp, Artificial sequence
  SiRNA target sequence
tttgaacaagtttggtttaca

SEQ ID NO: 43199 - DNA, 21 bp, Artificial sequence
  SiRNA target sequence
ttgaacaagtttggtttacat

SEQ ID NO: 43200 - DNA, 21 bp, Artificial sequence
  SiRNA target sequence
tgaacaagtttggtttacatt

SEQ ID NO: 43201 - DNA, 21 bp, Artificial sequence
  SiRNA target sequence
gaacaagtttggtttacatta

SEQ ID NO: 43202 - DNA, 21 bp, Artificial sequence
  SiRNA target sequence
aacaagtttggtttacattat

SEQ ID NO: 43203 - DNA, 21 bp, Artificial sequence
  SiRNA target sequence
acaagtttggtttacattatt

SEQ ID NO: 43204 - DNA, 21 bp, Artificial sequence
  SiRNA target sequence
caagtttggtttacattattg

SEQ ID NO: 43205 - DNA, 21 bp, Artificial sequence
  SiRNA target sequence
aagtttggtttacattattgc

SEQ ID NO: 43206 - DNA, 21 bp, Artificial sequence
  SiRNA target sequence
agtttggtttacattattgct

SEQ ID NO: 43207 - DNA, 21 bp, Artificial sequence
  SiRNA target sequence
gtttggtttacattattgctt

SEQ ID NO: 43208 - DNA, 21 bp, Artificial sequence
  SiRNA target sequence
tttggtttacattattgctta

SEQ ID NO: 43209 - DNA, 21 bp, Artificial sequence
  SiRNA target sequence
ttggtttacattattgcttaa

SEQ ID NO: 43210 - DNA, 21 bp, Artificial sequence
  SiRNA target sequence
tggtttacattattgcttaaa

SEQ ID NO: 43211 - DNA, 21 bp, Artificial sequence
  SiRNA target sequence
ggtttacattattgcttaaat

SEQ ID NO: 43212 - DNA, 21 bp, Artificial sequence
  SiRNA target sequence
gtttacattattgcttaaata

SEQ ID NO: 43213 - DNA, 21 bp, Artificial sequence
  SiRNA target sequence
tttacattattgcttaaatat

SEQ ID NO: 43214 - DNA, 21 bp, Artificial sequence
  SiRNA target sequence
ttacattattgcttaaatatc

SEQ ID NO: 43215 - DNA, 21 bp, Artificial sequence
  SiRNA target sequence
tacattattgcttaaatatct

SEQ ID NO: 43216 - DNA, 21 bp, Artificial sequence
  SiRNA target sequence
acattattgcttaaatatctt

SEQ ID NO: 43217 - DNA, 21 bp, Artificial sequence
  SiRNA target sequence
cattattgcttaaatatcttg

SEQ ID NO: 43218 - DNA, 21 bp, Artificial sequence
  SiRNA target sequence
attattgcttaaatatcttga

SEQ ID NO: 43219 - DNA, 21 bp, Artificial sequence
  SiRNA target sequence
ttattgcttaaatatcttgat

SEQ ID NO: 43220 - DNA, 21 bp, Artificial sequence
  SiRNA target sequence
tattgcttaaatatcttgatt

SEQ ID NO: 43221 - DNA, 21 bp, Artificial sequence
  SiRNA target sequence
attgcttaaatatcttgattt

SEQ ID NO: 43222 - DNA, 21 bp, Artificial sequence
  SiRNA target sequence
ttgcttaaatatcttgatttt

SEQ ID NO: 43223 - DNA, 21 bp, Artificial sequence
  SiRNA target sequence
tgcttaaatatcttgattttg

SEQ ID NO: 43224 - DNA, 21 bp, Artificial sequence
  SiRNA target sequence
gcttaaatatcttgattttgt

SEQ ID NO: 43225 - DNA, 21 bp, Artificial sequence
  SiRNA target sequence
cttaaatatcttgattttgta

SEQ ID NO: 43226 - DNA, 21 bp, Artificial sequence
  SiRNA target sequence
ttaaatatcttgattttgtac

SEQ ID NO: 43227 - DNA, 21 bp, Artificial sequence
  SiRNA target sequence
taaatatcttgattttgtacc

SEQ ID NO: 43228 - DNA, 21 bp, Artificial sequence
  SiRNA target sequence
aaatatcttgattttgtacca

SEQ ID NO: 43229 - DNA, 21 bp, Artificial sequence
  SiRNA target sequence
aatatcttgattttgtaccag

SEQ ID NO: 43230 - DNA, 21 bp, Artificial sequence
  SiRNA target sequence
atatcttgattttgtaccagt

SEQ ID NO: 43231 - DNA, 21 bp, Artificial sequence
  SiRNA target sequence
tatcttgattttgtaccagta

SEQ ID NO: 43232 - DNA, 21 bp, Artificial sequence
  SiRNA target sequence
atcttgattttgtaccagtac

SEQ ID NO: 43233 - DNA, 21 bp, Artificial sequence
  SiRNA target sequence
tcttgattttgtaccagtacc

SEQ ID NO: 43234 - DNA, 21 bp, Artificial sequence
  SiRNA target sequence
cttgattttgtaccagtacca

SEQ ID NO: 43235 - DNA, 21 bp, Artificial sequence
  SiRNA target sequence
ttgattttgtaccagtaccaa

SEQ ID NO: 43236 - DNA, 21 bp, Artificial sequence
  SiRNA target sequence
tgattttgtaccagtaccaat

SEQ ID NO: 43237 - DNA, 21 bp, Artificial sequence
  SiRNA target sequence
gattttgtaccagtaccaatg

SEQ ID NO: 43238 - DNA, 21 bp, Artificial sequence
  SiRNA target sequence
attttgtaccagtaccaatga

SEQ ID NO: 43239 - DNA, 21 bp, Artificial sequence
  SiRNA target sequence
ttttgtaccagtaccaatgaa

SEQ ID NO: 43240 - DNA, 21 bp, Artificial sequence
  SiRNA target sequence
tttgtaccagtaccaatgaat

SEQ ID NO: 43241 - DNA, 21 bp, Artificial sequence
  SiRNA target sequence
ttgtaccagtaccaatgaatt

SEQ ID NO: 43242 - DNA, 21 bp, Artificial sequence
  SiRNA target sequence
tgtaccagtaccaatgaattg

SEQ ID NO: 43243 - DNA, 21 bp, Artificial sequence
  SiRNA target sequence
gtaccagtaccaatgaattgg

SEQ ID NO: 43244 - DNA, 21 bp, Artificial sequence
  SiRNA target sequence
taccagtaccaatgaattgga

SEQ ID NO: 43245 - DNA, 21 bp, Artificial sequence
  SiRNA target sequence
accagtaccaatgaattggag

SEQ ID NO: 43246 - DNA, 21 bp, Artificial sequence
  SiRNA target sequence
ccagtaccaatgaattggaga

SEQ ID NO: 43247 - DNA, 21 bp, Artificial sequence
  SiRNA target sequence
cagtaccaatgaattggagag

SEQ ID NO: 43248 - DNA, 21 bp, Artificial sequence
  SiRNA target sequence
agtaccaatgaattggagagg

SEQ ID NO: 43249 - DNA, 21 bp, Artificial sequence
  SiRNA target sequence
gtaccaatgaattggagagga

SEQ ID NO: 43250 - DNA, 21 bp, Artificial sequence
  SiRNA target sequence
taccaatgaattggagaggaa

SEQ ID NO: 43251 - DNA, 21 bp, Artificial sequence
  SiRNA target sequence
accaatgaattggagaggaat

SEQ ID NO: 43252 - DNA, 21 bp, Artificial sequence
  SiRNA target sequence
ccaatgaattggagaggaatg

SEQ ID NO: 43253 - DNA, 21 bp, Artificial sequence
  SiRNA target sequence
caatgaattggagaggaatgc

SEQ ID NO: 43254 - DNA, 21 bp, Artificial sequence
  SiRNA target sequence
aatgaattggagaggaatgcc

SEQ ID NO: 43255 - DNA, 21 bp, Artificial sequence
  SiRNA target sequence
atgaattggagaggaatgcca

SEQ ID NO: 43256 - DNA, 21 bp, Artificial sequence
  SiRNA target sequence
tgaattggagaggaatgccag

SEQ ID NO: 43257 - DNA, 21 bp, Artificial sequence
  SiRNA target sequence
gaattggagaggaatgccaga

SEQ ID NO: 43258 - DNA, 21 bp, Artificial sequence
  SiRNA target sequence
aattggagaggaatgccagaa

SEQ ID NO: 43259 - DNA, 21 bp, Artificial sequence
  SiRNA target sequence
attggagaggaatgccagaat

SEQ ID NO: 43260 - DNA, 21 bp, Artificial sequence
  SiRNA target sequence
ttggagaggaatgccagaatt

SEQ ID NO: 43261 - DNA, 21 bp, Artificial sequence
  SiRNA target sequence
tggagaggaatgccagaattt

SEQ ID NO: 43262 - DNA, 21 bp, Artificial sequence
  SiRNA target sequence
ggagaggaatgccagaatttc

SEQ ID NO: 43263 - DNA, 21 bp, Artificial sequence
  SiRNA target sequence
gagaggaatgccagaatttcc

SEQ ID NO: 43264 - DNA, 21 bp, Artificial sequence
  SiRNA target sequence
agaggaatgccagaatttcct

SEQ ID NO: 43265 - DNA, 21 bp, Artificial sequence
  SiRNA target sequence
gaggaatgccagaatttccta

SEQ ID NO: 43266 - DNA, 21 bp, Artificial sequence
  SiRNA target sequence
aggaatgccagaatttcctac

SEQ ID NO: 43267 - DNA, 21 bp, Artificial sequence
  SiRNA target sequence
ggaatgccagaatttcctacc

SEQ ID NO: 43268 - DNA, 21 bp, Artificial sequence
  SiRNA target sequence
gaatgccagaatttcctacca

SEQ ID NO: 43269 - DNA, 21 bp, Artificial sequence
  SiRNA target sequence
aatgccagaatttcctaccat

SEQ ID NO: 43270 - DNA, 21 bp, Artificial sequence
  SiRNA target sequence
atgccagaatttcctaccatt

SEQ ID NO: 43271 - DNA, 21 bp, Artificial sequence
  SiRNA target sequence
tgccagaatttcctaccattt

SEQ ID NO: 43272 - DNA, 21 bp, Artificial sequence
  SiRNA target sequence
gccagaatttcctaccattta

SEQ ID NO: 43273 - DNA, 21 bp, Artificial sequence
  SiRNA target sequence
ccagaatttcctaccatttat

SEQ ID NO: 43274 - DNA, 21 bp, Artificial sequence
  SiRNA target sequence
cagaatttcctaccatttatg

SEQ ID NO: 43275 - DNA, 21 bp, Artificial sequence
  SiRNA target sequence
agaatttcctaccatttatgt

SEQ ID NO: 43276 - DNA, 21 bp, Artificial sequence
  SiRNA target sequence
gaatttcctaccatttatgta

SEQ ID NO: 43277 - DNA, 21 bp, Artificial sequence
  SiRNA target sequence
aatttcctaccatttatgtat

SEQ ID NO: 43278 - DNA, 21 bp, Artificial sequence
  SiRNA target sequence
atttcctaccatttatgtatc

SEQ ID NO: 43279 - DNA, 21 bp, Artificial sequence
  SiRNA target sequence
tttcctaccatttatgtatca

SEQ ID NO: 43280 - DNA, 21 bp, Artificial sequence
  SiRNA target sequence
ttcctaccatttatgtatcaa

SEQ ID NO: 43281 - DNA, 21 bp, Artificial sequence
  SiRNA target sequence
tcctaccatttatgtatcaaa

SEQ ID NO: 43282 - DNA, 21 bp, Artificial sequence
  SiRNA target sequence
cctaccatttatgtatcaaaa

SEQ ID NO: 43283 - DNA, 21 bp, Artificial sequence
  SiRNA target sequence
ctaccatttatgtatcaaaac

SEQ ID NO: 43284 - DNA, 21 bp, Artificial sequence
  SiRNA target sequence
taccatttatgtatcaaaaca

SEQ ID NO: 43285 - DNA, 21 bp, Artificial sequence
  SiRNA target sequence
accatttatgtatcaaaacat

SEQ ID NO: 43286 - DNA, 21 bp, Artificial sequence
  SiRNA target sequence
ccatttatgtatcaaaacatt

SEQ ID NO: 43287 - DNA, 21 bp, Artificial sequence
  SiRNA target sequence
catttatgtatcaaaacattt

SEQ ID NO: 43288 - DNA, 21 bp, Artificial sequence
  SiRNA target sequence
atttatgtatcaaaacatttt

SEQ ID NO: 43289 - DNA, 21 bp, Artificial sequence
  SiRNA target sequence
tttatgtatcaaaacattttt

SEQ ID NO: 43290 - DNA, 21 bp, Artificial sequence
  SiRNA target sequence
ttatgtatcaaaacatttttg

SEQ ID NO: 43291 - DNA, 21 bp, Artificial sequence
  SiRNA target sequence
tatgtatcaaaacatttttgg

SEQ ID NO: 43292 - DNA, 21 bp, Artificial sequence
  SiRNA target sequence
atgtatcaaaacatttttggt

SEQ ID NO: 43293 - DNA, 21 bp, Artificial sequence
  SiRNA target sequence
tgtatcaaaacatttttggta

SEQ ID NO: 43294 - DNA, 21 bp, Artificial sequence
  SiRNA target sequence
gtatcaaaacatttttggtat

SEQ ID NO: 43295 - DNA, 21 bp, Artificial sequence
  SiRNA target sequence
tatcaaaacatttttggtatg

SEQ ID NO: 43296 - DNA, 21 bp, Artificial sequence
  SiRNA target sequence
atcaaaacatttttggtatga

SEQ ID NO: 43297 - DNA, 21 bp, Artificial sequence
  SiRNA target sequence
tcaaaacatttttggtatgaa

SEQ ID NO: 43298 - DNA, 21 bp, Artificial sequence
  SiRNA target sequence
caaaacatttttggtatgaat

SEQ ID NO: 43299 - DNA, 21 bp, Artificial sequence
  SiRNA target sequence
aaaacatttttggtatgaatt

SEQ ID NO: 43300 - DNA, 21 bp, Artificial sequence
  SiRNA target sequence
aaacatttttggtatgaatta

SEQ ID NO: 43301 - DNA, 21 bp, Artificial sequence
  SiRNA target sequence
aacatttttggtatgaattat

SEQ ID NO: 43302 - DNA, 21 bp, Artificial sequence
  SiRNA target sequence
acatttttggtatgaattata

SEQ ID NO: 43303 - DNA, 21 bp, Artificial sequence
  SiRNA target sequence
catttttggtatgaattatat

SEQ ID NO: 43304 - DNA, 21 bp, Artificial sequence
  SiRNA target sequence
atttttggtatgaattatatc

SEQ ID NO: 43305 - DNA, 21 bp, Artificial sequence
  SiRNA target sequence
tttttggtatgaattatatcg

SEQ ID NO: 43306 - DNA, 21 bp, Artificial sequence
  SiRNA target sequence
ttttggtatgaattatatcgc

SEQ ID NO: 43307 - DNA, 21 bp, Artificial sequence
  SiRNA target sequence
tttggtatgaattatatcgca

SEQ ID NO: 43308 - DNA, 21 bp, Artificial sequence
  SiRNA target sequence
ttggtatgaattatatcgcat

SEQ ID NO: 43309 - DNA, 21 bp, Artificial sequence
  SiRNA target sequence
tggtatgaattatatcgcatt

SEQ ID NO: 43310 - DNA, 21 bp, Artificial sequence
  SiRNA target sequence
ggtatgaattatatcgcattg

SEQ ID NO: 43311 - DNA, 21 bp, Artificial sequence
  SiRNA target sequence
gtatgaattatatcgcattgg

SEQ ID NO: 43312 - DNA, 21 bp, Artificial sequence
  SiRNA target sequence
tatgaattatatcgcattgga

SEQ ID NO: 43313 - DNA, 21 bp, Artificial sequence
  SiRNA target sequence
atgaattatatcgcattggat

SEQ ID NO: 43314 - DNA, 21 bp, Artificial sequence
  SiRNA target sequence
tgaattatatcgcattggatt

SEQ ID NO: 43315 - DNA, 21 bp, Artificial sequence
  SiRNA target sequence
gaattatatcgcattggattt

SEQ ID NO: 43316 - DNA, 21 bp, Artificial sequence
  SiRNA target sequence
aattatatcgcattggatttt

SEQ ID NO: 43317 - DNA, 21 bp, Artificial sequence
  SiRNA target sequence
attatatcgcattggattttt

SEQ ID NO: 43318 - DNA, 21 bp, Artificial sequence
  SiRNA target sequence
ttatatcgcattggatttttg

SEQ ID NO: 43319 - DNA, 21 bp, Artificial sequence
  SiRNA target sequence
tatatcgcattggatttttga

SEQ ID NO: 43320 - DNA, 21 bp, Artificial sequence
  SiRNA target sequence
atatcgcattggatttttgaa

SEQ ID NO: 43321 - DNA, 21 bp, Artificial sequence
  SiRNA target sequence
tatcgcattggatttttgaat

SEQ ID NO: 43322 - DNA, 21 bp, Artificial sequence
  SiRNA target sequence
atcgcattggatttttgaata

SEQ ID NO: 43323 - DNA, 21 bp, Artificial sequence
  SiRNA target sequence
tcgcattggatttttgaataa

SEQ ID NO: 43324 - DNA, 21 bp, Artificial sequence
  SiRNA target sequence
cgcattggatttttgaataag

SEQ ID NO: 43325 - DNA, 21 bp, Artificial sequence
  SiRNA target sequence
gcattggatttttgaataagt

SEQ ID NO: 43326 - DNA, 21 bp, Artificial sequence
  SiRNA target sequence
cattggatttttgaataagtt

SEQ ID NO: 43327 - DNA, 21 bp, Artificial sequence
  SiRNA target sequence
attggatttttgaataagtta

SEQ ID NO: 43328 - DNA, 21 bp, Artificial sequence
  SiRNA target sequence
ttggatttttgaataagttat

SEQ ID NO: 43329 - DNA, 21 bp, Artificial sequence
  SiRNA target sequence
tggatttttgaataagttata

SEQ ID NO: 43330 - DNA, 21 bp, Artificial sequence
  SiRNA target sequence
ggatttttgaataagttatat

SEQ ID NO: 43331 - DNA, 21 bp, Artificial sequence
  SiRNA target sequence
gatttttgaataagttatata

SEQ ID NO: 43332 - DNA, 21 bp, Artificial sequence
  SiRNA target sequence
atttttgaataagttatataa

SEQ ID NO: 43333 - DNA, 21 bp, Artificial sequence
  SiRNA target sequence
tttttgaataagttatataaa

SEQ ID NO: 43334 - DNA, 21 bp, Artificial sequence
  SiRNA target sequence
ttttgaataagttatataaat

SEQ ID NO: 43335 - DNA, 21 bp, Artificial sequence
  SiRNA target sequence
tttgaataagttatataaatg

SEQ ID NO: 43336 - DNA, 21 bp, Artificial sequence
  SiRNA target sequence
ttgaataagttatataaatgt

SEQ ID NO: 43337 - DNA, 21 bp, Artificial sequence
  SiRNA target sequence
tgaataagttatataaatgtg

SEQ ID NO: 43338 - DNA, 21 bp, Artificial sequence
  SiRNA target sequence
gaataagttatataaatgtgg

SEQ ID NO: 43339 - DNA, 21 bp, Artificial sequence
  SiRNA target sequence
aataagttatataaatgtgga

SEQ ID NO: 43340 - DNA, 21 bp, Artificial sequence
  SiRNA target sequence
ataagttatataaatgtggaa

SEQ ID NO: 43341 - DNA, 21 bp, Artificial sequence
  SiRNA target sequence
taagttatataaatgtggaac

SEQ ID NO: 43342 - DNA, 21 bp, Artificial sequence
  SiRNA target sequence
aagttatataaatgtggaact

SEQ ID NO: 43343 - DNA, 21 bp, Artificial sequence
  SiRNA target sequence
agttatataaatgtggaactt

SEQ ID NO: 43344 - DNA, 21 bp, Artificial sequence
  SiRNA target sequence
gttatataaatgtggaacttg

SEQ ID NO: 43345 - DNA, 21 bp, Artificial sequence
  SiRNA target sequence
ttatataaatgtggaacttgg

SEQ ID NO: 43346 - DNA, 21 bp, Artificial sequence
  SiRNA target sequence
tatataaatgtggaacttggg

SEQ ID NO: 43347 - DNA, 21 bp, Artificial sequence
  SiRNA target sequence
atataaatgtggaacttggga

SEQ ID NO: 43348 - DNA, 21 bp, Artificial sequence
  SiRNA target sequence
tataaatgtggaacttgggag

SEQ ID NO: 43349 - DNA, 21 bp, Artificial sequence
  SiRNA target sequence
ataaatgtggaacttgggagt

SEQ ID NO: 43350 - DNA, 21 bp, Artificial sequence
  SiRNA target sequence
taaatgtggaacttgggagtc

SEQ ID NO: 43351 - DNA, 21 bp, Artificial sequence
  SiRNA target sequence
aaatgtggaacttgggagtca

SEQ ID NO: 43352 - DNA, 21 bp, Artificial sequence
  SiRNA target sequence
aatgtggaacttgggagtcag

SEQ ID NO: 43353 - DNA, 21 bp, Artificial sequence
  SiRNA target sequence
atgtggaacttgggagtcagt

SEQ ID NO: 43354 - DNA, 21 bp, Artificial sequence
  SiRNA target sequence
tgtggaacttgggagtcagta

SEQ ID NO: 43355 - DNA, 21 bp, Artificial sequence
  SiRNA target sequence
gtggaacttgggagtcagtat

SEQ ID NO: 43356 - DNA, 21 bp, Artificial sequence
  SiRNA target sequence
tggaacttgggagtcagtatt

SEQ ID NO: 43357 - DNA, 21 bp, Artificial sequence
  SiRNA target sequence
ggaacttgggagtcagtatta

SEQ ID NO: 43358 - DNA, 21 bp, Artificial sequence
  SiRNA target sequence
gaacttgggagtcagtattaa

SEQ ID NO: 43359 - DNA, 21 bp, Artificial sequence
  SiRNA target sequence
aacttgggagtcagtattaaa

SEQ ID NO: 43360 - DNA, 21 bp, Artificial sequence
  SiRNA target sequence
acttgggagtcagtattaaat

SEQ ID NO: 43361 - DNA, 21 bp, Artificial sequence
  SiRNA target sequence
cttgggagtcagtattaaatc

SEQ ID NO: 43362 - DNA, 21 bp, Artificial sequence
  SiRNA target sequence
ttgggagtcagtattaaatct

SEQ ID NO: 43363 - DNA, 21 bp, Artificial sequence
  SiRNA target sequence
tgggagtcagtattaaatctc

SEQ ID NO: 43364 - DNA, 21 bp, Artificial sequence
  SiRNA target sequence
gggagtcagtattaaatctct

SEQ ID NO: 43365 - DNA, 21 bp, Artificial sequence
  SiRNA target sequence
ggagtcagtattaaatctctt

SEQ ID NO: 43366 - DNA, 21 bp, Artificial sequence
  SiRNA target sequence
gagtcagtattaaatctctta

SEQ ID NO: 43367 - DNA, 21 bp, Artificial sequence
  SiRNA target sequence
agtcagtattaaatctcttag

SEQ ID NO: 43368 - DNA, 21 bp, Artificial sequence
  SiRNA target sequence
gtcagtattaaatctcttagc

SEQ ID NO: 43369 - DNA, 21 bp, Artificial sequence
  SiRNA target sequence
tcagtattaaatctcttagcc

SEQ ID NO: 43370 - DNA, 21 bp, Artificial sequence
  SiRNA target sequence
cagtattaaatctcttagccg

SEQ ID NO: 43371 - DNA, 21 bp, Artificial sequence
  SiRNA target sequence
agtattaaatctcttagccgg

SEQ ID NO: 43372 - DNA, 21 bp, Artificial sequence
  SiRNA target sequence
gtattaaatctcttagccgga

SEQ ID NO: 43373 - DNA, 21 bp, Artificial sequence
  SiRNA target sequence
tattaaatctcttagccggag

SEQ ID NO: 43374 - DNA, 21 bp, Artificial sequence
  SiRNA target sequence
attaaatctcttagccggaga

SEQ ID NO: 43375 - DNA, 21 bp, Artificial sequence
  SiRNA target sequence
ttaaatctcttagccggagat

SEQ ID NO: 43376 - DNA, 21 bp, Artificial sequence
  SiRNA target sequence
taaatctcttagccggagata

SEQ ID NO: 43377 - DNA, 21 bp, Artificial sequence
  SiRNA target sequence
aaatctcttagccggagatat

SEQ ID NO: 43378 - DNA, 21 bp, Artificial sequence
  SiRNA target sequence
aatctcttagccggagatata

SEQ ID NO: 43379 - DNA, 21 bp, Artificial sequence
  SiRNA target sequence
atctcttagccggagatatag

SEQ ID NO: 43380 - DNA, 21 bp, Artificial sequence
  SiRNA target sequence
tctcttagccggagatataga

SEQ ID NO: 43381 - DNA, 21 bp, Artificial sequence
  SiRNA target sequence
ctcttagccggagatatagaa

SEQ ID NO: 43382 - DNA, 21 bp, Artificial sequence
  SiRNA target sequence
tcttagccggagatatagaat

SEQ ID NO: 43383 - DNA, 21 bp, Artificial sequence
  SiRNA target sequence
cttagccggagatatagaatt

SEQ ID NO: 43384 - DNA, 21 bp, Artificial sequence
  SiRNA target sequence
ttagccggagatatagaattg

SEQ ID NO: 43385 - DNA, 21 bp, Artificial sequence
  SiRNA target sequence
tagccggagatatagaattga

SEQ ID NO: 43386 - DNA, 21 bp, Artificial sequence
  SiRNA target sequence
agccggagatatagaattgaa

SEQ ID NO: 43387 - DNA, 21 bp, Artificial sequence
  SiRNA target sequence
gccggagatatagaattgaat

SEQ ID NO: 43388 - DNA, 21 bp, Artificial sequence
  SiRNA target sequence
ccggagatatagaattgaatc

SEQ ID NO: 43389 - DNA, 21 bp, Artificial sequence
  SiRNA target sequence
cggagatatagaattgaatcc

SEQ ID NO: 43390 - DNA, 21 bp, Artificial sequence
  SiRNA target sequence
ggagatatagaattgaatcct

SEQ ID NO: 43391 - DNA, 21 bp, Artificial sequence
  SiRNA target sequence
gagatatagaattgaatcctg

SEQ ID NO: 43392 - DNA, 21 bp, Artificial sequence
  SiRNA target sequence
agatatagaattgaatcctgg

SEQ ID NO: 43393 - DNA, 21 bp, Artificial sequence
  SiRNA target sequence
gatatagaattgaatcctgga

SEQ ID NO: 43394 - DNA, 21 bp, Artificial sequence
  SiRNA target sequence
atatagaattgaatcctggac

SEQ ID NO: 43395 - DNA, 21 bp, Artificial sequence
  SiRNA target sequence
tatagaattgaatcctggacc

SEQ ID NO: 43396 - DNA, 21 bp, Artificial sequence
  SiRNA target sequence
atagaattgaatcctggaccc

SEQ ID NO: 43397 - DNA, 21 bp, Artificial sequence
  SiRNA target sequence
tagaattgaatcctggaccca

SEQ ID NO: 43398 - DNA, 21 bp, Artificial sequence
  SiRNA target sequence
agaattgaatcctggacccac

SEQ ID NO: 43399 - DNA, 21 bp, Artificial sequence
  SiRNA target sequence
gaattgaatcctggacccact

SEQ ID NO: 43400 - DNA, 21 bp, Artificial sequence
  SiRNA target sequence
aattgaatcctggacccactg

SEQ ID NO: 43401 - DNA, 21 bp, Artificial sequence
  SiRNA target sequence
attgaatcctggacccactga

SEQ ID NO: 43402 - DNA, 21 bp, Artificial sequence
  SiRNA target sequence
ttgaatcctggacccactgat

SEQ ID NO: 43403 - DNA, 21 bp, Artificial sequence
  SiRNA target sequence
tgaatcctggacccactgata

SEQ ID NO: 43404 - DNA, 21 bp, Artificial sequence
  SiRNA target sequence
gaatcctggacccactgatat

SEQ ID NO: 43405 - DNA, 21 bp, Artificial sequence
  SiRNA target sequence
aatcctggacccactgatatt

SEQ ID NO: 43406 - DNA, 21 bp, Artificial sequence
  SiRNA target sequence
atcctggacccactgatattt

SEQ ID NO: 43407 - DNA, 21 bp, Artificial sequence
  SiRNA target sequence
tcctggacccactgatatttc

SEQ ID NO: 43408 - DNA, 21 bp, Artificial sequence
  SiRNA target sequence
cctggacccactgatatttct

SEQ ID NO: 43409 - DNA, 21 bp, Artificial sequence
  SiRNA target sequence
ctggacccactgatatttctt

SEQ ID NO: 43410 - DNA, 21 bp, Artificial sequence
  SiRNA target sequence
tggacccactgatatttctta

SEQ ID NO: 43411 - DNA, 21 bp, Artificial sequence
  SiRNA target sequence
ggacccactgatatttcttac

SEQ ID NO: 43412 - DNA, 21 bp, Artificial sequence
  SiRNA target sequence
gacccactgatatttcttaca

SEQ ID NO: 43413 - DNA, 21 bp, Artificial sequence
  SiRNA target sequence
acccactgatatttcttacaa

SEQ ID NO: 43414 - DNA, 21 bp, Artificial sequence
  SiRNA target sequence
cccactgatatttcttacaaa

SEQ ID NO: 43415 - DNA, 21 bp, Artificial sequence
  SiRNA target sequence
ccactgatatttcttacaaag

SEQ ID NO: 43416 - DNA, 21 bp, Artificial sequence
  SiRNA target sequence
cactgatatttcttacaaaga

SEQ ID NO: 43417 - DNA, 21 bp, Artificial sequence
  SiRNA target sequence
actgatatttcttacaaagaa

SEQ ID NO: 43418 - DNA, 21 bp, Artificial sequence
  SiRNA target sequence
ctgatatttcttacaaagaac

SEQ ID NO: 43419 - DNA, 21 bp, Artificial sequence
  SiRNA target sequence
tgatatttcttacaaagaaca

SEQ ID NO: 43420 - DNA, 21 bp, Artificial sequence
  SiRNA target sequence
gatatttcttacaaagaacaa

SEQ ID NO: 43421 - DNA, 21 bp, Artificial sequence
  SiRNA target sequence
atatttcttacaaagaacaat

SEQ ID NO: 43422 - DNA, 21 bp, Artificial sequence
  SiRNA target sequence
tatttcttacaaagaacaatg

SEQ ID NO: 43423 - DNA, 21 bp, Artificial sequence
  SiRNA target sequence
atttcttacaaagaacaatgc

SEQ ID NO: 43424 - DNA, 21 bp, Artificial sequence
  SiRNA target sequence
tttcttacaaagaacaatgcc

SEQ ID NO: 43425 - DNA, 21 bp, Artificial sequence
  SiRNA target sequence
ttcttacaaagaacaatgcca

SEQ ID NO: 43426 - DNA, 21 bp, Artificial sequence
  SiRNA target sequence
tcttacaaagaacaatgccaa

SEQ ID NO: 43427 - DNA, 21 bp, Artificial sequence
  SiRNA target sequence
cttacaaagaacaatgccaac

SEQ ID NO: 43428 - DNA, 21 bp, Artificial sequence
  SiRNA target sequence
ttacaaagaacaatgccaacg

SEQ ID NO: 43429 - DNA, 21 bp, Artificial sequence
  SiRNA target sequence
tacaaagaacaatgccaacga

SEQ ID NO: 43430 - DNA, 21 bp, Artificial sequence
  SiRNA target sequence
acaaagaacaatgccaacgac

SEQ ID NO: 43431 - DNA, 21 bp, Artificial sequence
  SiRNA target sequence
caaagaacaatgccaacgacg

SEQ ID NO: 43432 - DNA, 21 bp, Artificial sequence
  SiRNA target sequence
aaagaacaatgccaacgacga

SEQ ID NO: 43433 - DNA, 21 bp, Artificial sequence
  SiRNA target sequence
aagaacaatgccaacgacgac

SEQ ID NO: 43434 - DNA, 21 bp, Artificial sequence
  SiRNA target sequence
agaacaatgccaacgacgaca

SEQ ID NO: 43435 - DNA, 21 bp, Artificial sequence
  SiRNA target sequence
gaacaatgccaacgacgacaa

SEQ ID NO: 43436 - DNA, 21 bp, Artificial sequence
  SiRNA target sequence
aacaatgccaacgacgacaac

SEQ ID NO: 43437 - DNA, 21 bp, Artificial sequence
  SiRNA target sequence
acaatgccaacgacgacaacg

SEQ ID NO: 43438 - DNA, 21 bp, Artificial sequence
  SiRNA target sequence
caatgccaacgacgacaacga

SEQ ID NO: 43439 - DNA, 21 bp, Artificial sequence
  SiRNA target sequence
aatgccaacgacgacaacgac

SEQ ID NO: 43440 - DNA, 21 bp, Artificial sequence
  SiRNA target sequence
atgccaacgacgacaacgacg

SEQ ID NO: 43441 - DNA, 21 bp, Artificial sequence
  SiRNA target sequence
tgccaacgacgacaacgacgc

SEQ ID NO: 43442 - DNA, 21 bp, Artificial sequence
  SiRNA target sequence
gccaacgacgacaacgacgca

SEQ ID NO: 43443 - DNA, 21 bp, Artificial sequence
  SiRNA target sequence
ccaacgacgacaacgacgcaa

SEQ ID NO: 43444 - DNA, 21 bp, Artificial sequence
  SiRNA target sequence
caacgacgacaacgacgcaaa

SEQ ID NO: 43445 - DNA, 21 bp, Artificial sequence
  SiRNA target sequence
aacgacgacaacgacgcaaac

SEQ ID NO: 43446 - DNA, 21 bp, Artificial sequence
  SiRNA target sequence
acgacgacaacgacgcaaacg

SEQ ID NO: 43447 - DNA, 21 bp, Artificial sequence
  SiRNA target sequence
cgacgacaacgacgcaaacga

SEQ ID NO: 43448 - DNA, 21 bp, Artificial sequence
  SiRNA target sequence
gacgacaacgacgcaaacgaa

SEQ ID NO: 43449 - DNA, 21 bp, Artificial sequence
  SiRNA target sequence
acgacaacgacgcaaacgaat

SEQ ID NO: 43450 - DNA, 21 bp, Artificial sequence
  SiRNA target sequence
cgacaacgacgcaaacgaatt

SEQ ID NO: 43451 - DNA, 21 bp, Artificial sequence
  SiRNA target sequence
gacaacgacgcaaacgaattt

SEQ ID NO: 43452 - DNA, 21 bp, Artificial sequence
  SiRNA target sequence
acaacgacgcaaacgaatttc

SEQ ID NO: 43453 - DNA, 21 bp, Artificial sequence
  SiRNA target sequence
caacgacgcaaacgaatttct

SEQ ID NO: 43454 - DNA, 21 bp, Artificial sequence
  SiRNA target sequence
aacgacgcaaacgaatttcta

SEQ ID NO: 43455 - DNA, 21 bp, Artificial sequence
  SiRNA target sequence
acgacgcaaacgaatttctaa

SEQ ID NO: 43456 - DNA, 21 bp, Artificial sequence
  SiRNA target sequence
cgacgcaaacgaatttctaaa

SEQ ID NO: 43457 - DNA, 21 bp, Artificial sequence
  SiRNA target sequence
gacgcaaacgaatttctaaat

SEQ ID NO: 43458 - DNA, 21 bp, Artificial sequence
  SiRNA target sequence
acgcaaacgaatttctaaatc

SEQ ID NO: 43459 - DNA, 21 bp, Artificial sequence
  SiRNA target sequence
cgcaaacgaatttctaaatct

SEQ ID NO: 43460 - DNA, 21 bp, Artificial sequence
  SiRNA target sequence
gcaaacgaatttctaaatctt

SEQ ID NO: 43461 - DNA, 21 bp, Artificial sequence
  SiRNA target sequence
caaacgaatttctaaatctta

SEQ ID NO: 43462 - DNA, 21 bp, Artificial sequence
  SiRNA target sequence
aaacgaatttctaaatcttat

SEQ ID NO: 43463 - DNA, 21 bp, Artificial sequence
  SiRNA target sequence
aacgaatttctaaatcttatg

SEQ ID NO: 43464 - DNA, 21 bp, Artificial sequence
  SiRNA target sequence
acgaatttctaaatcttatga

SEQ ID NO: 43465 - DNA, 21 bp, Artificial sequence
  SiRNA target sequence
cgaatttctaaatcttatgaa

SEQ ID NO: 43466 - DNA, 21 bp, Artificial sequence
  SiRNA target sequence
gaatttctaaatcttatgaag

SEQ ID NO: 43467 - DNA, 21 bp, Artificial sequence
  SiRNA target sequence
aatttctaaatcttatgaaga

SEQ ID NO: 43468 - DNA, 21 bp, Artificial sequence
  SiRNA target sequence
atttctaaatcttatgaagaa

SEQ ID NO: 43469 - DNA, 21 bp, Artificial sequence
  SiRNA target sequence
tttctaaatcttatgaagaaa

SEQ ID NO: 43470 - DNA, 21 bp, Artificial sequence
  SiRNA target sequence
ttctaaatcttatgaagaaat

SEQ ID NO: 43471 - DNA, 21 bp, Artificial sequence
  SiRNA target sequence
tctaaatcttatgaagaaatc

SEQ ID NO: 43472 - DNA, 21 bp, Artificial sequence
  SiRNA target sequence
ctaaatcttatgaagaaatca

SEQ ID NO: 43473 - DNA, 21 bp, Artificial sequence
  SiRNA target sequence
taaatcttatgaagaaatcaa

SEQ ID NO: 43474 - DNA, 21 bp, Artificial sequence
  SiRNA target sequence
aaatcttatgaagaaatcaaa

SEQ ID NO: 43475 - DNA, 21 bp, Artificial sequence
  SiRNA target sequence
aatcttatgaagaaatcaaaa

SEQ ID NO: 43476 - DNA, 21 bp, Artificial sequence
  SiRNA target sequence
atcttatgaagaaatcaaaat

SEQ ID NO: 43477 - DNA, 21 bp, Artificial sequence
  SiRNA target sequence
tcttatgaagaaatcaaaatg

SEQ ID NO: 43478 - DNA, 21 bp, Artificial sequence
  SiRNA target sequence
cttatgaagaaatcaaaatgc

SEQ ID NO: 43479 - DNA, 21 bp, Artificial sequence
  SiRNA target sequence
ttatgaagaaatcaaaatgca

SEQ ID NO: 43480 - DNA, 21 bp, Artificial sequence
  SiRNA target sequence
tatgaagaaatcaaaatgcaa

SEQ ID NO: 43481 - DNA, 21 bp, Artificial sequence
  SiRNA target sequence
atgaagaaatcaaaatgcaac

SEQ ID NO: 43482 - DNA, 21 bp, Artificial sequence
  SiRNA target sequence
tgaagaaatcaaaatgcaaca

SEQ ID NO: 43483 - DNA, 21 bp, Artificial sequence
  SiRNA target sequence
gaagaaatcaaaatgcaacaa

SEQ ID NO: 43484 - DNA, 21 bp, Artificial sequence
  SiRNA target sequence
aagaaatcaaaatgcaacaac

SEQ ID NO: 43485 - DNA, 21 bp, Artificial sequence
  SiRNA target sequence
agaaatcaaaatgcaacaaca

SEQ ID NO: 43486 - DNA, 21 bp, Artificial sequence
  SiRNA target sequence
gaaatcaaaatgcaacaacat

SEQ ID NO: 43487 - DNA, 21 bp, Artificial sequence
  SiRNA target sequence
aaatcaaaatgcaacaacata

SEQ ID NO: 43488 - DNA, 21 bp, Artificial sequence
  SiRNA target sequence
aatcaaaatgcaacaacatat

SEQ ID NO: 43489 - DNA, 21 bp, Artificial sequence
  SiRNA target sequence
atcaaaatgcaacaacatatt

SEQ ID NO: 43490 - DNA, 21 bp, Artificial sequence
  SiRNA target sequence
tcaaaatgcaacaacatattg

SEQ ID NO: 43491 - DNA, 21 bp, Artificial sequence
  SiRNA target sequence
caaaatgcaacaacatattga

SEQ ID NO: 43492 - DNA, 21 bp, Artificial sequence
  SiRNA target sequence
aaaatgcaacaacatattgat

SEQ ID NO: 43493 - DNA, 21 bp, Artificial sequence
  SiRNA target sequence
aaatgcaacaacatattgata

SEQ ID NO: 43494 - DNA, 21 bp, Artificial sequence
  SiRNA target sequence
aatgcaacaacatattgataa

SEQ ID NO: 43495 - DNA, 21 bp, Artificial sequence
  SiRNA target sequence
atgcaacaacatattgataaa

SEQ ID NO: 43496 - DNA, 21 bp, Artificial sequence
  SiRNA target sequence
tgcaacaacatattgataaag

SEQ ID NO: 43497 - DNA, 21 bp, Artificial sequence
  SiRNA target sequence
gcaacaacatattgataaagt

SEQ ID NO: 43498 - DNA, 21 bp, Artificial sequence
  SiRNA target sequence
caacaacatattgataaagta

SEQ ID NO: 43499 - DNA, 21 bp, Artificial sequence
  SiRNA target sequence
aacaacatattgataaagtaa

SEQ ID NO: 43500 - DNA, 21 bp, Artificial sequence
  SiRNA target sequence
acaacatattgataaagtaat

SEQ ID NO: 43501 - DNA, 21 bp, Artificial sequence
  SiRNA target sequence
caacatattgataaagtaata

SEQ ID NO: 43502 - DNA, 21 bp, Artificial sequence
  SiRNA target sequence
aacatattgataaagtaataa

SEQ ID NO: 43503 - DNA, 21 bp, Artificial sequence
  SiRNA target sequence
acatattgataaagtaataag

SEQ ID NO: 43504 - DNA, 21 bp, Artificial sequence
  SiRNA target sequence
catattgataaagtaataaga

SEQ ID NO: 43505 - DNA, 21 bp, Artificial sequence
  SiRNA target sequence
atattgataaagtaataagag

SEQ ID NO: 43506 - DNA, 21 bp, Artificial sequence
  SiRNA target sequence
tattgataaagtaataagaga

SEQ ID NO: 43507 - DNA, 21 bp, Artificial sequence
  SiRNA target sequence
attgataaagtaataagagaa

SEQ ID NO: 43508 - DNA, 21 bp, Artificial sequence
  SiRNA target sequence
ttgataaagtaataagagaag

SEQ ID NO: 43509 - DNA, 21 bp, Artificial sequence
  SiRNA target sequence
tgataaagtaataagagaaga

SEQ ID NO: 43510 - DNA, 21 bp, Artificial sequence
  SiRNA target sequence
gataaagtaataagagaagaa

SEQ ID NO: 43511 - DNA, 21 bp, Artificial sequence
  SiRNA target sequence
ataaagtaataagagaagaat

SEQ ID NO: 43512 - DNA, 21 bp, Artificial sequence
  SiRNA target sequence
taaagtaataagagaagaatt

SEQ ID NO: 43513 - DNA, 21 bp, Artificial sequence
  SiRNA target sequence
aaagtaataagagaagaattt

SEQ ID NO: 43514 - DNA, 21 bp, Artificial sequence
  SiRNA target sequence
aagtaataagagaagaatttc

SEQ ID NO: 43515 - DNA, 21 bp, Artificial sequence
  SiRNA target sequence
agtaataagagaagaatttcg

SEQ ID NO: 43516 - DNA, 21 bp, Artificial sequence
  SiRNA target sequence
gtaataagagaagaatttcgt

SEQ ID NO: 43517 - DNA, 21 bp, Artificial sequence
  SiRNA target sequence
taataagagaagaatttcgtt

SEQ ID NO: 43518 - DNA, 21 bp, Artificial sequence
  SiRNA target sequence
aataagagaagaatttcgttc

SEQ ID NO: 43519 - DNA, 21 bp, Artificial sequence
  SiRNA target sequence
ataagagaagaatttcgttcc

SEQ ID NO: 43520 - DNA, 21 bp, Artificial sequence
  SiRNA target sequence
taagagaagaatttcgttccc

SEQ ID NO: 43521 - DNA, 21 bp, Artificial sequence
  SiRNA target sequence
aagagaagaatttcgttccca

SEQ ID NO: 43522 - DNA, 21 bp, Artificial sequence
  SiRNA target sequence
agagaagaatttcgttcccac

SEQ ID NO: 43523 - DNA, 21 bp, Artificial sequence
  SiRNA target sequence
gagaagaatttcgttcccacc

SEQ ID NO: 43524 - DNA, 21 bp, Artificial sequence
  SiRNA target sequence
agaagaatttcgttcccacca

SEQ ID NO: 43525 - DNA, 21 bp, Artificial sequence
  SiRNA target sequence
gaagaatttcgttcccaccag

SEQ ID NO: 43526 - DNA, 21 bp, Artificial sequence
  SiRNA target sequence
aagaatttcgttcccaccaga

SEQ ID NO: 43527 - DNA, 21 bp, Artificial sequence
  SiRNA target sequence
agaatttcgttcccaccagac

SEQ ID NO: 43528 - DNA, 21 bp, Artificial sequence
  SiRNA target sequence
gaatttcgttcccaccagaca

SEQ ID NO: 43529 - DNA, 21 bp, Artificial sequence
  SiRNA target sequence
aatttcgttcccaccagacaa

SEQ ID NO: 43530 - DNA, 21 bp, Artificial sequence
  SiRNA target sequence
atttcgttcccaccagacaaa

SEQ ID NO: 43531 - DNA, 21 bp, Artificial sequence
  SiRNA target sequence
tttcgttcccaccagacaaaa

SEQ ID NO: 43532 - DNA, 21 bp, Artificial sequence
  SiRNA target sequence
ttcgttcccaccagacaaaac

SEQ ID NO: 43533 - DNA, 21 bp, Artificial sequence
  SiRNA target sequence
tcgttcccaccagacaaaacc

SEQ ID NO: 43534 - DNA, 21 bp, Artificial sequence
  SiRNA target sequence
cgttcccaccagacaaaaccc

SEQ ID NO: 43535 - DNA, 21 bp, Artificial sequence
  SiRNA target sequence
gttcccaccagacaaaaccca

SEQ ID NO: 43536 - DNA, 21 bp, Artificial sequence
  SiRNA target sequence
ttcccaccagacaaaacccaa

SEQ ID NO: 43537 - DNA, 21 bp, Artificial sequence
  SiRNA target sequence
tcccaccagacaaaacccaag

SEQ ID NO: 43538 - DNA, 21 bp, Artificial sequence
  SiRNA target sequence
cccaccagacaaaacccaaga

SEQ ID NO: 43539 - DNA, 21 bp, Artificial sequence
  SiRNA target sequence
ccaccagacaaaacccaagaa

SEQ ID NO: 43540 - DNA, 21 bp, Artificial sequence
  SiRNA target sequence
caccagacaaaacccaagaaa

SEQ ID NO: 43541 - DNA, 21 bp, Artificial sequence
  SiRNA target sequence
accagacaaaacccaagaaat

SEQ ID NO: 43542 - DNA, 21 bp, Artificial sequence
  SiRNA target sequence
ccagacaaaacccaagaaatt

SEQ ID NO: 43543 - DNA, 21 bp, Artificial sequence
  SiRNA target sequence
cagacaaaacccaagaaattg

SEQ ID NO: 43544 - DNA, 21 bp, Artificial sequence
  SiRNA target sequence
agacaaaacccaagaaattga

SEQ ID NO: 43545 - DNA, 21 bp, Artificial sequence
  SiRNA target sequence
gacaaaacccaagaaattgaa

SEQ ID NO: 43546 - DNA, 21 bp, Artificial sequence
  SiRNA target sequence
acaaaacccaagaaattgaaa

SEQ ID NO: 43547 - DNA, 21 bp, Artificial sequence
  SiRNA target sequence
caaaacccaagaaattgaaag

SEQ ID NO: 43548 - DNA, 21 bp, Artificial sequence
  SiRNA target sequence
aaaacccaagaaattgaaaga

SEQ ID NO: 43549 - DNA, 21 bp, Artificial sequence
  SiRNA target sequence
aaacccaagaaattgaaagat

SEQ ID NO: 43550 - DNA, 21 bp, Artificial sequence
  SiRNA target sequence
aacccaagaaattgaaagatg

SEQ ID NO: 43551 - DNA, 21 bp, Artificial sequence
  SiRNA target sequence
acccaagaaattgaaagatgt

SEQ ID NO: 43552 - DNA, 21 bp, Artificial sequence
  SiRNA target sequence
cccaagaaattgaaagatgtt

SEQ ID NO: 43553 - DNA, 21 bp, Artificial sequence
  SiRNA target sequence
ccaagaaattgaaagatgtta

SEQ ID NO: 43554 - DNA, 21 bp, Artificial sequence
  SiRNA target sequence
caagaaattgaaagatgttat

SEQ ID NO: 43555 - DNA, 21 bp, Artificial sequence
  SiRNA target sequence
aagaaattgaaagatgttatt

SEQ ID NO: 43556 - DNA, 21 bp, Artificial sequence
  SiRNA target sequence
agaaattgaaagatgttattg

SEQ ID NO: 43557 - DNA, 21 bp, Artificial sequence
  SiRNA target sequence
gaaattgaaagatgttattga

SEQ ID NO: 43558 - DNA, 21 bp, Artificial sequence
  SiRNA target sequence
aaattgaaagatgttattgat

SEQ ID NO: 43559 - DNA, 21 bp, Artificial sequence
  SiRNA target sequence
aattgaaagatgttattgatg

SEQ ID NO: 43560 - DNA, 21 bp, Artificial sequence
  SiRNA target sequence
attgaaagatgttattgatgt

SEQ ID NO: 43561 - DNA, 21 bp, Artificial sequence
  SiRNA target sequence
ttgaaagatgttattgatgtt

SEQ ID NO: 43562 - DNA, 21 bp, Artificial sequence
  SiRNA target sequence
tgaaagatgttattgatgttt

SEQ ID NO: 43563 - DNA, 21 bp, Artificial sequence
  SiRNA target sequence
gaaagatgttattgatgtttc

SEQ ID NO: 43564 - DNA, 21 bp, Artificial sequence
  SiRNA target sequence
aaagatgttattgatgtttct

SEQ ID NO: 43565 - DNA, 21 bp, Artificial sequence
  SiRNA target sequence
aagatgttattgatgtttcta

SEQ ID NO: 43566 - DNA, 21 bp, Artificial sequence
  SiRNA target sequence
agatgttattgatgtttctat

SEQ ID NO: 43567 - DNA, 21 bp, Artificial sequence
  SiRNA target sequence
gatgttattgatgtttctatg

SEQ ID NO: 43568 - DNA, 21 bp, Artificial sequence
  SiRNA target sequence
atgttattgatgtttctatgc

SEQ ID NO: 43569 - DNA, 21 bp, Artificial sequence
  SiRNA target sequence
tgttattgatgtttctatgca

SEQ ID NO: 43570 - DNA, 21 bp, Artificial sequence
  SiRNA target sequence
gttattgatgtttctatgcag

SEQ ID NO: 43571 - DNA, 21 bp, Artificial sequence
  SiRNA target sequence
ttattgatgtttctatgcagg

SEQ ID NO: 43572 - DNA, 21 bp, Artificial sequence
  SiRNA target sequence
tattgatgtttctatgcaggg

SEQ ID NO: 43573 - DNA, 21 bp, Artificial sequence
  SiRNA target sequence
attgatgtttctatgcaggga

SEQ ID NO: 43574 - DNA, 21 bp, Artificial sequence
  SiRNA target sequence
ttgatgtttctatgcagggac

SEQ ID NO: 43575 - DNA, 21 bp, Artificial sequence
  SiRNA target sequence
tgatgtttctatgcagggact

SEQ ID NO: 43576 - DNA, 21 bp, Artificial sequence
  SiRNA target sequence
gatgtttctatgcagggactt

SEQ ID NO: 43577 - DNA, 21 bp, Artificial sequence
  SiRNA target sequence
atgtttctatgcagggacttt

SEQ ID NO: 43578 - DNA, 21 bp, Artificial sequence
  SiRNA target sequence
tgtttctatgcagggactttt

SEQ ID NO: 43579 - DNA, 21 bp, Artificial sequence
  SiRNA target sequence
gtttctatgcagggacttttt

SEQ ID NO: 43580 - DNA, 21 bp, Artificial sequence
  SiRNA target sequence
tttctatgcagggacttttta

SEQ ID NO: 43581 - DNA, 21 bp, Artificial sequence
  SiRNA target sequence
ttctatgcagggactttttaa

SEQ ID NO: 43582 - DNA, 21 bp, Artificial sequence
  SiRNA target sequence
tctatgcagggactttttaat

SEQ ID NO: 43583 - DNA, 21 bp, Artificial sequence
  SiRNA target sequence
ctatgcagggactttttaatt

SEQ ID NO: 43584 - DNA, 21 bp, Artificial sequence
  SiRNA target sequence
tatgcagggactttttaattt

SEQ ID NO: 43585 - DNA, 21 bp, Artificial sequence
  SiRNA target sequence
atgcagggactttttaatttt

SEQ ID NO: 43586 - DNA, 21 bp, Artificial sequence
  SiRNA target sequence
tgcagggactttttaattttc

SEQ ID NO: 43587 - DNA, 21 bp, Artificial sequence
  SiRNA target sequence
gcagggactttttaattttca

SEQ ID NO: 43588 - DNA, 21 bp, Artificial sequence
  SiRNA target sequence
cagggactttttaattttcaa

SEQ ID NO: 43589 - DNA, 21 bp, Artificial sequence
  SiRNA target sequence
agggactttttaattttcaag

SEQ ID NO: 43590 - DNA, 21 bp, Artificial sequence
  SiRNA target sequence
gggactttttaattttcaaga

SEQ ID NO: 43591 - DNA, 21 bp, Artificial sequence
  SiRNA target sequence
ggactttttaattttcaagaa

SEQ ID NO: 43592 - DNA, 21 bp, Artificial sequence
  SiRNA target sequence
gactttttaattttcaagaag

SEQ ID NO: 43593 - DNA, 21 bp, Artificial sequence
  SiRNA target sequence
actttttaattttcaagaaga

SEQ ID NO: 43594 - DNA, 21 bp, Artificial sequence
  SiRNA target sequence
ctttttaattttcaagaagaa

SEQ ID NO: 43595 - DNA, 21 bp, Artificial sequence
  SiRNA target sequence
tttttaattttcaagaagaaa

SEQ ID NO: 43596 - DNA, 21 bp, Artificial sequence
  SiRNA target sequence
ttttaattttcaagaagaaaa

SEQ ID NO: 43597 - DNA, 21 bp, Artificial sequence
  SiRNA target sequence
tttaattttcaagaagaaaag

SEQ ID NO: 43598 - DNA, 21 bp, Artificial sequence
  SiRNA target sequence
ttaattttcaagaagaaaagg

SEQ ID NO: 43599 - DNA, 21 bp, Artificial sequence
  SiRNA target sequence
taattttcaagaagaaaagga

SEQ ID NO: 43600 - DNA, 21 bp, Artificial sequence
  SiRNA target sequence
aattttcaagaagaaaaggat

SEQ ID NO: 43601 - DNA, 21 bp, Artificial sequence
  SiRNA target sequence
attttcaagaagaaaaggata

SEQ ID NO: 43602 - DNA, 21 bp, Artificial sequence
  SiRNA target sequence
ttttcaagaagaaaaggatat

SEQ ID NO: 43603 - DNA, 21 bp, Artificial sequence
  SiRNA target sequence
tttcaagaagaaaaggatatt

SEQ ID NO: 43604 - DNA, 21 bp, Artificial sequence
  SiRNA target sequence
ttcaagaagaaaaggatatta

SEQ ID NO: 43605 - DNA, 21 bp, Artificial sequence
  SiRNA target sequence
tcaagaagaaaaggatattat

SEQ ID NO: 43606 - DNA, 21 bp, Artificial sequence
  SiRNA target sequence
caagaagaaaaggatattatt

SEQ ID NO: 43607 - DNA, 21 bp, Artificial sequence
  SiRNA target sequence
aagaagaaaaggatattatta

SEQ ID NO: 43608 - DNA, 21 bp, Artificial sequence
  SiRNA target sequence
agaagaaaaggatattattaa

SEQ ID NO: 43609 - DNA, 21 bp, Artificial sequence
  SiRNA target sequence
gaagaaaaggatattattaag

SEQ ID NO: 43610 - DNA, 21 bp, Artificial sequence
  SiRNA target sequence
aagaaaaggatattattaagt

SEQ ID NO: 43611 - DNA, 21 bp, Artificial sequence
  SiRNA target sequence
agaaaaggatattattaagtc

SEQ ID NO: 43612 - DNA, 21 bp, Artificial sequence
  SiRNA target sequence
gaaaaggatattattaagtca

SEQ ID NO: 43613 - DNA, 21 bp, Artificial sequence
  SiRNA target sequence
aaaaggatattattaagtcaa

SEQ ID NO: 43614 - DNA, 21 bp, Artificial sequence
  SiRNA target sequence
aaaggatattattaagtcaac

SEQ ID NO: 43615 - DNA, 21 bp, Artificial sequence
  SiRNA target sequence
aaggatattattaagtcaact

SEQ ID NO: 43616 - DNA, 21 bp, Artificial sequence
  SiRNA target sequence
aggatattattaagtcaactg

SEQ ID NO: 43617 - DNA, 21 bp, Artificial sequence
  SiRNA target sequence
ggatattattaagtcaactgc

SEQ ID NO: 43618 - DNA, 21 bp, Artificial sequence
  SiRNA target sequence
gatattattaagtcaactgca

SEQ ID NO: 43619 - DNA, 21 bp, Artificial sequence
  SiRNA target sequence
atattattaagtcaactgcat

SEQ ID NO: 43620 - DNA, 21 bp, Artificial sequence
  SiRNA target sequence
tattattaagtcaactgcata

SEQ ID NO: 43621 - DNA, 21 bp, Artificial sequence
  SiRNA target sequence
attattaagtcaactgcatat

SEQ ID NO: 43622 - DNA, 21 bp, Artificial sequence
  SiRNA target sequence
ttattaagtcaactgcatata

SEQ ID NO: 43623 - DNA, 21 bp, Artificial sequence
  SiRNA target sequence
tattaagtcaactgcatataa

SEQ ID NO: 43624 - DNA, 21 bp, Artificial sequence
  SiRNA target sequence
attaagtcaactgcatataaa

SEQ ID NO: 43625 - DNA, 21 bp, Artificial sequence
  SiRNA target sequence
ttaagtcaactgcatataaat

SEQ ID NO: 43626 - DNA, 21 bp, Artificial sequence
  SiRNA target sequence
taagtcaactgcatataaatt

SEQ ID NO: 43627 - DNA, 21 bp, Artificial sequence
  SiRNA target sequence
aagtcaactgcatataaattc

SEQ ID NO: 43628 - DNA, 21 bp, Artificial sequence
  SiRNA target sequence
agtcaactgcatataaattca

SEQ ID NO: 43629 - DNA, 21 bp, Artificial sequence
  SiRNA target sequence
gtcaactgcatataaattcaa

SEQ ID NO: 43630 - DNA, 21 bp, Artificial sequence
  SiRNA target sequence
tcaactgcatataaattcaat

SEQ ID NO: 43631 - DNA, 21 bp, Artificial sequence
  SiRNA target sequence
caactgcatataaattcaatg

SEQ ID NO: 43632 - DNA, 21 bp, Artificial sequence
  SiRNA target sequence
aactgcatataaattcaatga

SEQ ID NO: 43633 - DNA, 21 bp, Artificial sequence
  SiRNA target sequence
actgcatataaattcaatgat

SEQ ID NO: 43634 - DNA, 21 bp, Artificial sequence
  SiRNA target sequence
ctgcatataaattcaatgata

SEQ ID NO: 43635 - DNA, 21 bp, Artificial sequence
  SiRNA target sequence
tgcatataaattcaatgatac

SEQ ID NO: 43636 - DNA, 21 bp, Artificial sequence
  SiRNA target sequence
gcatataaattcaatgatact

SEQ ID NO: 43637 - DNA, 21 bp, Artificial sequence
  SiRNA target sequence
catataaattcaatgatactc

SEQ ID NO: 43638 - DNA, 21 bp, Artificial sequence
  SiRNA target sequence
atataaattcaatgatactct

SEQ ID NO: 43639 - DNA, 21 bp, Artificial sequence
  SiRNA target sequence
tataaattcaatgatactctg

SEQ ID NO: 43640 - DNA, 21 bp, Artificial sequence
  SiRNA target sequence
ataaattcaatgatactctgg

SEQ ID NO: 43641 - DNA, 21 bp, Artificial sequence
  SiRNA target sequence
taaattcaatgatactctgga

SEQ ID NO: 43642 - DNA, 21 bp, Artificial sequence
  SiRNA target sequence
aaattcaatgatactctggat

SEQ ID NO: 43643 - DNA, 21 bp, Artificial sequence
  SiRNA target sequence
aattcaatgatactctggata

SEQ ID NO: 43644 - DNA, 21 bp, Artificial sequence
  SiRNA target sequence
attcaatgatactctggataa

SEQ ID NO: 43645 - DNA, 21 bp, Artificial sequence
  SiRNA target sequence
ttcaatgatactctggataaa

SEQ ID NO: 43646 - DNA, 21 bp, Artificial sequence
  SiRNA target sequence
tcaatgatactctggataaat

SEQ ID NO: 43647 - DNA, 21 bp, Artificial sequence
  SiRNA target sequence
caatgatactctggataaatc

SEQ ID NO: 43648 - DNA, 21 bp, Artificial sequence
  SiRNA target sequence
aatgatactctggataaatct

SEQ ID NO: 43649 - DNA, 21 bp, Artificial sequence
  SiRNA target sequence
atgatactctggataaatcta

SEQ ID NO: 43650 - DNA, 21 bp, Artificial sequence
  SiRNA target sequence
tgatactctggataaatctaa

SEQ ID NO: 43651 - DNA, 21 bp, Artificial sequence
  SiRNA target sequence
gatactctggataaatctaat

SEQ ID NO: 43652 - DNA, 21 bp, Artificial sequence
  SiRNA target sequence
atactctggataaatctaatc

SEQ ID NO: 43653 - DNA, 21 bp, Artificial sequence
  SiRNA target sequence
tactctggataaatctaatca

SEQ ID NO: 43654 - DNA, 21 bp, Artificial sequence
  SiRNA target sequence
actctggataaatctaatcat

SEQ ID NO: 43655 - DNA, 21 bp, Artificial sequence
  SiRNA target sequence
ctctggataaatctaatcata

SEQ ID NO: 43656 - DNA, 21 bp, Artificial sequence
  SiRNA target sequence
tctggataaatctaatcatat

SEQ ID NO: 43657 - DNA, 21 bp, Artificial sequence
  SiRNA target sequence
ctggataaatctaatcatata

SEQ ID NO: 43658 - DNA, 21 bp, Artificial sequence
  SiRNA target sequence
tggataaatctaatcatataa

SEQ ID NO: 43659 - DNA, 21 bp, Artificial sequence
  SiRNA target sequence
ggataaatctaatcatataat

SEQ ID NO: 43660 - DNA, 21 bp, Artificial sequence
  SiRNA target sequence
gataaatctaatcatataatg

SEQ ID NO: 43661 - DNA, 21 bp, Artificial sequence
  SiRNA target sequence
ataaatctaatcatataatgg

SEQ ID NO: 43662 - DNA, 21 bp, Artificial sequence
  SiRNA target sequence
taaatctaatcatataatgga

SEQ ID NO: 43663 - DNA, 21 bp, Artificial sequence
  SiRNA target sequence
aaatctaatcatataatggat

SEQ ID NO: 43664 - DNA, 21 bp, Artificial sequence
  SiRNA target sequence
aatctaatcatataatggata

SEQ ID NO: 43665 - DNA, 21 bp, Artificial sequence
  SiRNA target sequence
atctaatcatataatggataa

SEQ ID NO: 43666 - DNA, 21 bp, Artificial sequence
  SiRNA target sequence
tctaatcatataatggataat

SEQ ID NO: 43667 - DNA, 21 bp, Artificial sequence
  SiRNA target sequence
ctaatcatataatggataatc

SEQ ID NO: 43668 - DNA, 21 bp, Artificial sequence
  SiRNA target sequence
taatcatataatggataatct

SEQ ID NO: 43669 - DNA, 21 bp, Artificial sequence
  SiRNA target sequence
aatcatataatggataatctt

SEQ ID NO: 43670 - DNA, 21 bp, Artificial sequence
  SiRNA target sequence
atcatataatggataatctta

SEQ ID NO: 43671 - DNA, 21 bp, Artificial sequence
  SiRNA target sequence
tcatataatggataatcttat

SEQ ID NO: 43672 - DNA, 21 bp, Artificial sequence
  SiRNA target sequence
catataatggataatcttata

SEQ ID NO: 43673 - DNA, 21 bp, Artificial sequence
  SiRNA target sequence
atataatggataatcttatac

SEQ ID NO: 43674 - DNA, 21 bp, Artificial sequence
  SiRNA target sequence
tataatggataatcttatacc

SEQ ID NO: 43675 - DNA, 21 bp, Artificial sequence
  SiRNA target sequence
ataatggataatcttatacca

SEQ ID NO: 43676 - DNA, 21 bp, Artificial sequence
  SiRNA target sequence
taatggataatcttataccac

SEQ ID NO: 43677 - DNA, 21 bp, Artificial sequence
  SiRNA target sequence
aatggataatcttataccaca

SEQ ID NO: 43678 - DNA, 21 bp, Artificial sequence
  SiRNA target sequence
atggataatcttataccacaa

SEQ ID NO: 43679 - DNA, 21 bp, Artificial sequence
  SiRNA target sequence
tggataatcttataccacaat

SEQ ID NO: 43680 - DNA, 21 bp, Artificial sequence
  SiRNA target sequence
ggataatcttataccacaatt

SEQ ID NO: 43681 - DNA, 21 bp, Artificial sequence
  SiRNA target sequence
gataatcttataccacaatta

SEQ ID NO: 43682 - DNA, 21 bp, Artificial sequence
  SiRNA target sequence
ataatcttataccacaattag

SEQ ID NO: 43683 - DNA, 21 bp, Artificial sequence
  SiRNA target sequence
taatcttataccacaattaga

SEQ ID NO: 43684 - DNA, 21 bp, Artificial sequence
  SiRNA target sequence
aatcttataccacaattagaa

SEQ ID NO: 43685 - DNA, 21 bp, Artificial sequence
  SiRNA target sequence
atcttataccacaattagaag

SEQ ID NO: 43686 - DNA, 21 bp, Artificial sequence
  SiRNA target sequence
tcttataccacaattagaaga

SEQ ID NO: 43687 - DNA, 21 bp, Artificial sequence
  SiRNA target sequence
cttataccacaattagaagaa

SEQ ID NO: 43688 - DNA, 21 bp, Artificial sequence
  SiRNA target sequence
ttataccacaattagaagaaa

SEQ ID NO: 43689 - DNA, 21 bp, Artificial sequence
  SiRNA target sequence
tataccacaattagaagaaac

SEQ ID NO: 43690 - DNA, 21 bp, Artificial sequence
  SiRNA target sequence
ataccacaattagaagaaacg

SEQ ID NO: 43691 - DNA, 21 bp, Artificial sequence
  SiRNA target sequence
taccacaattagaagaaacgt

SEQ ID NO: 43692 - DNA, 21 bp, Artificial sequence
  SiRNA target sequence
accacaattagaagaaacgtt

SEQ ID NO: 43693 - DNA, 21 bp, Artificial sequence
  SiRNA target sequence
ccacaattagaagaaacgtta

SEQ ID NO: 43694 - DNA, 21 bp, Artificial sequence
  SiRNA target sequence
cacaattagaagaaacgttag

SEQ ID NO: 43695 - DNA, 21 bp, Artificial sequence
  SiRNA target sequence
acaattagaagaaacgttagc

SEQ ID NO: 43696 - DNA, 21 bp, Artificial sequence
  SiRNA target sequence
caattagaagaaacgttagca

SEQ ID NO: 43697 - DNA, 21 bp, Artificial sequence
  SiRNA target sequence
aattagaagaaacgttagcag

SEQ ID NO: 43698 - DNA, 21 bp, Artificial sequence
  SiRNA target sequence
attagaagaaacgttagcagg

SEQ ID NO: 43699 - DNA, 21 bp, Artificial sequence
  SiRNA target sequence
ttagaagaaacgttagcaggc

SEQ ID NO: 43700 - DNA, 21 bp, Artificial sequence
  SiRNA target sequence
tagaagaaacgttagcaggct

SEQ ID NO: 43701 - DNA, 21 bp, Artificial sequence
  SiRNA target sequence
agaagaaacgttagcaggctt

SEQ ID NO: 43702 - DNA, 21 bp, Artificial sequence
  SiRNA target sequence
gaagaaacgttagcaggcttt

SEQ ID NO: 43703 - DNA, 21 bp, Artificial sequence
  SiRNA target sequence
aagaaacgttagcaggcttta

SEQ ID NO: 43704 - DNA, 21 bp, Artificial sequence
  SiRNA target sequence
agaaacgttagcaggctttag

SEQ ID NO: 43705 - DNA, 21 bp, Artificial sequence
  SiRNA target sequence
gaaacgttagcaggctttaga

SEQ ID NO: 43706 - DNA, 21 bp, Artificial sequence
  SiRNA target sequence
aaacgttagcaggctttagaa

SEQ ID NO: 43707 - DNA, 21 bp, Artificial sequence
  SiRNA target sequence
aacgttagcaggctttagaag

SEQ ID NO: 43708 - DNA, 21 bp, Artificial sequence
  SiRNA target sequence
acgttagcaggctttagaagg

SEQ ID NO: 43709 - DNA, 21 bp, Artificial sequence
  SiRNA target sequence
cgttagcaggctttagaagga

SEQ ID NO: 43710 - DNA, 21 bp, Artificial sequence
  SiRNA target sequence
gttagcaggctttagaaggac

SEQ ID NO: 43711 - DNA, 21 bp, Artificial sequence
  SiRNA target sequence
ttagcaggctttagaaggact

SEQ ID NO: 43712 - DNA, 21 bp, Artificial sequence
  SiRNA target sequence
tagcaggctttagaaggactt

SEQ ID NO: 43713 - DNA, 21 bp, Artificial sequence
  SiRNA target sequence
agcaggctttagaaggactta

SEQ ID NO: 43714 - DNA, 21 bp, Artificial sequence
  SiRNA target sequence
gcaggctttagaaggacttat

SEQ ID NO: 43715 - DNA, 21 bp, Artificial sequence
  SiRNA target sequence
caggctttagaaggacttatg

SEQ ID NO: 43716 - DNA, 21 bp, Artificial sequence
  SiRNA target sequence
aggctttagaaggacttatgc

SEQ ID NO: 43717 - DNA, 21 bp, Artificial sequence
  SiRNA target sequence
ggctttagaaggacttatgcg

SEQ ID NO: 43718 - DNA, 21 bp, Artificial sequence
  SiRNA target sequence
gctttagaaggacttatgcga

SEQ ID NO: 43719 - DNA, 21 bp, Artificial sequence
  SiRNA target sequence
ctttagaaggacttatgcgaa

SEQ ID NO: 43720 - DNA, 21 bp, Artificial sequence
  SiRNA target sequence
tttagaaggacttatgcgaag

SEQ ID NO: 43721 - DNA, 21 bp, Artificial sequence
  SiRNA target sequence
ttagaaggacttatgcgaagt

SEQ ID NO: 43722 - DNA, 21 bp, Artificial sequence
  SiRNA target sequence
tagaaggacttatgcgaagtg

SEQ ID NO: 43723 - DNA, 21 bp, Artificial sequence
  SiRNA target sequence
agaaggacttatgcgaagtgt

SEQ ID NO: 43724 - DNA, 21 bp, Artificial sequence
  SiRNA target sequence
gaaggacttatgcgaagtgtg

SEQ ID NO: 43725 - DNA, 21 bp, Artificial sequence
  SiRNA target sequence
aaggacttatgcgaagtgtga

SEQ ID NO: 43726 - DNA, 21 bp, Artificial sequence
  SiRNA target sequence
aggacttatgcgaagtgtgaa

SEQ ID NO: 43727 - DNA, 21 bp, Artificial sequence
  SiRNA target sequence
ggacttatgcgaagtgtgaac

SEQ ID NO: 43728 - DNA, 21 bp, Artificial sequence
  SiRNA target sequence
gacttatgcgaagtgtgaaca

SEQ ID NO: 43729 - DNA, 21 bp, Artificial sequence
  SiRNA target sequence
acttatgcgaagtgtgaacaa

SEQ ID NO: 43730 - DNA, 21 bp, Artificial sequence
  SiRNA target sequence
cttatgcgaagtgtgaacaaa

SEQ ID NO: 43731 - DNA, 21 bp, Artificial sequence
  SiRNA target sequence
ttatgcgaagtgtgaacaaaa

SEQ ID NO: 43732 - DNA, 21 bp, Artificial sequence
  SiRNA target sequence
tatgcgaagtgtgaacaaaag

SEQ ID NO: 43733 - DNA, 21 bp, Artificial sequence
  SiRNA target sequence
atgcgaagtgtgaacaaaagt

SEQ ID NO: 43734 - DNA, 21 bp, Artificial sequence
  SiRNA target sequence
tgcgaagtgtgaacaaaagtt

SEQ ID NO: 43735 - DNA, 21 bp, Artificial sequence
  SiRNA target sequence
gcgaagtgtgaacaaaagtta

SEQ ID NO: 43736 - DNA, 21 bp, Artificial sequence
  SiRNA target sequence
cgaagtgtgaacaaaagttat

SEQ ID NO: 43737 - DNA, 21 bp, Artificial sequence
  SiRNA target sequence
gaagtgtgaacaaaagttatt

SEQ ID NO: 43738 - DNA, 21 bp, Artificial sequence
  SiRNA target sequence
aagtgtgaacaaaagttattt

SEQ ID NO: 43739 - DNA, 21 bp, Artificial sequence
  SiRNA target sequence
agtgtgaacaaaagttatttg

SEQ ID NO: 43740 - DNA, 21 bp, Artificial sequence
  SiRNA target sequence
gtgtgaacaaaagttatttgg

SEQ ID NO: 43741 - DNA, 21 bp, Artificial sequence
  SiRNA target sequence
tgtgaacaaaagttatttgga

SEQ ID NO: 43742 - DNA, 21 bp, Artificial sequence
  SiRNA target sequence
gtgaacaaaagttatttggaa

SEQ ID NO: 43743 - DNA, 21 bp, Artificial sequence
  SiRNA target sequence
tgaacaaaagttatttggaac

SEQ ID NO: 43744 - DNA, 21 bp, Artificial sequence
  SiRNA target sequence
gaacaaaagttatttggaact

SEQ ID NO: 43745 - DNA, 21 bp, Artificial sequence
  SiRNA target sequence
aacaaaagttatttggaacta

SEQ ID NO: 43746 - DNA, 21 bp, Artificial sequence
  SiRNA target sequence
acaaaagttatttggaactat

SEQ ID NO: 43747 - DNA, 21 bp, Artificial sequence
  SiRNA target sequence
caaaagttatttggaactatt

SEQ ID NO: 43748 - DNA, 21 bp, Artificial sequence
  SiRNA target sequence
aaaagttatttggaactatta

SEQ ID NO: 43749 - DNA, 21 bp, Artificial sequence
  SiRNA target sequence
aaagttatttggaactattag

SEQ ID NO: 43750 - DNA, 21 bp, Artificial sequence
  SiRNA target sequence
aagttatttggaactattagc

SEQ ID NO: 43751 - DNA, 21 bp, Artificial sequence
  SiRNA target sequence
agttatttggaactattagca

SEQ ID NO: 43752 - DNA, 21 bp, Artificial sequence
  SiRNA target sequence
gttatttggaactattagcat

SEQ ID NO: 43753 - DNA, 21 bp, Artificial sequence
  SiRNA target sequence
ttatttggaactattagcatt

SEQ ID NO: 43754 - DNA, 21 bp, Artificial sequence
  SiRNA target sequence
tatttggaactattagcatta

SEQ ID NO: 43755 - DNA, 21 bp, Artificial sequence
  SiRNA target sequence
atttggaactattagcattat

SEQ ID NO: 43756 - DNA, 21 bp, Artificial sequence
  SiRNA target sequence
tttggaactattagcattatt

SEQ ID NO: 43757 - DNA, 21 bp, Artificial sequence
  SiRNA target sequence
ttggaactattagcattattg

SEQ ID NO: 43758 - DNA, 21 bp, Artificial sequence
  SiRNA target sequence
tggaactattagcattattga

SEQ ID NO: 43759 - DNA, 21 bp, Artificial sequence
  SiRNA target sequence
ggaactattagcattattgat

SEQ ID NO: 43760 - DNA, 21 bp, Artificial sequence
  SiRNA target sequence
gaactattagcattattgatg

SEQ ID NO: 43761 - DNA, 21 bp, Artificial sequence
  SiRNA target sequence
aactattagcattattgatgt

SEQ ID NO: 43762 - DNA, 21 bp, Artificial sequence
  SiRNA target sequence
actattagcattattgatgtc

SEQ ID NO: 43763 - DNA, 21 bp, Artificial sequence
  SiRNA target sequence
ctattagcattattgatgtct

SEQ ID NO: 43764 - DNA, 21 bp, Artificial sequence
  SiRNA target sequence
tattagcattattgatgtctg

SEQ ID NO: 43765 - DNA, 21 bp, Artificial sequence
  SiRNA target sequence
attagcattattgatgtctgt

SEQ ID NO: 43766 - DNA, 21 bp, Artificial sequence
  SiRNA target sequence
ttagcattattgatgtctgta

SEQ ID NO: 43767 - DNA, 21 bp, Artificial sequence
  SiRNA target sequence
tagcattattgatgtctgtat

SEQ ID NO: 43768 - DNA, 21 bp, Artificial sequence
  SiRNA target sequence
agcattattgatgtctgtatt

SEQ ID NO: 43769 - DNA, 21 bp, Artificial sequence
  SiRNA target sequence
gcattattgatgtctgtattg

SEQ ID NO: 43770 - DNA, 21 bp, Artificial sequence
  SiRNA target sequence
cattattgatgtctgtattga

SEQ ID NO: 43771 - DNA, 21 bp, Artificial sequence
  SiRNA target sequence
attattgatgtctgtattgat

SEQ ID NO: 43772 - DNA, 21 bp, Artificial sequence
  SiRNA target sequence
ttattgatgtctgtattgata

SEQ ID NO: 43773 - DNA, 21 bp, Artificial sequence
  SiRNA target sequence
tattgatgtctgtattgatat

SEQ ID NO: 43774 - DNA, 21 bp, Artificial sequence
  SiRNA target sequence
attgatgtctgtattgatatc

SEQ ID NO: 43775 - DNA, 21 bp, Artificial sequence
  SiRNA target sequence
ttgatgtctgtattgatatca

SEQ ID NO: 43776 - DNA, 21 bp, Artificial sequence
  SiRNA target sequence
tgatgtctgtattgatatcat

SEQ ID NO: 43777 - DNA, 21 bp, Artificial sequence
  SiRNA target sequence
gatgtctgtattgatatcatt

SEQ ID NO: 43778 - DNA, 21 bp, Artificial sequence
  SiRNA target sequence
atgtctgtattgatatcatta

SEQ ID NO: 43779 - DNA, 21 bp, Artificial sequence
  SiRNA target sequence
tgtctgtattgatatcattag

SEQ ID NO: 43780 - DNA, 21 bp, Artificial sequence
  SiRNA target sequence
gtctgtattgatatcattagt

SEQ ID NO: 43781 - DNA, 21 bp, Artificial sequence
  SiRNA target sequence
tctgtattgatatcattagtg

SEQ ID NO: 43782 - DNA, 21 bp, Artificial sequence
  SiRNA target sequence
ctgtattgatatcattagtgc

SEQ ID NO: 43783 - DNA, 21 bp, Artificial sequence
  SiRNA target sequence
tgtattgatatcattagtgct

SEQ ID NO: 43784 - DNA, 21 bp, Artificial sequence
  SiRNA target sequence
gtattgatatcattagtgctt

SEQ ID NO: 43785 - DNA, 21 bp, Artificial sequence
  SiRNA target sequence
tattgatatcattagtgcttt

SEQ ID NO: 43786 - DNA, 21 bp, Artificial sequence
  SiRNA target sequence
attgatatcattagtgctttg

SEQ ID NO: 43787 - DNA, 21 bp, Artificial sequence
  SiRNA target sequence
ttgatatcattagtgctttgt

SEQ ID NO: 43788 - DNA, 21 bp, Artificial sequence
  SiRNA target sequence
tgatatcattagtgctttgtt

SEQ ID NO: 43789 - DNA, 21 bp, Artificial sequence
  SiRNA target sequence
gatatcattagtgctttgtta

SEQ ID NO: 43790 - DNA, 21 bp, Artificial sequence
  SiRNA target sequence
atatcattagtgctttgttac

SEQ ID NO: 43791 - DNA, 21 bp, Artificial sequence
  SiRNA target sequence
tatcattagtgctttgttaca

SEQ ID NO: 43792 - DNA, 21 bp, Artificial sequence
  SiRNA target sequence
atcattagtgctttgttacaa

SEQ ID NO: 43793 - DNA, 21 bp, Artificial sequence
  SiRNA target sequence
tcattagtgctttgttacaag

SEQ ID NO: 43794 - DNA, 21 bp, Artificial sequence
  SiRNA target sequence
cattagtgctttgttacaagt

SEQ ID NO: 43795 - DNA, 21 bp, Artificial sequence
  SiRNA target sequence
attagtgctttgttacaagta

SEQ ID NO: 43796 - DNA, 21 bp, Artificial sequence
  SiRNA target sequence
ttagtgctttgttacaagtaa

SEQ ID NO: 43797 - DNA, 21 bp, Artificial sequence
  SiRNA target sequence
tagtgctttgttacaagtaag

SEQ ID NO: 43798 - DNA, 21 bp, Artificial sequence
  SiRNA target sequence
agtgctttgttacaagtaagt

SEQ ID NO: 43799 - DNA, 21 bp, Artificial sequence
  SiRNA target sequence
gtgctttgttacaagtaagtt

SEQ ID NO: 43800 - DNA, 21 bp, Artificial sequence
  SiRNA target sequence
tgctttgttacaagtaagttt

SEQ ID NO: 43801 - DNA, 21 bp, Artificial sequence
  SiRNA target sequence
gctttgttacaagtaagtttt

SEQ ID NO: 43802 - DNA, 21 bp, Artificial sequence
  SiRNA target sequence
ctttgttacaagtaagttttg

SEQ ID NO: 43803 - DNA, 21 bp, Artificial sequence
  SiRNA target sequence
tttgttacaagtaagttttgc

SEQ ID NO: 43804 - DNA, 21 bp, Artificial sequence
  SiRNA target sequence
ttgttacaagtaagttttgcg

SEQ ID NO: 43805 - DNA, 21 bp, Artificial sequence
  SiRNA target sequence
tgttacaagtaagttttgcga

SEQ ID NO: 43806 - DNA, 21 bp, Artificial sequence
  SiRNA target sequence
gttacaagtaagttttgcgaa

SEQ ID NO: 43807 - DNA, 21 bp, Artificial sequence
  SiRNA target sequence
ttacaagtaagttttgcgaaa

SEQ ID NO: 43808 - DNA, 21 bp, Artificial sequence
  SiRNA target sequence
tacaagtaagttttgcgaaag

SEQ ID NO: 43809 - DNA, 21 bp, Artificial sequence
  SiRNA target sequence
acaagtaagttttgcgaaagc

SEQ ID NO: 43810 - DNA, 21 bp, Artificial sequence
  SiRNA target sequence
caagtaagttttgcgaaagct

SEQ ID NO: 43811 - DNA, 21 bp, Artificial sequence
  SiRNA target sequence
aagtaagttttgcgaaagctt

SEQ ID NO: 43812 - DNA, 21 bp, Artificial sequence
  SiRNA target sequence
agtaagttttgcgaaagcttc

SEQ ID NO: 43813 - DNA, 21 bp, Artificial sequence
  SiRNA target sequence
gtaagttttgcgaaagcttca

SEQ ID NO: 43814 - DNA, 21 bp, Artificial sequence
  SiRNA target sequence
taagttttgcgaaagcttcaa

SEQ ID NO: 43815 - DNA, 21 bp, Artificial sequence
  SiRNA target sequence
aagttttgcgaaagcttcaat

SEQ ID NO: 43816 - DNA, 21 bp, Artificial sequence
  SiRNA target sequence
agttttgcgaaagcttcaatg

SEQ ID NO: 43817 - DNA, 21 bp, Artificial sequence
  SiRNA target sequence
gttttgcgaaagcttcaatga

SEQ ID NO: 43818 - DNA, 21 bp, Artificial sequence
  SiRNA target sequence
ttttgcgaaagcttcaatgaa

SEQ ID NO: 43819 - DNA, 21 bp, Artificial sequence
  SiRNA target sequence
tttgcgaaagcttcaatgaag

SEQ ID NO: 43820 - DNA, 21 bp, Artificial sequence
  SiRNA target sequence
ttgcgaaagcttcaatgaagt

SEQ ID NO: 43821 - DNA, 21 bp, Artificial sequence
  SiRNA target sequence
tgcgaaagcttcaatgaagtt

SEQ ID NO: 43822 - DNA, 21 bp, Artificial sequence
  SiRNA target sequence
gcgaaagcttcaatgaagtta

SEQ ID NO: 43823 - DNA, 21 bp, Artificial sequence
  SiRNA target sequence
cgaaagcttcaatgaagttag

SEQ ID NO: 43824 - DNA, 21 bp, Artificial sequence
  SiRNA target sequence
gaaagcttcaatgaagttagc

SEQ ID NO: 43825 - DNA, 21 bp, Artificial sequence
  SiRNA target sequence
aaagcttcaatgaagttagct

SEQ ID NO: 43826 - DNA, 21 bp, Artificial sequence
  SiRNA target sequence
aagcttcaatgaagttagctt

SEQ ID NO: 43827 - DNA, 21 bp, Artificial sequence
  SiRNA target sequence
agcttcaatgaagttagcttc

SEQ ID NO: 43828 - DNA, 21 bp, Artificial sequence
  SiRNA target sequence
gcttcaatgaagttagcttct

SEQ ID NO: 43829 - DNA, 21 bp, Artificial sequence
  SiRNA target sequence
cttcaatgaagttagcttctt

SEQ ID NO: 43830 - DNA, 21 bp, Artificial sequence
  SiRNA target sequence
ttcaatgaagttagcttcttt

SEQ ID NO: 43831 - DNA, 21 bp, Artificial sequence
  SiRNA target sequence
tcaatgaagttagcttcttta

SEQ ID NO: 43832 - DNA, 21 bp, Artificial sequence
  SiRNA target sequence
caatgaagttagcttctttag

SEQ ID NO: 43833 - DNA, 21 bp, Artificial sequence
  SiRNA target sequence
aatgaagttagcttctttagc

SEQ ID NO: 43834 - DNA, 21 bp, Artificial sequence
  SiRNA target sequence
atgaagttagcttctttagca

SEQ ID NO: 43835 - DNA, 21 bp, Artificial sequence
  SiRNA target sequence
tgaagttagcttctttagcag

SEQ ID NO: 43836 - DNA, 21 bp, Artificial sequence
  SiRNA target sequence
gaagttagcttctttagcagt

SEQ ID NO: 43837 - DNA, 21 bp, Artificial sequence
  SiRNA target sequence
aagttagcttctttagcagta

SEQ ID NO: 43838 - DNA, 21 bp, Artificial sequence
  SiRNA target sequence
agttagcttctttagcagtag

SEQ ID NO: 43839 - DNA, 21 bp, Artificial sequence
  SiRNA target sequence
gttagcttctttagcagtaga

SEQ ID NO: 43840 - DNA, 21 bp, Artificial sequence
  SiRNA target sequence
ttagcttctttagcagtagaa

SEQ ID NO: 43841 - DNA, 21 bp, Artificial sequence
  SiRNA target sequence
tagcttctttagcagtagaag

SEQ ID NO: 43842 - DNA, 21 bp, Artificial sequence
  SiRNA target sequence
agcttctttagcagtagaagt

SEQ ID NO: 43843 - DNA, 21 bp, Artificial sequence
  SiRNA target sequence
gcttctttagcagtagaagta

SEQ ID NO: 43844 - DNA, 21 bp, Artificial sequence
  SiRNA target sequence
cttctttagcagtagaagtat

SEQ ID NO: 43845 - DNA, 21 bp, Artificial sequence
  SiRNA target sequence
ttctttagcagtagaagtatt

SEQ ID NO: 43846 - DNA, 21 bp, Artificial sequence
  SiRNA target sequence
tctttagcagtagaagtattt

SEQ ID NO: 43847 - DNA, 21 bp, Artificial sequence
  SiRNA target sequence
ctttagcagtagaagtattta

SEQ ID NO: 43848 - DNA, 21 bp, Artificial sequence
  SiRNA target sequence
tttagcagtagaagtatttag

SEQ ID NO: 43849 - DNA, 21 bp, Artificial sequence
  SiRNA target sequence
ttagcagtagaagtatttaga

SEQ ID NO: 43850 - DNA, 21 bp, Artificial sequence
  SiRNA target sequence
tagcagtagaagtatttagat

SEQ ID NO: 43851 - DNA, 21 bp, Artificial sequence
  SiRNA target sequence
agcagtagaagtatttagatt

SEQ ID NO: 43852 - DNA, 21 bp, Artificial sequence
  SiRNA target sequence
gcagtagaagtatttagatta

SEQ ID NO: 43853 - DNA, 21 bp, Artificial sequence
  SiRNA target sequence
cagtagaagtatttagattaa

SEQ ID NO: 43854 - DNA, 21 bp, Artificial sequence
  SiRNA target sequence
agtagaagtatttagattaat

SEQ ID NO: 43855 - DNA, 21 bp, Artificial sequence
  SiRNA target sequence
gtagaagtatttagattaatt

SEQ ID NO: 43856 - DNA, 21 bp, Artificial sequence
  SiRNA target sequence
tagaagtatttagattaatta

SEQ ID NO: 43857 - DNA, 21 bp, Artificial sequence
  SiRNA target sequence
agaagtatttagattaattaa

SEQ ID NO: 43858 - DNA, 21 bp, Artificial sequence
  SiRNA target sequence
gaagtatttagattaattaag

SEQ ID NO: 43859 - DNA, 21 bp, Artificial sequence
  SiRNA target sequence
aagtatttagattaattaaga

SEQ ID NO: 43860 - DNA, 21 bp, Artificial sequence
  SiRNA target sequence
agtatttagattaattaagaa

SEQ ID NO: 43861 - DNA, 21 bp, Artificial sequence
  SiRNA target sequence
gtatttagattaattaagaag

SEQ ID NO: 43862 - DNA, 21 bp, Artificial sequence
  SiRNA target sequence
tatttagattaattaagaagt

SEQ ID NO: 43863 - DNA, 21 bp, Artificial sequence
  SiRNA target sequence
atttagattaattaagaagta

SEQ ID NO: 43864 - DNA, 21 bp, Artificial sequence
  SiRNA target sequence
tttagattaattaagaagtat

SEQ ID NO: 43865 - DNA, 21 bp, Artificial sequence
  SiRNA target sequence
ttagattaattaagaagtatg

SEQ ID NO: 43866 - DNA, 21 bp, Artificial sequence
  SiRNA target sequence
tagattaattaagaagtatgt

SEQ ID NO: 43867 - DNA, 21 bp, Artificial sequence
  SiRNA target sequence
agattaattaagaagtatgta

SEQ ID NO: 43868 - DNA, 21 bp, Artificial sequence
  SiRNA target sequence
gattaattaagaagtatgtag

SEQ ID NO: 43869 - DNA, 21 bp, Artificial sequence
  SiRNA target sequence
attaattaagaagtatgtagg

SEQ ID NO: 43870 - DNA, 21 bp, Artificial sequence
  SiRNA target sequence
ttaattaagaagtatgtaggc

SEQ ID NO: 43871 - DNA, 21 bp, Artificial sequence
  SiRNA target sequence
taattaagaagtatgtaggca

SEQ ID NO: 43872 - DNA, 21 bp, Artificial sequence
  SiRNA target sequence
aattaagaagtatgtaggcag

SEQ ID NO: 43873 - DNA, 21 bp, Artificial sequence
  SiRNA target sequence
attaagaagtatgtaggcagt

SEQ ID NO: 43874 - DNA, 21 bp, Artificial sequence
  SiRNA target sequence
ttaagaagtatgtaggcagtg

SEQ ID NO: 43875 - DNA, 21 bp, Artificial sequence
  SiRNA target sequence
taagaagtatgtaggcagtgt

SEQ ID NO: 43876 - DNA, 21 bp, Artificial sequence
  SiRNA target sequence
aagaagtatgtaggcagtgtt

SEQ ID NO: 43877 - DNA, 21 bp, Artificial sequence
  SiRNA target sequence
agaagtatgtaggcagtgtta

SEQ ID NO: 43878 - DNA, 21 bp, Artificial sequence
  SiRNA target sequence
gaagtatgtaggcagtgttaa

SEQ ID NO: 43879 - DNA, 21 bp, Artificial sequence
  SiRNA target sequence
aagtatgtaggcagtgttaag

SEQ ID NO: 43880 - DNA, 21 bp, Artificial sequence
  SiRNA target sequence
agtatgtaggcagtgttaaga

SEQ ID NO: 43881 - DNA, 21 bp, Artificial sequence
  SiRNA target sequence
gtatgtaggcagtgttaagat

SEQ ID NO: 43882 - DNA, 21 bp, Artificial sequence
  SiRNA target sequence
tatgtaggcagtgttaagatt

SEQ ID NO: 43883 - DNA, 21 bp, Artificial sequence
  SiRNA target sequence
atgtaggcagtgttaagatta

SEQ ID NO: 43884 - DNA, 21 bp, Artificial sequence
  SiRNA target sequence
tgtaggcagtgttaagattaa

SEQ ID NO: 43885 - DNA, 21 bp, Artificial sequence
  SiRNA target sequence
gtaggcagtgttaagattaat

SEQ ID NO: 43886 - DNA, 21 bp, Artificial sequence
  SiRNA target sequence
taggcagtgttaagattaata

SEQ ID NO: 43887 - DNA, 21 bp, Artificial sequence
  SiRNA target sequence
aggcagtgttaagattaatat

SEQ ID NO: 43888 - DNA, 21 bp, Artificial sequence
  SiRNA target sequence
ggcagtgttaagattaatatt

SEQ ID NO: 43889 - DNA, 21 bp, Artificial sequence
  SiRNA target sequence
gcagtgttaagattaatattg

SEQ ID NO: 43890 - DNA, 21 bp, Artificial sequence
  SiRNA target sequence
cagtgttaagattaatattga

SEQ ID NO: 43891 - DNA, 21 bp, Artificial sequence
  SiRNA target sequence
agtgttaagattaatattgat

SEQ ID NO: 43892 - DNA, 21 bp, Artificial sequence
  SiRNA target sequence
gtgttaagattaatattgata

SEQ ID NO: 43893 - DNA, 21 bp, Artificial sequence
  SiRNA target sequence
tgttaagattaatattgataa

SEQ ID NO: 43894 - DNA, 21 bp, Artificial sequence
  SiRNA target sequence
gttaagattaatattgataaa

SEQ ID NO: 43895 - DNA, 21 bp, Artificial sequence
  SiRNA target sequence
ttaagattaatattgataaaa

SEQ ID NO: 43896 - DNA, 21 bp, Artificial sequence
  SiRNA target sequence
taagattaatattgataaaat

SEQ ID NO: 43897 - DNA, 21 bp, Artificial sequence
  SiRNA target sequence
aagattaatattgataaaata

SEQ ID NO: 43898 - DNA, 21 bp, Artificial sequence
  SiRNA target sequence
agattaatattgataaaataa

SEQ ID NO: 43899 - DNA, 21 bp, Artificial sequence
  SiRNA target sequence
gattaatattgataaaataaa

SEQ ID NO: 43900 - DNA, 21 bp, Artificial sequence
  SiRNA target sequence
attaatattgataaaataaag

SEQ ID NO: 43901 - DNA, 21 bp, Artificial sequence
  SiRNA target sequence
ttaatattgataaaataaagg

SEQ ID NO: 43902 - DNA, 21 bp, Artificial sequence
  SiRNA target sequence
taatattgataaaataaagga

SEQ ID NO: 43903 - DNA, 21 bp, Artificial sequence
  SiRNA target sequence
aatattgataaaataaaggag

SEQ ID NO: 43904 - DNA, 21 bp, Artificial sequence
  SiRNA target sequence
atattgataaaataaaggagt

SEQ ID NO: 43905 - DNA, 21 bp, Artificial sequence
  SiRNA target sequence
tattgataaaataaaggagtt

SEQ ID NO: 43906 - DNA, 21 bp, Artificial sequence
  SiRNA target sequence
attgataaaataaaggagttg

SEQ ID NO: 43907 - DNA, 21 bp, Artificial sequence
  SiRNA target sequence
ttgataaaataaaggagttgt

SEQ ID NO: 43908 - DNA, 21 bp, Artificial sequence
  SiRNA target sequence
tgataaaataaaggagttgtt

SEQ ID NO: 43909 - DNA, 21 bp, Artificial sequence
  SiRNA target sequence
gataaaataaaggagttgtta

SEQ ID NO: 43910 - DNA, 21 bp, Artificial sequence
  SiRNA target sequence
ataaaataaaggagttgttaa

SEQ ID NO: 43911 - DNA, 21 bp, Artificial sequence
  SiRNA target sequence
taaaataaaggagttgttaac

SEQ ID NO: 43912 - DNA, 21 bp, Artificial sequence
  SiRNA target sequence
aaaataaaggagttgttaaca

SEQ ID NO: 43913 - DNA, 21 bp, Artificial sequence
  SiRNA target sequence
aaataaaggagttgttaacat

SEQ ID NO: 43914 - DNA, 21 bp, Artificial sequence
  SiRNA target sequence
aataaaggagttgttaacatt

SEQ ID NO: 43915 - DNA, 21 bp, Artificial sequence
  SiRNA target sequence
ataaaggagttgttaacattt

SEQ ID NO: 43916 - DNA, 21 bp, Artificial sequence
  SiRNA target sequence
taaaggagttgttaacatttg

SEQ ID NO: 43917 - DNA, 21 bp, Artificial sequence
  SiRNA target sequence
aaaggagttgttaacatttgg

SEQ ID NO: 43918 - DNA, 21 bp, Artificial sequence
  SiRNA target sequence
aaggagttgttaacatttggt

SEQ ID NO: 43919 - DNA, 21 bp, Artificial sequence
  SiRNA target sequence
aggagttgttaacatttggta

SEQ ID NO: 43920 - DNA, 21 bp, Artificial sequence
  SiRNA target sequence
ggagttgttaacatttggtaa

SEQ ID NO: 43921 - DNA, 21 bp, Artificial sequence
  SiRNA target sequence
gagttgttaacatttggtaag

SEQ ID NO: 43922 - DNA, 21 bp, Artificial sequence
  SiRNA target sequence
agttgttaacatttggtaagc

SEQ ID NO: 43923 - DNA, 21 bp, Artificial sequence
  SiRNA target sequence
gttgttaacatttggtaagca

SEQ ID NO: 43924 - DNA, 21 bp, Artificial sequence
  SiRNA target sequence
ttgttaacatttggtaagcaa

SEQ ID NO: 43925 - DNA, 21 bp, Artificial sequence
  SiRNA target sequence
tgttaacatttggtaagcaag

SEQ ID NO: 43926 - DNA, 21 bp, Artificial sequence
  SiRNA target sequence
gttaacatttggtaagcaagc

SEQ ID NO: 43927 - DNA, 21 bp, Artificial sequence
  SiRNA target sequence
ttaacatttggtaagcaagca

SEQ ID NO: 43928 - DNA, 21 bp, Artificial sequence
  SiRNA target sequence
taacatttggtaagcaagcat

SEQ ID NO: 43929 - DNA, 21 bp, Artificial sequence
  SiRNA target sequence
aacatttggtaagcaagcatt

SEQ ID NO: 43930 - DNA, 21 bp, Artificial sequence
  SiRNA target sequence
acatttggtaagcaagcatta

SEQ ID NO: 43931 - DNA, 21 bp, Artificial sequence
  SiRNA target sequence
catttggtaagcaagcattag

SEQ ID NO: 43932 - DNA, 21 bp, Artificial sequence
  SiRNA target sequence
atttggtaagcaagcattaga

SEQ ID NO: 43933 - DNA, 21 bp, Artificial sequence
  SiRNA target sequence
tttggtaagcaagcattagac

SEQ ID NO: 43934 - DNA, 21 bp, Artificial sequence
  SiRNA target sequence
ttggtaagcaagcattagacg

SEQ ID NO: 43935 - DNA, 21 bp, Artificial sequence
  SiRNA target sequence
tggtaagcaagcattagacgt

SEQ ID NO: 43936 - DNA, 21 bp, Artificial sequence
  SiRNA target sequence
ggtaagcaagcattagacgtg

SEQ ID NO: 43937 - DNA, 21 bp, Artificial sequence
  SiRNA target sequence
gtaagcaagcattagacgtgg

SEQ ID NO: 43938 - DNA, 21 bp, Artificial sequence
  SiRNA target sequence
taagcaagcattagacgtgga

SEQ ID NO: 43939 - DNA, 21 bp, Artificial sequence
  SiRNA target sequence
aagcaagcattagacgtggat

SEQ ID NO: 43940 - DNA, 21 bp, Artificial sequence
  SiRNA target sequence
agcaagcattagacgtggata

SEQ ID NO: 43941 - DNA, 21 bp, Artificial sequence
  SiRNA target sequence
gcaagcattagacgtggataa

SEQ ID NO: 43942 - DNA, 21 bp, Artificial sequence
  SiRNA target sequence
caagcattagacgtggataat

SEQ ID NO: 43943 - DNA, 21 bp, Artificial sequence
  SiRNA target sequence
aagcattagacgtggataatc

SEQ ID NO: 43944 - DNA, 21 bp, Artificial sequence
  SiRNA target sequence
agcattagacgtggataatcc

SEQ ID NO: 43945 - DNA, 21 bp, Artificial sequence
  SiRNA target sequence
gcattagacgtggataatccc

SEQ ID NO: 43946 - DNA, 21 bp, Artificial sequence
  SiRNA target sequence
cattagacgtggataatccca

SEQ ID NO: 43947 - DNA, 21 bp, Artificial sequence
  SiRNA target sequence
attagacgtggataatcccat

SEQ ID NO: 43948 - DNA, 21 bp, Artificial sequence
  SiRNA target sequence
ttagacgtggataatcccatt

SEQ ID NO: 43949 - DNA, 21 bp, Artificial sequence
  SiRNA target sequence
tagacgtggataatcccatta

SEQ ID NO: 43950 - DNA, 21 bp, Artificial sequence
  SiRNA target sequence
agacgtggataatcccattat

SEQ ID NO: 43951 - DNA, 21 bp, Artificial sequence
  SiRNA target sequence
gacgtggataatcccattatt

SEQ ID NO: 43952 - DNA, 21 bp, Artificial sequence
  SiRNA target sequence
acgtggataatcccattattc

SEQ ID NO: 43953 - DNA, 21 bp, Artificial sequence
  SiRNA target sequence
cgtggataatcccattattca

SEQ ID NO: 43954 - DNA, 21 bp, Artificial sequence
  SiRNA target sequence
gtggataatcccattattcaa

SEQ ID NO: 43955 - DNA, 21 bp, Artificial sequence
  SiRNA target sequence
tggataatcccattattcaag

SEQ ID NO: 43956 - DNA, 21 bp, Artificial sequence
  SiRNA target sequence
ggataatcccattattcaagt

SEQ ID NO: 43957 - DNA, 21 bp, Artificial sequence
  SiRNA target sequence
gataatcccattattcaagtt

SEQ ID NO: 43958 - DNA, 21 bp, Artificial sequence
  SiRNA target sequence
ataatcccattattcaagtta

SEQ ID NO: 43959 - DNA, 21 bp, Artificial sequence
  SiRNA target sequence
taatcccattattcaagttaa

SEQ ID NO: 43960 - DNA, 21 bp, Artificial sequence
  SiRNA target sequence
aatcccattattcaagttaaa

SEQ ID NO: 43961 - DNA, 21 bp, Artificial sequence
  SiRNA target sequence
atcccattattcaagttaaaa

SEQ ID NO: 43962 - DNA, 21 bp, Artificial sequence
  SiRNA target sequence
tcccattattcaagttaaaat

SEQ ID NO: 43963 - DNA, 21 bp, Artificial sequence
  SiRNA target sequence
cccattattcaagttaaaatg

SEQ ID NO: 43964 - DNA, 21 bp, Artificial sequence
  SiRNA target sequence
ccattattcaagttaaaatgc

SEQ ID NO: 43965 - DNA, 21 bp, Artificial sequence
  SiRNA target sequence
cattattcaagttaaaatgca

SEQ ID NO: 43966 - DNA, 21 bp, Artificial sequence
  SiRNA target sequence
attattcaagttaaaatgcaa

SEQ ID NO: 43967 - DNA, 21 bp, Artificial sequence
  SiRNA target sequence
ttattcaagttaaaatgcaaa

SEQ ID NO: 43968 - DNA, 21 bp, Artificial sequence
  SiRNA target sequence
tattcaagttaaaatgcaaat

SEQ ID NO: 43969 - DNA, 21 bp, Artificial sequence
  SiRNA target sequence
attcaagttaaaatgcaaatt

SEQ ID NO: 43970 - DNA, 21 bp, Artificial sequence
  SiRNA target sequence
ttcaagttaaaatgcaaattg

SEQ ID NO: 43971 - DNA, 21 bp, Artificial sequence
  SiRNA target sequence
tcaagttaaaatgcaaattga

SEQ ID NO: 43972 - DNA, 21 bp, Artificial sequence
  SiRNA target sequence
caagttaaaatgcaaattgat

SEQ ID NO: 43973 - DNA, 21 bp, Artificial sequence
  SiRNA target sequence
aagttaaaatgcaaattgata

SEQ ID NO: 43974 - DNA, 21 bp, Artificial sequence
  SiRNA target sequence
agttaaaatgcaaattgatat

SEQ ID NO: 43975 - DNA, 21 bp, Artificial sequence
  SiRNA target sequence
gttaaaatgcaaattgatatg

SEQ ID NO: 43976 - DNA, 21 bp, Artificial sequence
  SiRNA target sequence
ttaaaatgcaaattgatatgc

SEQ ID NO: 43977 - DNA, 21 bp, Artificial sequence
  SiRNA target sequence
taaaatgcaaattgatatgcc

SEQ ID NO: 43978 - DNA, 21 bp, Artificial sequence
  SiRNA target sequence
aaaatgcaaattgatatgcca

SEQ ID NO: 43979 - DNA, 21 bp, Artificial sequence
  SiRNA target sequence
aaatgcaaattgatatgccag

SEQ ID NO: 43980 - DNA, 21 bp, Artificial sequence
  SiRNA target sequence
aatgcaaattgatatgccaga

SEQ ID NO: 43981 - DNA, 21 bp, Artificial sequence
  SiRNA target sequence
atgcaaattgatatgccagat

SEQ ID NO: 43982 - DNA, 21 bp, Artificial sequence
  SiRNA target sequence
tgcaaattgatatgccagatt

SEQ ID NO: 43983 - DNA, 21 bp, Artificial sequence
  SiRNA target sequence
gcaaattgatatgccagatta

SEQ ID NO: 43984 - DNA, 21 bp, Artificial sequence
  SiRNA target sequence
caaattgatatgccagattac

SEQ ID NO: 43985 - DNA, 21 bp, Artificial sequence
  SiRNA target sequence
aaattgatatgccagattaca

SEQ ID NO: 43986 - DNA, 21 bp, Artificial sequence
  SiRNA target sequence
aattgatatgccagattacac

SEQ ID NO: 43987 - DNA, 21 bp, Artificial sequence
  SiRNA target sequence
attgatatgccagattacaca

SEQ ID NO: 43988 - DNA, 21 bp, Artificial sequence
  SiRNA target sequence
ttgatatgccagattacacaa

SEQ ID NO: 43989 - DNA, 21 bp, Artificial sequence
  SiRNA target sequence
tgatatgccagattacacaac

SEQ ID NO: 43990 - DNA, 21 bp, Artificial sequence
  SiRNA target sequence
gatatgccagattacacaact

SEQ ID NO: 43991 - DNA, 21 bp, Artificial sequence
  SiRNA target sequence
atatgccagattacacaactc

SEQ ID NO: 43992 - DNA, 21 bp, Artificial sequence
  SiRNA target sequence
tatgccagattacacaactct

SEQ ID NO: 43993 - DNA, 21 bp, Artificial sequence
  SiRNA target sequence
atgccagattacacaactctt

SEQ ID NO: 43994 - DNA, 21 bp, Artificial sequence
  SiRNA target sequence
tgccagattacacaactcttt

SEQ ID NO: 43995 - DNA, 21 bp, Artificial sequence
  SiRNA target sequence
gccagattacacaactctttt

SEQ ID NO: 43996 - DNA, 21 bp, Artificial sequence
  SiRNA target sequence
ccagattacacaactctttta

SEQ ID NO: 43997 - DNA, 21 bp, Artificial sequence
  SiRNA target sequence
cagattacacaactcttttac

SEQ ID NO: 43998 - DNA, 21 bp, Artificial sequence
  SiRNA target sequence
agattacacaactcttttaca

SEQ ID NO: 43999 - DNA, 21 bp, Artificial sequence
  SiRNA target sequence
gattacacaactcttttacaa

SEQ ID NO: 44000 - DNA, 21 bp, Artificial sequence
  SiRNA target sequence
attacacaactcttttacaac

SEQ ID NO: 44001 - DNA, 21 bp, Artificial sequence
  SiRNA target sequence
ttacacaactcttttacaacc

SEQ ID NO: 44002 - DNA, 21 bp, Artificial sequence
  SiRNA target sequence
tacacaactcttttacaaccc

SEQ ID NO: 44003 - DNA, 21 bp, Artificial sequence
  SiRNA target sequence
acacaactcttttacaaccca

SEQ ID NO: 44004 - DNA, 21 bp, Artificial sequence
  SiRNA target sequence
cacaactcttttacaacccaa

SEQ ID NO: 44005 - DNA, 21 bp, Artificial sequence
  SiRNA target sequence
acaactcttttacaacccaat

SEQ ID NO: 44006 - DNA, 21 bp, Artificial sequence
  SiRNA target sequence
caactcttttacaacccaatg

SEQ ID NO: 44007 - DNA, 21 bp, Artificial sequence
  SiRNA target sequence
aactcttttacaacccaatgt

SEQ ID NO: 44008 - DNA, 21 bp, Artificial sequence
  SiRNA target sequence
actcttttacaacccaatgtt

SEQ ID NO: 44009 - DNA, 21 bp, Artificial sequence
  SiRNA target sequence
ctcttttacaacccaatgtta

SEQ ID NO: 44010 - DNA, 21 bp, Artificial sequence
  SiRNA target sequence
tcttttacaacccaatgttat

SEQ ID NO: 44011 - DNA, 21 bp, Artificial sequence
  SiRNA target sequence
cttttacaacccaatgttatt

SEQ ID NO: 44012 - DNA, 21 bp, Artificial sequence
  SiRNA target sequence
ttttacaacccaatgttattg

SEQ ID NO: 44013 - DNA, 21 bp, Artificial sequence
  SiRNA target sequence
tttacaacccaatgttattgt

SEQ ID NO: 44014 - DNA, 21 bp, Artificial sequence
  SiRNA target sequence
ttacaacccaatgttattgtt

SEQ ID NO: 44015 - DNA, 21 bp, Artificial sequence
  SiRNA target sequence
tacaacccaatgttattgtta

SEQ ID NO: 44016 - DNA, 21 bp, Artificial sequence
  SiRNA target sequence
acaacccaatgttattgttag

SEQ ID NO: 44017 - DNA, 21 bp, Artificial sequence
  SiRNA target sequence
caacccaatgttattgttagt

SEQ ID NO: 44018 - DNA, 21 bp, Artificial sequence
  SiRNA target sequence
aacccaatgttattgttagtg

SEQ ID NO: 44019 - DNA, 21 bp, Artificial sequence
  SiRNA target sequence
acccaatgttattgttagtgc

SEQ ID NO: 44020 - DNA, 21 bp, Artificial sequence
  SiRNA target sequence
cccaatgttattgttagtgct

SEQ ID NO: 44021 - DNA, 21 bp, Artificial sequence
  SiRNA target sequence
ccaatgttattgttagtgcta

SEQ ID NO: 44022 - DNA, 21 bp, Artificial sequence
  SiRNA target sequence
caatgttattgttagtgctat

SEQ ID NO: 44023 - DNA, 21 bp, Artificial sequence
  SiRNA target sequence
aatgttattgttagtgctata

SEQ ID NO: 44024 - DNA, 21 bp, Artificial sequence
  SiRNA target sequence
atgttattgttagtgctatat

SEQ ID NO: 44025 - DNA, 21 bp, Artificial sequence
  SiRNA target sequence
tgttattgttagtgctatatt

SEQ ID NO: 44026 - DNA, 21 bp, Artificial sequence
  SiRNA target sequence
gttattgttagtgctatattt

SEQ ID NO: 44027 - DNA, 21 bp, Artificial sequence
  SiRNA target sequence
ttattgttagtgctatatttt

SEQ ID NO: 44028 - DNA, 21 bp, Artificial sequence
  SiRNA target sequence
tattgttagtgctatattttt

SEQ ID NO: 44029 - DNA, 21 bp, Artificial sequence
  SiRNA target sequence
attgttagtgctatattttta

SEQ ID NO: 44030 - DNA, 21 bp, Artificial sequence
  SiRNA target sequence
ttgttagtgctatatttttag

SEQ ID NO: 44031 - DNA, 21 bp, Artificial sequence
  SiRNA target sequence
tgttagtgctatatttttagt

SEQ ID NO: 44032 - DNA, 21 bp, Artificial sequence
  SiRNA target sequence
gttagtgctatatttttagta

SEQ ID NO: 44033 - DNA, 21 bp, Artificial sequence
  SiRNA target sequence
ttagtgctatatttttagtat

SEQ ID NO: 44034 - DNA, 21 bp, Artificial sequence
  SiRNA target sequence
tagtgctatatttttagtatt

SEQ ID NO: 44035 - DNA, 21 bp, Artificial sequence
  SiRNA target sequence
agtgctatatttttagtatta

SEQ ID NO: 44036 - DNA, 21 bp, Artificial sequence
  SiRNA target sequence
gtgctatatttttagtattaa

SEQ ID NO: 44037 - DNA, 21 bp, Artificial sequence
  SiRNA target sequence
tgctatatttttagtattaag

SEQ ID NO: 44038 - DNA, 21 bp, Artificial sequence
  SiRNA target sequence
gctatatttttagtattaagt

SEQ ID NO: 44039 - DNA, 21 bp, Artificial sequence
  SiRNA target sequence
ctatatttttagtattaagtg

SEQ ID NO: 44040 - DNA, 21 bp, Artificial sequence
  SiRNA target sequence
tatatttttagtattaagtgt

SEQ ID NO: 44041 - DNA, 21 bp, Artificial sequence
  SiRNA target sequence
atatttttagtattaagtgtt

SEQ ID NO: 44042 - DNA, 21 bp, Artificial sequence
  SiRNA target sequence
tatttttagtattaagtgtta

SEQ ID NO: 44043 - DNA, 21 bp, Artificial sequence
  SiRNA target sequence
atttttagtattaagtgttat

SEQ ID NO: 44044 - DNA, 21 bp, Artificial sequence
  SiRNA target sequence
tttttagtattaagtgttatt

SEQ ID NO: 44045 - DNA, 21 bp, Artificial sequence
  SiRNA target sequence
ttttagtattaagtgttattt

SEQ ID NO: 44046 - DNA, 21 bp, Artificial sequence
  SiRNA target sequence
tttagtattaagtgttatttt

SEQ ID NO: 44047 - DNA, 21 bp, Artificial sequence
  SiRNA target sequence
ttagtattaagtgttattttc

SEQ ID NO: 44048 - DNA, 21 bp, Artificial sequence
  SiRNA target sequence
tagtattaagtgttattttca

SEQ ID NO: 44049 - DNA, 21 bp, Artificial sequence
  SiRNA target sequence
agtattaagtgttattttcac

SEQ ID NO: 44050 - DNA, 21 bp, Artificial sequence
  SiRNA target sequence
gtattaagtgttattttcacc

SEQ ID NO: 44051 - DNA, 21 bp, Artificial sequence
  SiRNA target sequence
tattaagtgttattttcacca

SEQ ID NO: 44052 - DNA, 21 bp, Artificial sequence
  SiRNA target sequence
attaagtgttattttcaccag

SEQ ID NO: 44053 - DNA, 21 bp, Artificial sequence
  SiRNA target sequence
ttaagtgttattttcaccaga

SEQ ID NO: 44054 - DNA, 21 bp, Artificial sequence
  SiRNA target sequence
taagtgttattttcaccagaa

SEQ ID NO: 44055 - DNA, 21 bp, Artificial sequence
  SiRNA target sequence
aagtgttattttcaccagaac

SEQ ID NO: 44056 - DNA, 21 bp, Artificial sequence
  SiRNA target sequence
agtgttattttcaccagaact

SEQ ID NO: 44057 - DNA, 21 bp, Artificial sequence
  SiRNA target sequence
gtgttattttcaccagaactc

SEQ ID NO: 44058 - DNA, 21 bp, Artificial sequence
  SiRNA target sequence
tgttattttcaccagaactct

SEQ ID NO: 44059 - DNA, 21 bp, Artificial sequence
  SiRNA target sequence
gttattttcaccagaactctt

SEQ ID NO: 44060 - DNA, 21 bp, Artificial sequence
  SiRNA target sequence
ttattttcaccagaactcttc

SEQ ID NO: 44061 - DNA, 21 bp, Artificial sequence
  SiRNA target sequence
tattttcaccagaactcttcc

SEQ ID NO: 44062 - DNA, 21 bp, Artificial sequence
  SiRNA target sequence
attttcaccagaactcttccc

SEQ ID NO: 44063 - DNA, 21 bp, Artificial sequence
  SiRNA target sequence
ttttcaccagaactcttccca

SEQ ID NO: 44064 - DNA, 21 bp, Artificial sequence
  SiRNA target sequence
tttcaccagaactcttcccac

SEQ ID NO: 44065 - DNA, 21 bp, Artificial sequence
  SiRNA target sequence
ttcaccagaactcttcccaca

SEQ ID NO: 44066 - DNA, 21 bp, Artificial sequence
  SiRNA target sequence
tcaccagaactcttcccacaa

SEQ ID NO: 44067 - DNA, 21 bp, Artificial sequence
  SiRNA target sequence
caccagaactcttcccacaaa

SEQ ID NO: 44068 - DNA, 21 bp, Artificial sequence
  SiRNA target sequence
accagaactcttcccacaaaa

SEQ ID NO: 44069 - DNA, 21 bp, Artificial sequence
  SiRNA target sequence
ccagaactcttcccacaaaaa

SEQ ID NO: 44070 - DNA, 21 bp, Artificial sequence
  SiRNA target sequence
cagaactcttcccacaaaaac

SEQ ID NO: 44071 - DNA, 21 bp, Artificial sequence
  SiRNA target sequence
agaactcttcccacaaaaact

SEQ ID NO: 44072 - DNA, 21 bp, Artificial sequence
  SiRNA target sequence
gaactcttcccacaaaaactg

SEQ ID NO: 44073 - DNA, 21 bp, Artificial sequence
  SiRNA target sequence
aactcttcccacaaaaactgg

SEQ ID NO: 44074 - DNA, 21 bp, Artificial sequence
  SiRNA target sequence
actcttcccacaaaaactgga

SEQ ID NO: 44075 - DNA, 21 bp, Artificial sequence
  SiRNA target sequence
ctcttcccacaaaaactggaa

SEQ ID NO: 44076 - DNA, 21 bp, Artificial sequence
  SiRNA target sequence
tcttcccacaaaaactggaat

SEQ ID NO: 44077 - DNA, 21 bp, Artificial sequence
  SiRNA target sequence
cttcccacaaaaactggaatg

SEQ ID NO: 44078 - DNA, 21 bp, Artificial sequence
  SiRNA target sequence
ttcccacaaaaactggaatgg

SEQ ID NO: 44079 - DNA, 21 bp, Artificial sequence
  SiRNA target sequence
tcccacaaaaactggaatgga

SEQ ID NO: 44080 - DNA, 21 bp, Artificial sequence
  SiRNA target sequence
cccacaaaaactggaatggaa

SEQ ID NO: 44081 - DNA, 21 bp, Artificial sequence
  SiRNA target sequence
ccacaaaaactggaatggaag

SEQ ID NO: 44082 - DNA, 21 bp, Artificial sequence
  SiRNA target sequence
cacaaaaactggaatggaagc

SEQ ID NO: 44083 - DNA, 21 bp, Artificial sequence
  SiRNA target sequence
acaaaaactggaatggaagca

SEQ ID NO: 44084 - DNA, 21 bp, Artificial sequence
  SiRNA target sequence
caaaaactggaatggaagcaa

SEQ ID NO: 44085 - DNA, 21 bp, Artificial sequence
  SiRNA target sequence
aaaaactggaatggaagcaat

SEQ ID NO: 44086 - DNA, 21 bp, Artificial sequence
  SiRNA target sequence
aaaactggaatggaagcaatg

SEQ ID NO: 44087 - DNA, 21 bp, Artificial sequence
  SiRNA target sequence
aaactggaatggaagcaatga

SEQ ID NO: 44088 - DNA, 21 bp, Artificial sequence
  SiRNA target sequence
aactggaatggaagcaatgat

SEQ ID NO: 44089 - DNA, 21 bp, Artificial sequence
  SiRNA target sequence
actggaatggaagcaatgata

SEQ ID NO: 44090 - DNA, 21 bp, Artificial sequence
  SiRNA target sequence
ctggaatggaagcaatgataa

SEQ ID NO: 44091 - DNA, 21 bp, Artificial sequence
  SiRNA target sequence
tggaatggaagcaatgataaa

SEQ ID NO: 44092 - DNA, 21 bp, Artificial sequence
  SiRNA target sequence
ggaatggaagcaatgataaaa

SEQ ID NO: 44093 - DNA, 21 bp, Artificial sequence
  SiRNA target sequence
gaatggaagcaatgataaaaa

SEQ ID NO: 44094 - DNA, 21 bp, Artificial sequence
  SiRNA target sequence
aatggaagcaatgataaaaag

SEQ ID NO: 44095 - DNA, 21 bp, Artificial sequence
  SiRNA target sequence
atggaagcaatgataaaaagg

SEQ ID NO: 44096 - DNA, 21 bp, Artificial sequence
  SiRNA target sequence
tggaagcaatgataaaaagga

SEQ ID NO: 44097 - DNA, 21 bp, Artificial sequence
  SiRNA target sequence
ggaagcaatgataaaaaggat

SEQ ID NO: 44098 - DNA, 21 bp, Artificial sequence
  SiRNA target sequence
gaagcaatgataaaaaggatt

SEQ ID NO: 44099 - DNA, 21 bp, Artificial sequence
  SiRNA target sequence
aagcaatgataaaaaggattg

SEQ ID NO: 44100 - DNA, 21 bp, Artificial sequence
  SiRNA target sequence
agcaatgataaaaaggattgg

SEQ ID NO: 44101 - DNA, 21 bp, Artificial sequence
  SiRNA target sequence
gcaatgataaaaaggattgga

SEQ ID NO: 44102 - DNA, 21 bp, Artificial sequence
  SiRNA target sequence
caatgataaaaaggattggag

SEQ ID NO: 44103 - DNA, 21 bp, Artificial sequence
  SiRNA target sequence
aatgataaaaaggattggaga

SEQ ID NO: 44104 - DNA, 21 bp, Artificial sequence
  SiRNA target sequence
atgataaaaaggattggagat

SEQ ID NO: 44105 - DNA, 21 bp, Artificial sequence
  SiRNA target sequence
tgataaaaaggattggagatc

SEQ ID NO: 44106 - DNA, 21 bp, Artificial sequence
  SiRNA target sequence
gataaaaaggattggagatct

SEQ ID NO: 44107 - DNA, 21 bp, Artificial sequence
  SiRNA target sequence
ataaaaaggattggagatcta

SEQ ID NO: 44108 - DNA, 21 bp, Artificial sequence
  SiRNA target sequence
taaaaaggattggagatctag

SEQ ID NO: 44109 - DNA, 21 bp, Artificial sequence
  SiRNA target sequence
aaaaaggattggagatctagg

SEQ ID NO: 44110 - DNA, 21 bp, Artificial sequence
  SiRNA target sequence
aaaaggattggagatctagga

SEQ ID NO: 44111 - DNA, 21 bp, Artificial sequence
  SiRNA target sequence
aaaggattggagatctaggac

SEQ ID NO: 44112 - DNA, 21 bp, Artificial sequence
  SiRNA target sequence
aaggattggagatctaggacg

SEQ ID NO: 44113 - DNA, 21 bp, Artificial sequence
  SiRNA target sequence
aggattggagatctaggacgt

SEQ ID NO: 44114 - DNA, 21 bp, Artificial sequence
  SiRNA target sequence
ggattggagatctaggacgtg

SEQ ID NO: 44115 - DNA, 21 bp, Artificial sequence
  SiRNA target sequence
gattggagatctaggacgtgc

SEQ ID NO: 44116 - DNA, 21 bp, Artificial sequence
  SiRNA target sequence
attggagatctaggacgtgct

SEQ ID NO: 44117 - DNA, 21 bp, Artificial sequence
  SiRNA target sequence
ttggagatctaggacgtgctg

SEQ ID NO: 44118 - DNA, 21 bp, Artificial sequence
  SiRNA target sequence
tggagatctaggacgtgctgc

SEQ ID NO: 44119 - DNA, 21 bp, Artificial sequence
  SiRNA target sequence
ggagatctaggacgtgctgcg

SEQ ID NO: 44120 - DNA, 21 bp, Artificial sequence
  SiRNA target sequence
gagatctaggacgtgctgcga

SEQ ID NO: 44121 - DNA, 21 bp, Artificial sequence
  SiRNA target sequence
agatctaggacgtgctgcgaa

SEQ ID NO: 44122 - DNA, 21 bp, Artificial sequence
  SiRNA target sequence
gatctaggacgtgctgcgaaa

SEQ ID NO: 44123 - DNA, 21 bp, Artificial sequence
  SiRNA target sequence
atctaggacgtgctgcgaaag

SEQ ID NO: 44124 - DNA, 21 bp, Artificial sequence
  SiRNA target sequence
tctaggacgtgctgcgaaagg

SEQ ID NO: 44125 - DNA, 21 bp, Artificial sequence
  SiRNA target sequence
ctaggacgtgctgcgaaaggc

SEQ ID NO: 44126 - DNA, 21 bp, Artificial sequence
  SiRNA target sequence
taggacgtgctgcgaaaggcg

SEQ ID NO: 44127 - DNA, 21 bp, Artificial sequence
  SiRNA target sequence
aggacgtgctgcgaaaggcgt

SEQ ID NO: 44128 - DNA, 21 bp, Artificial sequence
  SiRNA target sequence
ggacgtgctgcgaaaggcgtt

SEQ ID NO: 44129 - DNA, 21 bp, Artificial sequence
  SiRNA target sequence
gacgtgctgcgaaaggcgttt

SEQ ID NO: 44130 - DNA, 21 bp, Artificial sequence
  SiRNA target sequence
acgtgctgcgaaaggcgtttc

SEQ ID NO: 44131 - DNA, 21 bp, Artificial sequence
  SiRNA target sequence
cgtgctgcgaaaggcgtttct

SEQ ID NO: 44132 - DNA, 21 bp, Artificial sequence
  SiRNA target sequence
gtgctgcgaaaggcgtttctg

SEQ ID NO: 44133 - DNA, 21 bp, Artificial sequence
  SiRNA target sequence
tgctgcgaaaggcgtttctga

SEQ ID NO: 44134 - DNA, 21 bp, Artificial sequence
  SiRNA target sequence
gctgcgaaaggcgtttctgat

SEQ ID NO: 44135 - DNA, 21 bp, Artificial sequence
  SiRNA target sequence
ctgcgaaaggcgtttctgatc

SEQ ID NO: 44136 - DNA, 21 bp, Artificial sequence
  SiRNA target sequence
tgcgaaaggcgtttctgatct

SEQ ID NO: 44137 - DNA, 21 bp, Artificial sequence
  SiRNA target sequence
gcgaaaggcgtttctgatctt

SEQ ID NO: 44138 - DNA, 21 bp, Artificial sequence
  SiRNA target sequence
cgaaaggcgtttctgatctta

SEQ ID NO: 44139 - DNA, 21 bp, Artificial sequence
  SiRNA target sequence
gaaaggcgtttctgatcttaa

SEQ ID NO: 44140 - DNA, 21 bp, Artificial sequence
  SiRNA target sequence
aaaggcgtttctgatcttaat

SEQ ID NO: 44141 - DNA, 21 bp, Artificial sequence
  SiRNA target sequence
aaggcgtttctgatcttaatt

SEQ ID NO: 44142 - DNA, 21 bp, Artificial sequence
  SiRNA target sequence
aggcgtttctgatcttaattc

SEQ ID NO: 44143 - DNA, 21 bp, Artificial sequence
  SiRNA target sequence
ggcgtttctgatcttaattct

SEQ ID NO: 44144 - DNA, 21 bp, Artificial sequence
  SiRNA target sequence
gcgtttctgatcttaattctg

SEQ ID NO: 44145 - DNA, 21 bp, Artificial sequence
  SiRNA target sequence
cgtttctgatcttaattctgt

SEQ ID NO: 44146 - DNA, 21 bp, Artificial sequence
  SiRNA target sequence
gtttctgatcttaattctgtt

SEQ ID NO: 44147 - DNA, 21 bp, Artificial sequence
  SiRNA target sequence
tttctgatcttaattctgttt

SEQ ID NO: 44148 - DNA, 21 bp, Artificial sequence
  SiRNA target sequence
ttctgatcttaattctgtttt

SEQ ID NO: 44149 - DNA, 21 bp, Artificial sequence
  SiRNA target sequence
tctgatcttaattctgttttg

SEQ ID NO: 44150 - DNA, 21 bp, Artificial sequence
  SiRNA target sequence
ctgatcttaattctgttttga

SEQ ID NO: 44151 - DNA, 21 bp, Artificial sequence
  SiRNA target sequence
tgatcttaattctgttttgaa

SEQ ID NO: 44152 - DNA, 21 bp, Artificial sequence
  SiRNA target sequence
gatcttaattctgttttgaat

SEQ ID NO: 44153 - DNA, 21 bp, Artificial sequence
  SiRNA target sequence
atcttaattctgttttgaata

SEQ ID NO: 44154 - DNA, 21 bp, Artificial sequence
  SiRNA target sequence
tcttaattctgttttgaataa

SEQ ID NO: 44155 - DNA, 21 bp, Artificial sequence
  SiRNA target sequence
cttaattctgttttgaataat

SEQ ID NO: 44156 - DNA, 21 bp, Artificial sequence
  SiRNA target sequence
ttaattctgttttgaataatt

SEQ ID NO: 44157 - DNA, 21 bp, Artificial sequence
  SiRNA target sequence
taattctgttttgaataattc

SEQ ID NO: 44158 - DNA, 21 bp, Artificial sequence
  SiRNA target sequence
aattctgttttgaataattcc

SEQ ID NO: 44159 - DNA, 21 bp, Artificial sequence
  SiRNA target sequence
attctgttttgaataattcca

SEQ ID NO: 44160 - DNA, 21 bp, Artificial sequence
  SiRNA target sequence
ttctgttttgaataattccat

SEQ ID NO: 44161 - DNA, 21 bp, Artificial sequence
  SiRNA target sequence
tctgttttgaataattccatt

SEQ ID NO: 44162 - DNA, 21 bp, Artificial sequence
  SiRNA target sequence
ctgttttgaataattccattt

SEQ ID NO: 44163 - DNA, 21 bp, Artificial sequence
  SiRNA target sequence
tgttttgaataattccatttc

SEQ ID NO: 44164 - DNA, 21 bp, Artificial sequence
  SiRNA target sequence
gttttgaataattccatttca

SEQ ID NO: 44165 - DNA, 21 bp, Artificial sequence
  SiRNA target sequence
ttttgaataattccatttcaa

SEQ ID NO: 44166 - DNA, 21 bp, Artificial sequence
  SiRNA target sequence
tttgaataattccatttcaac

SEQ ID NO: 44167 - DNA, 21 bp, Artificial sequence
  SiRNA target sequence
ttgaataattccatttcaact

SEQ ID NO: 44168 - DNA, 21 bp, Artificial sequence
  SiRNA target sequence
tgaataattccatttcaacta

SEQ ID NO: 44169 - DNA, 21 bp, Artificial sequence
  SiRNA target sequence
gaataattccatttcaactat

SEQ ID NO: 44170 - DNA, 21 bp, Artificial sequence
  SiRNA target sequence
aataattccatttcaactatg

SEQ ID NO: 44171 - DNA, 21 bp, Artificial sequence
  SiRNA target sequence
ataattccatttcaactatgt

SEQ ID NO: 44172 - DNA, 21 bp, Artificial sequence
  SiRNA target sequence
taattccatttcaactatgtt

SEQ ID NO: 44173 - DNA, 21 bp, Artificial sequence
  SiRNA target sequence
aattccatttcaactatgttg

SEQ ID NO: 44174 - DNA, 21 bp, Artificial sequence
  SiRNA target sequence
attccatttcaactatgttgg

SEQ ID NO: 44175 - DNA, 21 bp, Artificial sequence
  SiRNA target sequence
ttccatttcaactatgttgga

SEQ ID NO: 44176 - DNA, 21 bp, Artificial sequence
  SiRNA target sequence
tccatttcaactatgttggaa

SEQ ID NO: 44177 - DNA, 21 bp, Artificial sequence
  SiRNA target sequence
ccatttcaactatgttggaac

SEQ ID NO: 44178 - DNA, 21 bp, Artificial sequence
  SiRNA target sequence
catttcaactatgttggaaca

SEQ ID NO: 44179 - DNA, 21 bp, Artificial sequence
  SiRNA target sequence
atttcaactatgttggaacat

SEQ ID NO: 44180 - DNA, 21 bp, Artificial sequence
  SiRNA target sequence
tttcaactatgttggaacatt

SEQ ID NO: 44181 - DNA, 21 bp, Artificial sequence
  SiRNA target sequence
ttcaactatgttggaacattt

SEQ ID NO: 44182 - DNA, 21 bp, Artificial sequence
  SiRNA target sequence
tcaactatgttggaacatttt

SEQ ID NO: 44183 - DNA, 21 bp, Artificial sequence
  SiRNA target sequence
caactatgttggaacattttg

SEQ ID NO: 44184 - DNA, 21 bp, Artificial sequence
  SiRNA target sequence
aactatgttggaacattttgg

SEQ ID NO: 44185 - DNA, 21 bp, Artificial sequence
  SiRNA target sequence
actatgttggaacattttggc

SEQ ID NO: 44186 - DNA, 21 bp, Artificial sequence
  SiRNA target sequence
ctatgttggaacattttggcg

SEQ ID NO: 44187 - DNA, 21 bp, Artificial sequence
  SiRNA target sequence
tatgttggaacattttggcgt

SEQ ID NO: 44188 - DNA, 21 bp, Artificial sequence
  SiRNA target sequence
atgttggaacattttggcgtt

SEQ ID NO: 44189 - DNA, 21 bp, Artificial sequence
  SiRNA target sequence
tgttggaacattttggcgttc

SEQ ID NO: 44190 - DNA, 21 bp, Artificial sequence
  SiRNA target sequence
gttggaacattttggcgttca

SEQ ID NO: 44191 - DNA, 21 bp, Artificial sequence
  SiRNA target sequence
ttggaacattttggcgttcat

SEQ ID NO: 44192 - DNA, 21 bp, Artificial sequence
  SiRNA target sequence
tggaacattttggcgttcata

SEQ ID NO: 44193 - DNA, 21 bp, Artificial sequence
  SiRNA target sequence
ggaacattttggcgttcatac

SEQ ID NO: 44194 - DNA, 21 bp, Artificial sequence
  SiRNA target sequence
gaacattttggcgttcatact

SEQ ID NO: 44195 - DNA, 21 bp, Artificial sequence
  SiRNA target sequence
aacattttggcgttcatactt

SEQ ID NO: 44196 - DNA, 21 bp, Artificial sequence
  SiRNA target sequence
acattttggcgttcatacttt

SEQ ID NO: 44197 - DNA, 21 bp, Artificial sequence
  SiRNA target sequence
cattttggcgttcatacttta

SEQ ID NO: 44198 - DNA, 21 bp, Artificial sequence
  SiRNA target sequence
attttggcgttcatactttag

SEQ ID NO: 44199 - DNA, 21 bp, Artificial sequence
  SiRNA target sequence
ttttggcgttcatactttagg

SEQ ID NO: 44200 - DNA, 21 bp, Artificial sequence
  SiRNA target sequence
tttggcgttcatactttaggt

SEQ ID NO: 44201 - DNA, 21 bp, Artificial sequence
  SiRNA target sequence
ttggcgttcatactttaggtt

SEQ ID NO: 44202 - DNA, 21 bp, Artificial sequence
  SiRNA target sequence
tggcgttcatactttaggttt

SEQ ID NO: 44203 - DNA, 21 bp, Artificial sequence
  SiRNA target sequence
ggcgttcatactttaggttta

SEQ ID NO: 44204 - DNA, 21 bp, Artificial sequence
  SiRNA target sequence
gcgttcatactttaggtttaa

SEQ ID NO: 44205 - DNA, 21 bp, Artificial sequence
  SiRNA target sequence
cgttcatactttaggtttaaa

SEQ ID NO: 44206 - DNA, 21 bp, Artificial sequence
  SiRNA target sequence
gttcatactttaggtttaaaa

SEQ ID NO: 44207 - DNA, 21 bp, Artificial sequence
  SiRNA target sequence
ttcatactttaggtttaaaac

SEQ ID NO: 44208 - DNA, 21 bp, Artificial sequence
  SiRNA target sequence
tcatactttaggtttaaaaca

SEQ ID NO: 44209 - DNA, 21 bp, Artificial sequence
  SiRNA target sequence
catactttaggtttaaaacaa

SEQ ID NO: 44210 - DNA, 21 bp, Artificial sequence
  SiRNA target sequence
atactttaggtttaaaacaag

SEQ ID NO: 44211 - DNA, 21 bp, Artificial sequence
  SiRNA target sequence
tactttaggtttaaaacaaga

SEQ ID NO: 44212 - DNA, 21 bp, Artificial sequence
  SiRNA target sequence
actttaggtttaaaacaagag

SEQ ID NO: 44213 - DNA, 21 bp, Artificial sequence
  SiRNA target sequence
ctttaggtttaaaacaagagg

SEQ ID NO: 44214 - DNA, 21 bp, Artificial sequence
  SiRNA target sequence
tttaggtttaaaacaagaggc

SEQ ID NO: 44215 - DNA, 21 bp, Artificial sequence
  SiRNA target sequence
ttaggtttaaaacaagaggca

SEQ ID NO: 44216 - DNA, 21 bp, Artificial sequence
  SiRNA target sequence
taggtttaaaacaagaggcag

SEQ ID NO: 44217 - DNA, 21 bp, Artificial sequence
  SiRNA target sequence
aggtttaaaacaagaggcaga

SEQ ID NO: 44218 - DNA, 21 bp, Artificial sequence
  SiRNA target sequence
ggtttaaaacaagaggcagag

SEQ ID NO: 44219 - DNA, 21 bp, Artificial sequence
  SiRNA target sequence
gtttaaaacaagaggcagagc

SEQ ID NO: 44220 - DNA, 21 bp, Artificial sequence
  SiRNA target sequence
tttaaaacaagaggcagagct

SEQ ID NO: 44221 - DNA, 21 bp, Artificial sequence
  SiRNA target sequence
ttaaaacaagaggcagagctt

SEQ ID NO: 44222 - DNA, 21 bp, Artificial sequence
  SiRNA target sequence
taaaacaagaggcagagcttc

SEQ ID NO: 44223 - DNA, 21 bp, Artificial sequence
  SiRNA target sequence
aaaacaagaggcagagcttca

SEQ ID NO: 44224 - DNA, 21 bp, Artificial sequence
  SiRNA target sequence
aaacaagaggcagagcttcaa

SEQ ID NO: 44225 - DNA, 21 bp, Artificial sequence
  SiRNA target sequence
aacaagaggcagagcttcaac

SEQ ID NO: 44226 - DNA, 21 bp, Artificial sequence
  SiRNA target sequence
acaagaggcagagcttcaact

SEQ ID NO: 44227 - DNA, 21 bp, Artificial sequence
  SiRNA target sequence
caagaggcagagcttcaactt

SEQ ID NO: 44228 - DNA, 21 bp, Artificial sequence
  SiRNA target sequence
aagaggcagagcttcaacttt

SEQ ID NO: 44229 - DNA, 21 bp, Artificial sequence
  SiRNA target sequence
agaggcagagcttcaactttt

SEQ ID NO: 44230 - DNA, 21 bp, Artificial sequence
  SiRNA target sequence
gaggcagagcttcaactttta

SEQ ID NO: 44231 - DNA, 21 bp, Artificial sequence
  SiRNA target sequence
aggcagagcttcaacttttag

SEQ ID NO: 44232 - DNA, 21 bp, Artificial sequence
  SiRNA target sequence
ggcagagcttcaacttttagt

SEQ ID NO: 44233 - DNA, 21 bp, Artificial sequence
  SiRNA target sequence
gcagagcttcaacttttagta

SEQ ID NO: 44234 - DNA, 21 bp, Artificial sequence
  SiRNA target sequence
cagagcttcaacttttagtac

SEQ ID NO: 44235 - DNA, 21 bp, Artificial sequence
  SiRNA target sequence
agagcttcaacttttagtaca

SEQ ID NO: 44236 - DNA, 21 bp, Artificial sequence
  SiRNA target sequence
gagcttcaacttttagtacaa

SEQ ID NO: 44237 - DNA, 21 bp, Artificial sequence
  SiRNA target sequence
agcttcaacttttagtacaag

SEQ ID NO: 44238 - DNA, 21 bp, Artificial sequence
  SiRNA target sequence
gcttcaacttttagtacaagg

SEQ ID NO: 44239 - DNA, 21 bp, Artificial sequence
  SiRNA target sequence
cttcaacttttagtacaaggc

SEQ ID NO: 44240 - DNA, 21 bp, Artificial sequence
  SiRNA target sequence
ttcaacttttagtacaaggct

SEQ ID NO: 44241 - DNA, 21 bp, Artificial sequence
  SiRNA target sequence
tcaacttttagtacaaggcta

SEQ ID NO: 44242 - DNA, 21 bp, Artificial sequence
  SiRNA target sequence
caacttttagtacaaggctat

SEQ ID NO: 44243 - DNA, 21 bp, Artificial sequence
  SiRNA target sequence
aacttttagtacaaggctata

SEQ ID NO: 44244 - DNA, 21 bp, Artificial sequence
  SiRNA target sequence
acttttagtacaaggctataa

SEQ ID NO: 44245 - DNA, 21 bp, Artificial sequence
  SiRNA target sequence
cttttagtacaaggctataag

SEQ ID NO: 44246 - DNA, 21 bp, Artificial sequence
  SiRNA target sequence
ttttagtacaaggctataagg

SEQ ID NO: 44247 - DNA, 21 bp, Artificial sequence
  SiRNA target sequence
tttagtacaaggctataaggc

SEQ ID NO: 44248 - DNA, 21 bp, Artificial sequence
  SiRNA target sequence
ttagtacaaggctataaggcc

SEQ ID NO: 44249 - DNA, 21 bp, Artificial sequence
  SiRNA target sequence
tagtacaaggctataaggcct

SEQ ID NO: 44250 - DNA, 21 bp, Artificial sequence
  SiRNA target sequence
agtacaaggctataaggcctg

SEQ ID NO: 44251 - DNA, 21 bp, Artificial sequence
  SiRNA target sequence
gtacaaggctataaggcctgg

SEQ ID NO: 44252 - DNA, 21 bp, Artificial sequence
  SiRNA target sequence
tacaaggctataaggcctggt

SEQ ID NO: 44253 - DNA, 21 bp, Artificial sequence
  SiRNA target sequence
acaaggctataaggcctggtg

SEQ ID NO: 44254 - DNA, 21 bp, Artificial sequence
  SiRNA target sequence
caaggctataaggcctggtgc

SEQ ID NO: 44255 - DNA, 21 bp, Artificial sequence
  SiRNA target sequence
aaggctataaggcctggtgcg

SEQ ID NO: 44256 - DNA, 21 bp, Artificial sequence
  SiRNA target sequence
aggctataaggcctggtgcga

SEQ ID NO: 44257 - DNA, 21 bp, Artificial sequence
  SiRNA target sequence
ggctataaggcctggtgcgat

SEQ ID NO: 44258 - DNA, 21 bp, Artificial sequence
  SiRNA target sequence
gctataaggcctggtgcgatg

SEQ ID NO: 44259 - DNA, 21 bp, Artificial sequence
  SiRNA target sequence
ctataaggcctggtgcgatga

SEQ ID NO: 44260 - DNA, 21 bp, Artificial sequence
  SiRNA target sequence
tataaggcctggtgcgatgaa

SEQ ID NO: 44261 - DNA, 21 bp, Artificial sequence
  SiRNA target sequence
ataaggcctggtgcgatgaag

SEQ ID NO: 44262 - DNA, 21 bp, Artificial sequence
  SiRNA target sequence
taaggcctggtgcgatgaagt

SEQ ID NO: 44263 - DNA, 21 bp, Artificial sequence
  SiRNA target sequence
aaggcctggtgcgatgaagtg

SEQ ID NO: 44264 - DNA, 21 bp, Artificial sequence
  SiRNA target sequence
aggcctggtgcgatgaagtga

SEQ ID NO: 44265 - DNA, 21 bp, Artificial sequence
  SiRNA target sequence
ggcctggtgcgatgaagtgag

SEQ ID NO: 44266 - DNA, 21 bp, Artificial sequence
  SiRNA target sequence
gcctggtgcgatgaagtgaga

SEQ ID NO: 44267 - DNA, 21 bp, Artificial sequence
  SiRNA target sequence
cctggtgcgatgaagtgagag

SEQ ID NO: 44268 - DNA, 21 bp, Artificial sequence
  SiRNA target sequence
ctggtgcgatgaagtgagagc

SEQ ID NO: 44269 - DNA, 21 bp, Artificial sequence
  SiRNA target sequence
tggtgcgatgaagtgagagct

SEQ ID NO: 44270 - DNA, 21 bp, Artificial sequence
  SiRNA target sequence
ggtgcgatgaagtgagagctc

SEQ ID NO: 44271 - DNA, 21 bp, Artificial sequence
  SiRNA target sequence
gtgcgatgaagtgagagctct

SEQ ID NO: 44272 - DNA, 21 bp, Artificial sequence
  SiRNA target sequence
tgcgatgaagtgagagctcta

SEQ ID NO: 44273 - DNA, 21 bp, Artificial sequence
  SiRNA target sequence
gcgatgaagtgagagctctag

SEQ ID NO: 44274 - DNA, 21 bp, Artificial sequence
  SiRNA target sequence
cgatgaagtgagagctctagt

SEQ ID NO: 44275 - DNA, 21 bp, Artificial sequence
  SiRNA target sequence
gatgaagtgagagctctagta

SEQ ID NO: 44276 - DNA, 21 bp, Artificial sequence
  SiRNA target sequence
atgaagtgagagctctagtag

SEQ ID NO: 44277 - DNA, 21 bp, Artificial sequence
  SiRNA target sequence
tgaagtgagagctctagtagg

SEQ ID NO: 44278 - DNA, 21 bp, Artificial sequence
  SiRNA target sequence
gaagtgagagctctagtagga

SEQ ID NO: 44279 - DNA, 21 bp, Artificial sequence
  SiRNA target sequence
aagtgagagctctagtaggac

SEQ ID NO: 44280 - DNA, 21 bp, Artificial sequence
  SiRNA target sequence
agtgagagctctagtaggaca

SEQ ID NO: 44281 - DNA, 21 bp, Artificial sequence
  SiRNA target sequence
gtgagagctctagtaggacat

SEQ ID NO: 44282 - DNA, 21 bp, Artificial sequence
  SiRNA target sequence
tgagagctctagtaggacata

SEQ ID NO: 44283 - DNA, 21 bp, Artificial sequence
  SiRNA target sequence
gagagctctagtaggacataa

SEQ ID NO: 44284 - DNA, 21 bp, Artificial sequence
  SiRNA target sequence
agagctctagtaggacataag

SEQ ID NO: 44285 - DNA, 21 bp, Artificial sequence
  SiRNA target sequence
gagctctagtaggacataaga

SEQ ID NO: 44286 - DNA, 21 bp, Artificial sequence
  SiRNA target sequence
agctctagtaggacataagat

SEQ ID NO: 44287 - DNA, 21 bp, Artificial sequence
  SiRNA target sequence
gctctagtaggacataagatt

SEQ ID NO: 44288 - DNA, 21 bp, Artificial sequence
  SiRNA target sequence
ctctagtaggacataagatta

SEQ ID NO: 44289 - DNA, 21 bp, Artificial sequence
  SiRNA target sequence
tctagtaggacataagattaa

SEQ ID NO: 44290 - DNA, 21 bp, Artificial sequence
  SiRNA target sequence
ctagtaggacataagattaaa

SEQ ID NO: 44291 - DNA, 21 bp, Artificial sequence
  SiRNA target sequence
tagtaggacataagattaaat

SEQ ID NO: 44292 - DNA, 21 bp, Artificial sequence
  SiRNA target sequence
agtaggacataagattaaatt

SEQ ID NO: 44293 - DNA, 21 bp, Artificial sequence
  SiRNA target sequence
gtaggacataagattaaatta

SEQ ID NO: 44294 - DNA, 21 bp, Artificial sequence
  SiRNA target sequence
taggacataagattaaattag

SEQ ID NO: 44295 - DNA, 21 bp, Artificial sequence
  SiRNA target sequence
aggacataagattaaattaga

SEQ ID NO: 44296 - DNA, 21 bp, Artificial sequence
  SiRNA target sequence
ggacataagattaaattagac

SEQ ID NO: 44297 - DNA, 21 bp, Artificial sequence
  SiRNA target sequence
gacataagattaaattagacg

SEQ ID NO: 44298 - DNA, 21 bp, Artificial sequence
  SiRNA target sequence
acataagattaaattagacgg

SEQ ID NO: 44299 - DNA, 21 bp, Artificial sequence
  SiRNA target sequence
cataagattaaattagacgga

SEQ ID NO: 44300 - DNA, 21 bp, Artificial sequence
  SiRNA target sequence
ataagattaaattagacggag

SEQ ID NO: 44301 - DNA, 21 bp, Artificial sequence
  SiRNA target sequence
taagattaaattagacggaga

SEQ ID NO: 44302 - DNA, 21 bp, Artificial sequence
  SiRNA target sequence
aagattaaattagacggagat

SEQ ID NO: 44303 - DNA, 21 bp, Artificial sequence
  SiRNA target sequence
agattaaattagacggagatt

SEQ ID NO: 44304 - DNA, 21 bp, Artificial sequence
  SiRNA target sequence
gattaaattagacggagattt

SEQ ID NO: 44305 - DNA, 21 bp, Artificial sequence
  SiRNA target sequence
attaaattagacggagatttt

SEQ ID NO: 44306 - DNA, 21 bp, Artificial sequence
  SiRNA target sequence
ttaaattagacggagattttg

SEQ ID NO: 44307 - DNA, 21 bp, Artificial sequence
  SiRNA target sequence
taaattagacggagattttga

SEQ ID NO: 44308 - DNA, 21 bp, Artificial sequence
  SiRNA target sequence
aaattagacggagattttgat

SEQ ID NO: 44309 - DNA, 21 bp, Artificial sequence
  SiRNA target sequence
aattagacggagattttgatg

SEQ ID NO: 44310 - DNA, 21 bp, Artificial sequence
  SiRNA target sequence
attagacggagattttgatgg

SEQ ID NO: 44311 - DNA, 21 bp, Artificial sequence
  SiRNA target sequence
ttagacggagattttgatgga

SEQ ID NO: 44312 - DNA, 21 bp, Artificial sequence
  SiRNA target sequence
tagacggagattttgatggaa

SEQ ID NO: 44313 - DNA, 21 bp, Artificial sequence
  SiRNA target sequence
agacggagattttgatggaaa

SEQ ID NO: 44314 - DNA, 21 bp, Artificial sequence
  SiRNA target sequence
gacggagattttgatggaaaa

SEQ ID NO: 44315 - DNA, 21 bp, Artificial sequence
  SiRNA target sequence
acggagattttgatggaaaaa

SEQ ID NO: 44316 - DNA, 21 bp, Artificial sequence
  SiRNA target sequence
cggagattttgatggaaaaag

SEQ ID NO: 44317 - DNA, 21 bp, Artificial sequence
  SiRNA target sequence
ggagattttgatggaaaaagt

SEQ ID NO: 44318 - DNA, 21 bp, Artificial sequence
  SiRNA target sequence
gagattttgatggaaaaagta

SEQ ID NO: 44319 - DNA, 21 bp, Artificial sequence
  SiRNA target sequence
agattttgatggaaaaagtat

SEQ ID NO: 44320 - DNA, 21 bp, Artificial sequence
  SiRNA target sequence
gattttgatggaaaaagtatt

SEQ ID NO: 44321 - DNA, 21 bp, Artificial sequence
  SiRNA target sequence
attttgatggaaaaagtattg

SEQ ID NO: 44322 - DNA, 21 bp, Artificial sequence
  SiRNA target sequence
ttttgatggaaaaagtattgt

SEQ ID NO: 44323 - DNA, 21 bp, Artificial sequence
  SiRNA target sequence
tttgatggaaaaagtattgtt

SEQ ID NO: 44324 - DNA, 21 bp, Artificial sequence
  SiRNA target sequence
ttgatggaaaaagtattgttg

SEQ ID NO: 44325 - DNA, 21 bp, Artificial sequence
  SiRNA target sequence
tgatggaaaaagtattgttga

SEQ ID NO: 44326 - DNA, 21 bp, Artificial sequence
  SiRNA target sequence
gatggaaaaagtattgttgaa

SEQ ID NO: 44327 - DNA, 21 bp, Artificial sequence
  SiRNA target sequence
atggaaaaagtattgttgaag

SEQ ID NO: 44328 - DNA, 21 bp, Artificial sequence
  SiRNA target sequence
tggaaaaagtattgttgaaga

SEQ ID NO: 44329 - DNA, 21 bp, Artificial sequence
  SiRNA target sequence
ggaaaaagtattgttgaagaa

SEQ ID NO: 44330 - DNA, 21 bp, Artificial sequence
  SiRNA target sequence
gaaaaagtattgttgaagaaa

SEQ ID NO: 44331 - DNA, 21 bp, Artificial sequence
  SiRNA target sequence
aaaaagtattgttgaagaaat

SEQ ID NO: 44332 - DNA, 21 bp, Artificial sequence
  SiRNA target sequence
aaaagtattgttgaagaaata

SEQ ID NO: 44333 - DNA, 21 bp, Artificial sequence
  SiRNA target sequence
aaagtattgttgaagaaataa

SEQ ID NO: 44334 - DNA, 21 bp, Artificial sequence
  SiRNA target sequence
aagtattgttgaagaaataat

SEQ ID NO: 44335 - DNA, 21 bp, Artificial sequence
  SiRNA target sequence
agtattgttgaagaaataatg

SEQ ID NO: 44336 - DNA, 21 bp, Artificial sequence
  SiRNA target sequence
gtattgttgaagaaataatga

SEQ ID NO: 44337 - DNA, 21 bp, Artificial sequence
  SiRNA target sequence
tattgttgaagaaataatgaa

SEQ ID NO: 44338 - DNA, 21 bp, Artificial sequence
  SiRNA target sequence
attgttgaagaaataatgaaa

SEQ ID NO: 44339 - DNA, 21 bp, Artificial sequence
  SiRNA target sequence
ttgttgaagaaataatgaaag

SEQ ID NO: 44340 - DNA, 21 bp, Artificial sequence
  SiRNA target sequence
tgttgaagaaataatgaaaga

SEQ ID NO: 44341 - DNA, 21 bp, Artificial sequence
  SiRNA target sequence
gttgaagaaataatgaaagat

SEQ ID NO: 44342 - DNA, 21 bp, Artificial sequence
  SiRNA target sequence
ttgaagaaataatgaaagatg

SEQ ID NO: 44343 - DNA, 21 bp, Artificial sequence
  SiRNA target sequence
tgaagaaataatgaaagatgt

SEQ ID NO: 44344 - DNA, 21 bp, Artificial sequence
  SiRNA target sequence
gaagaaataatgaaagatgtc

SEQ ID NO: 44345 - DNA, 21 bp, Artificial sequence
  SiRNA target sequence
aagaaataatgaaagatgtcc

SEQ ID NO: 44346 - DNA, 21 bp, Artificial sequence
  SiRNA target sequence
agaaataatgaaagatgtcca

SEQ ID NO: 44347 - DNA, 21 bp, Artificial sequence
  SiRNA target sequence
gaaataatgaaagatgtccac

SEQ ID NO: 44348 - DNA, 21 bp, Artificial sequence
  SiRNA target sequence
aaataatgaaagatgtccacg

SEQ ID NO: 44349 - DNA, 21 bp, Artificial sequence
  SiRNA target sequence
aataatgaaagatgtccacga

SEQ ID NO: 44350 - DNA, 21 bp, Artificial sequence
  SiRNA target sequence
ataatgaaagatgtccacgaa

SEQ ID NO: 44351 - DNA, 21 bp, Artificial sequence
  SiRNA target sequence
taatgaaagatgtccacgaaa

SEQ ID NO: 44352 - DNA, 21 bp, Artificial sequence
  SiRNA target sequence
aatgaaagatgtccacgaaat

SEQ ID NO: 44353 - DNA, 21 bp, Artificial sequence
  SiRNA target sequence
atgaaagatgtccacgaaatt

SEQ ID NO: 44354 - DNA, 21 bp, Artificial sequence
  SiRNA target sequence
tgaaagatgtccacgaaattc

SEQ ID NO: 44355 - DNA, 21 bp, Artificial sequence
  SiRNA target sequence
gaaagatgtccacgaaattca

SEQ ID NO: 44356 - DNA, 21 bp, Artificial sequence
  SiRNA target sequence
aaagatgtccacgaaattcag

SEQ ID NO: 44357 - DNA, 21 bp, Artificial sequence
  SiRNA target sequence
aagatgtccacgaaattcagc

SEQ ID NO: 44358 - DNA, 21 bp, Artificial sequence
  SiRNA target sequence
agatgtccacgaaattcagcg

SEQ ID NO: 44359 - DNA, 21 bp, Artificial sequence
  SiRNA target sequence
gatgtccacgaaattcagcgt

SEQ ID NO: 44360 - DNA, 21 bp, Artificial sequence
  SiRNA target sequence
atgtccacgaaattcagcgtg

SEQ ID NO: 44361 - DNA, 21 bp, Artificial sequence
  SiRNA target sequence
tgtccacgaaattcagcgtgt

SEQ ID NO: 44362 - DNA, 21 bp, Artificial sequence
  SiRNA target sequence
gtccacgaaattcagcgtgta

SEQ ID NO: 44363 - DNA, 21 bp, Artificial sequence
  SiRNA target sequence
tccacgaaattcagcgtgtag

SEQ ID NO: 44364 - DNA, 21 bp, Artificial sequence
  SiRNA target sequence
ccacgaaattcagcgtgtaga

SEQ ID NO: 44365 - DNA, 21 bp, Artificial sequence
  SiRNA target sequence
cacgaaattcagcgtgtagag

SEQ ID NO: 44366 - DNA, 21 bp, Artificial sequence
  SiRNA target sequence
acgaaattcagcgtgtagaga

SEQ ID NO: 44367 - DNA, 21 bp, Artificial sequence
  SiRNA target sequence
cgaaattcagcgtgtagagaa

SEQ ID NO: 44368 - DNA, 21 bp, Artificial sequence
  SiRNA target sequence
gaaattcagcgtgtagagaac

SEQ ID NO: 44369 - DNA, 21 bp, Artificial sequence
  SiRNA target sequence
aaattcagcgtgtagagaacc

SEQ ID NO: 44370 - DNA, 21 bp, Artificial sequence
  SiRNA target sequence
aattcagcgtgtagagaacct

SEQ ID NO: 44371 - DNA, 21 bp, Artificial sequence
  SiRNA target sequence
attcagcgtgtagagaacctc

SEQ ID NO: 44372 - DNA, 21 bp, Artificial sequence
  SiRNA target sequence
ttcagcgtgtagagaacctct

SEQ ID NO: 44373 - DNA, 21 bp, Artificial sequence
  SiRNA target sequence
tcagcgtgtagagaacctcta

SEQ ID NO: 44374 - DNA, 21 bp, Artificial sequence
  SiRNA target sequence
cagcgtgtagagaacctctac

SEQ ID NO: 44375 - DNA, 21 bp, Artificial sequence
  SiRNA target sequence
agcgtgtagagaacctctaca

SEQ ID NO: 44376 - DNA, 21 bp, Artificial sequence
  SiRNA target sequence
gcgtgtagagaacctctacaa

SEQ ID NO: 44377 - DNA, 21 bp, Artificial sequence
  SiRNA target sequence
cgtgtagagaacctctacaag

SEQ ID NO: 44378 - DNA, 21 bp, Artificial sequence
  SiRNA target sequence
gtgtagagaacctctacaagc

SEQ ID NO: 44379 - DNA, 21 bp, Artificial sequence
  SiRNA target sequence
tgtagagaacctctacaagca

SEQ ID NO: 44380 - DNA, 21 bp, Artificial sequence
  SiRNA target sequence
gtagagaacctctacaagcaa

SEQ ID NO: 44381 - DNA, 21 bp, Artificial sequence
  SiRNA target sequence
tagagaacctctacaagcaag

SEQ ID NO: 44382 - DNA, 21 bp, Artificial sequence
  SiRNA target sequence
agagaacctctacaagcaagg

SEQ ID NO: 44383 - DNA, 21 bp, Artificial sequence
  SiRNA target sequence
gagaacctctacaagcaagga

SEQ ID NO: 44384 - DNA, 21 bp, Artificial sequence
  SiRNA target sequence
agaacctctacaagcaaggat

SEQ ID NO: 44385 - DNA, 21 bp, Artificial sequence
  SiRNA target sequence
gaacctctacaagcaaggatt

SEQ ID NO: 44386 - DNA, 21 bp, Artificial sequence
  SiRNA target sequence
aacctctacaagcaaggattg

SEQ ID NO: 44387 - DNA, 21 bp, Artificial sequence
  SiRNA target sequence
acctctacaagcaaggattgg

SEQ ID NO: 44388 - DNA, 21 bp, Artificial sequence
  SiRNA target sequence
cctctacaagcaaggattgga

SEQ ID NO: 44389 - DNA, 21 bp, Artificial sequence
  SiRNA target sequence
ctctacaagcaaggattggac

SEQ ID NO: 44390 - DNA, 21 bp, Artificial sequence
  SiRNA target sequence
tctacaagcaaggattggaca

SEQ ID NO: 44391 - DNA, 21 bp, Artificial sequence
  SiRNA target sequence
ctacaagcaaggattggacat

SEQ ID NO: 44392 - DNA, 21 bp, Artificial sequence
  SiRNA target sequence
tacaagcaaggattggacatt

SEQ ID NO: 44393 - DNA, 21 bp, Artificial sequence
  SiRNA target sequence
acaagcaaggattggacattg

SEQ ID NO: 44394 - DNA, 21 bp, Artificial sequence
  SiRNA target sequence
caagcaaggattggacattgc

SEQ ID NO: 44395 - DNA, 21 bp, Artificial sequence
  SiRNA target sequence
aagcaaggattggacattgct

SEQ ID NO: 44396 - DNA, 21 bp, Artificial sequence
  SiRNA target sequence
agcaaggattggacattgctc

SEQ ID NO: 44397 - DNA, 21 bp, Artificial sequence
  SiRNA target sequence
gcaaggattggacattgctcg

SEQ ID NO: 44398 - DNA, 21 bp, Artificial sequence
  SiRNA target sequence
caaggattggacattgctcgt

SEQ ID NO: 44399 - DNA, 21 bp, Artificial sequence
  SiRNA target sequence
aaggattggacattgctcgta

SEQ ID NO: 44400 - DNA, 21 bp, Artificial sequence
  SiRNA target sequence
aggattggacattgctcgtaa

SEQ ID NO: 44401 - DNA, 21 bp, Artificial sequence
  SiRNA target sequence
ggattggacattgctcgtaat

SEQ ID NO: 44402 - DNA, 21 bp, Artificial sequence
  SiRNA target sequence
gattggacattgctcgtaata

SEQ ID NO: 44403 - DNA, 21 bp, Artificial sequence
  SiRNA target sequence
attggacattgctcgtaatat

SEQ ID NO: 44404 - DNA, 21 bp, Artificial sequence
  SiRNA target sequence
ttggacattgctcgtaatatt

SEQ ID NO: 44405 - DNA, 21 bp, Artificial sequence
  SiRNA target sequence
tggacattgctcgtaatattt

SEQ ID NO: 44406 - DNA, 21 bp, Artificial sequence
  SiRNA target sequence
ggacattgctcgtaatatttc

SEQ ID NO: 44407 - DNA, 21 bp, Artificial sequence
  SiRNA target sequence
gacattgctcgtaatatttct

SEQ ID NO: 44408 - DNA, 21 bp, Artificial sequence
  SiRNA target sequence
acattgctcgtaatatttctg

SEQ ID NO: 44409 - DNA, 21 bp, Artificial sequence
  SiRNA target sequence
cattgctcgtaatatttctga

SEQ ID NO: 44410 - DNA, 21 bp, Artificial sequence
  SiRNA target sequence
attgctcgtaatatttctgat

SEQ ID NO: 44411 - DNA, 21 bp, Artificial sequence
  SiRNA target sequence
ttgctcgtaatatttctgata

SEQ ID NO: 44412 - DNA, 21 bp, Artificial sequence
  SiRNA target sequence
tgctcgtaatatttctgatat

SEQ ID NO: 44413 - DNA, 21 bp, Artificial sequence
  SiRNA target sequence
gctcgtaatatttctgatatg

SEQ ID NO: 44414 - DNA, 21 bp, Artificial sequence
  SiRNA target sequence
ctcgtaatatttctgatatga

SEQ ID NO: 44415 - DNA, 21 bp, Artificial sequence
  SiRNA target sequence
tcgtaatatttctgatatgaa

SEQ ID NO: 44416 - DNA, 21 bp, Artificial sequence
  SiRNA target sequence
cgtaatatttctgatatgaaa

SEQ ID NO: 44417 - DNA, 21 bp, Artificial sequence
  SiRNA target sequence
gtaatatttctgatatgaaac

SEQ ID NO: 44418 - DNA, 21 bp, Artificial sequence
  SiRNA target sequence
taatatttctgatatgaaact

SEQ ID NO: 44419 - DNA, 21 bp, Artificial sequence
  SiRNA target sequence
aatatttctgatatgaaactc

SEQ ID NO: 44420 - DNA, 21 bp, Artificial sequence
  SiRNA target sequence
atatttctgatatgaaactcc

SEQ ID NO: 44421 - DNA, 21 bp, Artificial sequence
  SiRNA target sequence
tatttctgatatgaaactccc

SEQ ID NO: 44422 - DNA, 21 bp, Artificial sequence
  SiRNA target sequence
atttctgatatgaaactccca

SEQ ID NO: 44423 - DNA, 21 bp, Artificial sequence
  SiRNA target sequence
tttctgatatgaaactcccat

SEQ ID NO: 44424 - DNA, 21 bp, Artificial sequence
  SiRNA target sequence
ttctgatatgaaactcccatc

SEQ ID NO: 44425 - DNA, 21 bp, Artificial sequence
  SiRNA target sequence
tctgatatgaaactcccatca

SEQ ID NO: 44426 - DNA, 21 bp, Artificial sequence
  SiRNA target sequence
ctgatatgaaactcccatcaa

SEQ ID NO: 44427 - DNA, 21 bp, Artificial sequence
  SiRNA target sequence
tgatatgaaactcccatcaaa

SEQ ID NO: 44428 - DNA, 21 bp, Artificial sequence
  SiRNA target sequence
gatatgaaactcccatcaaaa

SEQ ID NO: 44429 - DNA, 21 bp, Artificial sequence
  SiRNA target sequence
atatgaaactcccatcaaaat

SEQ ID NO: 44430 - DNA, 21 bp, Artificial sequence
  SiRNA target sequence
tatgaaactcccatcaaaatt

SEQ ID NO: 44431 - DNA, 21 bp, Artificial sequence
  SiRNA target sequence
atgaaactcccatcaaaattg

SEQ ID NO: 44432 - DNA, 21 bp, Artificial sequence
  SiRNA target sequence
tgaaactcccatcaaaattga

SEQ ID NO: 44433 - DNA, 21 bp, Artificial sequence
  SiRNA target sequence
gaaactcccatcaaaattgac

SEQ ID NO: 44434 - DNA, 21 bp, Artificial sequence
  SiRNA target sequence
aaactcccatcaaaattgaca

SEQ ID NO: 44435 - DNA, 21 bp, Artificial sequence
  SiRNA target sequence
aactcccatcaaaattgacaa

SEQ ID NO: 44436 - DNA, 21 bp, Artificial sequence
  SiRNA target sequence
actcccatcaaaattgacaat

SEQ ID NO: 44437 - DNA, 21 bp, Artificial sequence
  SiRNA target sequence
ctcccatcaaaattgacaatt

SEQ ID NO: 44438 - DNA, 21 bp, Artificial sequence
  SiRNA target sequence
tcccatcaaaattgacaatta

SEQ ID NO: 44439 - DNA, 21 bp, Artificial sequence
  SiRNA target sequence
cccatcaaaattgacaattag

SEQ ID NO: 44440 - DNA, 21 bp, Artificial sequence
  SiRNA target sequence
ccatcaaaattgacaattagt

SEQ ID NO: 44441 - DNA, 21 bp, Artificial sequence
  SiRNA target sequence
catcaaaattgacaattagtt

SEQ ID NO: 44442 - DNA, 21 bp, Artificial sequence
  SiRNA target sequence
atcaaaattgacaattagttt

SEQ ID NO: 44443 - DNA, 21 bp, Artificial sequence
  SiRNA target sequence
tcaaaattgacaattagtttt

SEQ ID NO: 44444 - DNA, 21 bp, Artificial sequence
  SiRNA target sequence
caaaattgacaattagtttta

SEQ ID NO: 44445 - DNA, 21 bp, Artificial sequence
  SiRNA target sequence
aaaattgacaattagttttaa

SEQ ID NO: 44446 - DNA, 21 bp, Artificial sequence
  SiRNA target sequence
aaattgacaattagttttaat

SEQ ID NO: 44447 - DNA, 21 bp, Artificial sequence
  SiRNA target sequence
aattgacaattagttttaata

SEQ ID NO: 44448 - DNA, 21 bp, Artificial sequence
  SiRNA target sequence
attgacaattagttttaatac

SEQ ID NO: 44449 - DNA, 21 bp, Artificial sequence
  SiRNA target sequence
ttgacaattagttttaatacc

SEQ ID NO: 44450 - DNA, 21 bp, Artificial sequence
  SiRNA target sequence
tgacaattagttttaataccc

SEQ ID NO: 44451 - DNA, 21 bp, Artificial sequence
  SiRNA target sequence
gacaattagttttaataccca

SEQ ID NO: 44452 - DNA, 21 bp, Artificial sequence
  SiRNA target sequence
acaattagttttaatacccac

SEQ ID NO: 44453 - DNA, 21 bp, Artificial sequence
  SiRNA target sequence
caattagttttaatacccaca

SEQ ID NO: 44454 - DNA, 21 bp, Artificial sequence
  SiRNA target sequence
aattagttttaatacccacat

SEQ ID NO: 44455 - DNA, 21 bp, Artificial sequence
  SiRNA target sequence
attagttttaatacccacatg

SEQ ID NO: 44456 - DNA, 21 bp, Artificial sequence
  SiRNA target sequence
ttagttttaatacccacatga

SEQ ID NO: 44457 - DNA, 21 bp, Artificial sequence
  SiRNA target sequence
tagttttaatacccacatgag

SEQ ID NO: 44458 - DNA, 21 bp, Artificial sequence
  SiRNA target sequence
agttttaatacccacatgaga

SEQ ID NO: 44459 - DNA, 21 bp, Artificial sequence
  SiRNA target sequence
gttttaatacccacatgagat

SEQ ID NO: 44460 - DNA, 21 bp, Artificial sequence
  SiRNA target sequence
ttttaatacccacatgagata

SEQ ID NO: 44461 - DNA, 21 bp, Artificial sequence
  SiRNA target sequence
tttaatacccacatgagatat

SEQ ID NO: 44462 - DNA, 21 bp, Artificial sequence
  SiRNA target sequence
ttaatacccacatgagatatt

SEQ ID NO: 44463 - DNA, 21 bp, Artificial sequence
  SiRNA target sequence
taatacccacatgagatattt

SEQ ID NO: 44464 - DNA, 21 bp, Artificial sequence
  SiRNA target sequence
aatacccacatgagatatttg

SEQ ID NO: 44465 - DNA, 21 bp, Artificial sequence
  SiRNA target sequence
atacccacatgagatatttga

SEQ ID NO: 44466 - DNA, 21 bp, Artificial sequence
  SiRNA target sequence
tacccacatgagatatttgac

SEQ ID NO: 44467 - DNA, 21 bp, Artificial sequence
  SiRNA target sequence
acccacatgagatatttgact

SEQ ID NO: 44468 - DNA, 21 bp, Artificial sequence
  SiRNA target sequence
cccacatgagatatttgactg

SEQ ID NO: 44469 - DNA, 21 bp, Artificial sequence
  SiRNA target sequence
ccacatgagatatttgactga

SEQ ID NO: 44470 - DNA, 21 bp, Artificial sequence
  SiRNA target sequence
cacatgagatatttgactgaa

SEQ ID NO: 44471 - DNA, 21 bp, Artificial sequence
  SiRNA target sequence
acatgagatatttgactgaag

SEQ ID NO: 44472 - DNA, 21 bp, Artificial sequence
  SiRNA target sequence
catgagatatttgactgaagt

SEQ ID NO: 44473 - DNA, 21 bp, Artificial sequence
  SiRNA target sequence
atgagatatttgactgaagtt

SEQ ID NO: 44474 - DNA, 21 bp, Artificial sequence
  SiRNA target sequence
tgagatatttgactgaagttt

SEQ ID NO: 44475 - DNA, 21 bp, Artificial sequence
  SiRNA target sequence
gagatatttgactgaagtttt

SEQ ID NO: 44476 - DNA, 21 bp, Artificial sequence
  SiRNA target sequence
agatatttgactgaagttttc

SEQ ID NO: 44477 - DNA, 21 bp, Artificial sequence
  SiRNA target sequence
gatatttgactgaagttttca

SEQ ID NO: 44478 - DNA, 21 bp, Artificial sequence
  SiRNA target sequence
atatttgactgaagttttcaa

SEQ ID NO: 44479 - DNA, 21 bp, Artificial sequence
  SiRNA target sequence
tatttgactgaagttttcaaa

SEQ ID NO: 44480 - DNA, 21 bp, Artificial sequence
  SiRNA target sequence
atttgactgaagttttcaaag

SEQ ID NO: 44481 - DNA, 21 bp, Artificial sequence
  SiRNA target sequence
tttgactgaagttttcaaagc

SEQ ID NO: 44482 - DNA, 21 bp, Artificial sequence
  SiRNA target sequence
ttgactgaagttttcaaagca

SEQ ID NO: 44483 - DNA, 21 bp, Artificial sequence
  SiRNA target sequence
tgactgaagttttcaaagcag

SEQ ID NO: 44484 - DNA, 21 bp, Artificial sequence
  SiRNA target sequence
gactgaagttttcaaagcagt

SEQ ID NO: 44485 - DNA, 21 bp, Artificial sequence
  SiRNA target sequence
actgaagttttcaaagcagta

SEQ ID NO: 44486 - DNA, 21 bp, Artificial sequence
  SiRNA target sequence
ctgaagttttcaaagcagtag

SEQ ID NO: 44487 - DNA, 21 bp, Artificial sequence
  SiRNA target sequence
tgaagttttcaaagcagtaga

SEQ ID NO: 44488 - DNA, 21 bp, Artificial sequence
  SiRNA target sequence
gaagttttcaaagcagtagac

SEQ ID NO: 44489 - DNA, 21 bp, Artificial sequence
  SiRNA target sequence
aagttttcaaagcagtagaca

SEQ ID NO: 44490 - DNA, 21 bp, Artificial sequence
  SiRNA target sequence
agttttcaaagcagtagacac

SEQ ID NO: 44491 - DNA, 21 bp, Artificial sequence
  SiRNA target sequence
gttttcaaagcagtagacacc

SEQ ID NO: 44492 - DNA, 21 bp, Artificial sequence
  SiRNA target sequence
ttttcaaagcagtagacacct

SEQ ID NO: 44493 - DNA, 21 bp, Artificial sequence
  SiRNA target sequence
tttcaaagcagtagacacctc

SEQ ID NO: 44494 - DNA, 21 bp, Artificial sequence
  SiRNA target sequence
ttcaaagcagtagacacctct

SEQ ID NO: 44495 - DNA, 21 bp, Artificial sequence
  SiRNA target sequence
tcaaagcagtagacacctctg

SEQ ID NO: 44496 - DNA, 21 bp, Artificial sequence
  SiRNA target sequence
caaagcagtagacacctctgg

SEQ ID NO: 44497 - DNA, 21 bp, Artificial sequence
  SiRNA target sequence
aaagcagtagacacctctggc

SEQ ID NO: 44498 - DNA, 21 bp, Artificial sequence
  SiRNA target sequence
aagcagtagacacctctggcg

SEQ ID NO: 44499 - DNA, 21 bp, Artificial sequence
  SiRNA target sequence
agcagtagacacctctggcgc

SEQ ID NO: 44500 - DNA, 21 bp, Artificial sequence
  SiRNA target sequence
gcagtagacacctctggcgcc

SEQ ID NO: 44501 - DNA, 21 bp, Artificial sequence
  SiRNA target sequence
cagtagacacctctggcgcct

SEQ ID NO: 44502 - DNA, 21 bp, Artificial sequence
  SiRNA target sequence
agtagacacctctggcgcctt

SEQ ID NO: 44503 - DNA, 21 bp, Artificial sequence
  SiRNA target sequence
gtagacacctctggcgccttt

SEQ ID NO: 44504 - DNA, 21 bp, Artificial sequence
  SiRNA target sequence
tagacacctctggcgcctttg

SEQ ID NO: 44505 - DNA, 21 bp, Artificial sequence
  SiRNA target sequence
agacacctctggcgcctttgg

SEQ ID NO: 44506 - DNA, 21 bp, Artificial sequence
  SiRNA target sequence
gacacctctggcgcctttgga

SEQ ID NO: 44507 - DNA, 21 bp, Artificial sequence
  SiRNA target sequence
acacctctggcgcctttggaa

SEQ ID NO: 44508 - DNA, 21 bp, Artificial sequence
  SiRNA target sequence
cacctctggcgcctttggaaa

SEQ ID NO: 44509 - DNA, 21 bp, Artificial sequence
  SiRNA target sequence
acctctggcgcctttggaaac

SEQ ID NO: 44510 - DNA, 21 bp, Artificial sequence
  SiRNA target sequence
cctctggcgcctttggaaaca

SEQ ID NO: 44511 - DNA, 21 bp, Artificial sequence
  SiRNA target sequence
ctctggcgcctttggaaacaa

SEQ ID NO: 44512 - DNA, 21 bp, Artificial sequence
  SiRNA target sequence
tctggcgcctttggaaacaaa

SEQ ID NO: 44513 - DNA, 21 bp, Artificial sequence
  SiRNA target sequence
ctggcgcctttggaaacaaac

SEQ ID NO: 44514 - DNA, 21 bp, Artificial sequence
  SiRNA target sequence
tggcgcctttggaaacaaacc

SEQ ID NO: 44515 - DNA, 21 bp, Artificial sequence
  SiRNA target sequence
ggcgcctttggaaacaaacca

SEQ ID NO: 44516 - DNA, 21 bp, Artificial sequence
  SiRNA target sequence
gcgcctttggaaacaaaccac

SEQ ID NO: 44517 - DNA, 21 bp, Artificial sequence
  SiRNA target sequence
cgcctttggaaacaaaccacg

SEQ ID NO: 44518 - DNA, 21 bp, Artificial sequence
  SiRNA target sequence
gcctttggaaacaaaccacgg

SEQ ID NO: 44519 - DNA, 21 bp, Artificial sequence
  SiRNA target sequence
cctttggaaacaaaccacgga

SEQ ID NO: 44520 - DNA, 21 bp, Artificial sequence
  SiRNA target sequence
ctttggaaacaaaccacggac

SEQ ID NO: 44521 - DNA, 21 bp, Artificial sequence
  SiRNA target sequence
tttggaaacaaaccacggact

SEQ ID NO: 44522 - DNA, 21 bp, Artificial sequence
  SiRNA target sequence
ttggaaacaaaccacggactc

SEQ ID NO: 44523 - DNA, 21 bp, Artificial sequence
  SiRNA target sequence
tggaaacaaaccacggactca

SEQ ID NO: 44524 - DNA, 21 bp, Artificial sequence
  SiRNA target sequence
ggaaacaaaccacggactcaa

SEQ ID NO: 44525 - DNA, 21 bp, Artificial sequence
  SiRNA target sequence
gaaacaaaccacggactcaac

SEQ ID NO: 44526 - DNA, 21 bp, Artificial sequence
  SiRNA target sequence
aaacaaaccacggactcaacc

SEQ ID NO: 44527 - DNA, 21 bp, Artificial sequence
  SiRNA target sequence
aacaaaccacggactcaacct

SEQ ID NO: 44528 - DNA, 21 bp, Artificial sequence
  SiRNA target sequence
acaaaccacggactcaacctg

SEQ ID NO: 44529 - DNA, 21 bp, Artificial sequence
  SiRNA target sequence
caaaccacggactcaacctgt

SEQ ID NO: 44530 - DNA, 21 bp, Artificial sequence
  SiRNA target sequence
aaaccacggactcaacctgta

SEQ ID NO: 44531 - DNA, 21 bp, Artificial sequence
  SiRNA target sequence
aaccacggactcaacctgtag

SEQ ID NO: 44532 - DNA, 21 bp, Artificial sequence
  SiRNA target sequence
accacggactcaacctgtagt

SEQ ID NO: 44533 - DNA, 21 bp, Artificial sequence
  SiRNA target sequence
ccacggactcaacctgtagtc

SEQ ID NO: 44534 - DNA, 21 bp, Artificial sequence
  SiRNA target sequence
cacggactcaacctgtagtca

SEQ ID NO: 44535 - DNA, 21 bp, Artificial sequence
  SiRNA target sequence
acggactcaacctgtagtcat

SEQ ID NO: 44536 - DNA, 21 bp, Artificial sequence
  SiRNA target sequence
cggactcaacctgtagtcatt

SEQ ID NO: 44537 - DNA, 21 bp, Artificial sequence
  SiRNA target sequence
ggactcaacctgtagtcattt

SEQ ID NO: 44538 - DNA, 21 bp, Artificial sequence
  SiRNA target sequence
gactcaacctgtagtcatttg

SEQ ID NO: 44539 - DNA, 21 bp, Artificial sequence
  SiRNA target sequence
actcaacctgtagtcatttgg

SEQ ID NO: 44540 - DNA, 21 bp, Artificial sequence
  SiRNA target sequence
ctcaacctgtagtcatttggc

SEQ ID NO: 44541 - DNA, 21 bp, Artificial sequence
  SiRNA target sequence
tcaacctgtagtcatttggct

SEQ ID NO: 44542 - DNA, 21 bp, Artificial sequence
  SiRNA target sequence
caacctgtagtcatttggcta

SEQ ID NO: 44543 - DNA, 21 bp, Artificial sequence
  SiRNA target sequence
aacctgtagtcatttggctat

SEQ ID NO: 44544 - DNA, 21 bp, Artificial sequence
  SiRNA target sequence
acctgtagtcatttggctata

SEQ ID NO: 44545 - DNA, 21 bp, Artificial sequence
  SiRNA target sequence
cctgtagtcatttggctatat

SEQ ID NO: 44546 - DNA, 21 bp, Artificial sequence
  SiRNA target sequence
ctgtagtcatttggctatatg

SEQ ID NO: 44547 - DNA, 21 bp, Artificial sequence
  SiRNA target sequence
tgtagtcatttggctatatgg

SEQ ID NO: 44548 - DNA, 21 bp, Artificial sequence
  SiRNA target sequence
gtagtcatttggctatatggt

SEQ ID NO: 44549 - DNA, 21 bp, Artificial sequence
  SiRNA target sequence
tagtcatttggctatatggtg

SEQ ID NO: 44550 - DNA, 21 bp, Artificial sequence
  SiRNA target sequence
agtcatttggctatatggtga

SEQ ID NO: 44551 - DNA, 21 bp, Artificial sequence
  SiRNA target sequence
gtcatttggctatatggtgag

SEQ ID NO: 44552 - DNA, 21 bp, Artificial sequence
  SiRNA target sequence
tcatttggctatatggtgaga

SEQ ID NO: 44553 - DNA, 21 bp, Artificial sequence
  SiRNA target sequence
catttggctatatggtgagag

SEQ ID NO: 44554 - DNA, 21 bp, Artificial sequence
  SiRNA target sequence
atttggctatatggtgagagt

SEQ ID NO: 44555 - DNA, 21 bp, Artificial sequence
  SiRNA target sequence
tttggctatatggtgagagtg

SEQ ID NO: 44556 - DNA, 21 bp, Artificial sequence
  SiRNA target sequence
ttggctatatggtgagagtgg

SEQ ID NO: 44557 - DNA, 21 bp, Artificial sequence
  SiRNA target sequence
tggctatatggtgagagtgga

SEQ ID NO: 44558 - DNA, 21 bp, Artificial sequence
  SiRNA target sequence
ggctatatggtgagagtggac

SEQ ID NO: 44559 - DNA, 21 bp, Artificial sequence
  SiRNA target sequence
gctatatggtgagagtggacg

SEQ ID NO: 44560 - DNA, 21 bp, Artificial sequence
  SiRNA target sequence
ctatatggtgagagtggacgt

SEQ ID NO: 44561 - DNA, 21 bp, Artificial sequence
  SiRNA target sequence
tatatggtgagagtggacgtg

SEQ ID NO: 44562 - DNA, 21 bp, Artificial sequence
  SiRNA target sequence
atatggtgagagtggacgtgg

SEQ ID NO: 44563 - DNA, 21 bp, Artificial sequence
  SiRNA target sequence
tatggtgagagtggacgtggt

SEQ ID NO: 44564 - DNA, 21 bp, Artificial sequence
  SiRNA target sequence
atggtgagagtggacgtggta

SEQ ID NO: 44565 - DNA, 21 bp, Artificial sequence
  SiRNA target sequence
tggtgagagtggacgtggtaa

SEQ ID NO: 44566 - DNA, 21 bp, Artificial sequence
  SiRNA target sequence
ggtgagagtggacgtggtaag

SEQ ID NO: 44567 - DNA, 21 bp, Artificial sequence
  SiRNA target sequence
gtgagagtggacgtggtaagt

SEQ ID NO: 44568 - DNA, 21 bp, Artificial sequence
  SiRNA target sequence
tgagagtggacgtggtaagtc

SEQ ID NO: 44569 - DNA, 21 bp, Artificial sequence
  SiRNA target sequence
gagagtggacgtggtaagtca

SEQ ID NO: 44570 - DNA, 21 bp, Artificial sequence
  SiRNA target sequence
agagtggacgtggtaagtcag

SEQ ID NO: 44571 - DNA, 21 bp, Artificial sequence
  SiRNA target sequence
gagtggacgtggtaagtcagg

SEQ ID NO: 44572 - DNA, 21 bp, Artificial sequence
  SiRNA target sequence
agtggacgtggtaagtcaggt

SEQ ID NO: 44573 - DNA, 21 bp, Artificial sequence
  SiRNA target sequence
gtggacgtggtaagtcaggta

SEQ ID NO: 44574 - DNA, 21 bp, Artificial sequence
  SiRNA target sequence
tggacgtggtaagtcaggtat

SEQ ID NO: 44575 - DNA, 21 bp, Artificial sequence
  SiRNA target sequence
ggacgtggtaagtcaggtatg

SEQ ID NO: 44576 - DNA, 21 bp, Artificial sequence
  SiRNA target sequence
gacgtggtaagtcaggtatga

SEQ ID NO: 44577 - DNA, 21 bp, Artificial sequence
  SiRNA target sequence
acgtggtaagtcaggtatgac

SEQ ID NO: 44578 - DNA, 21 bp, Artificial sequence
  SiRNA target sequence
cgtggtaagtcaggtatgaca

SEQ ID NO: 44579 - DNA, 21 bp, Artificial sequence
  SiRNA target sequence
gtggtaagtcaggtatgacat

SEQ ID NO: 44580 - DNA, 21 bp, Artificial sequence
  SiRNA target sequence
tggtaagtcaggtatgacatg

SEQ ID NO: 44581 - DNA, 21 bp, Artificial sequence
  SiRNA target sequence
ggtaagtcaggtatgacatgg

SEQ ID NO: 44582 - DNA, 21 bp, Artificial sequence
  SiRNA target sequence
gtaagtcaggtatgacatggc

SEQ ID NO: 44583 - DNA, 21 bp, Artificial sequence
  SiRNA target sequence
taagtcaggtatgacatggcc

SEQ ID NO: 44584 - DNA, 21 bp, Artificial sequence
  SiRNA target sequence
aagtcaggtatgacatggccc

SEQ ID NO: 44585 - DNA, 21 bp, Artificial sequence
  SiRNA target sequence
agtcaggtatgacatggccct

SEQ ID NO: 44586 - DNA, 21 bp, Artificial sequence
  SiRNA target sequence
gtcaggtatgacatggccctt

SEQ ID NO: 44587 - DNA, 21 bp, Artificial sequence
  SiRNA target sequence
tcaggtatgacatggccctta

SEQ ID NO: 44588 - DNA, 21 bp, Artificial sequence
  SiRNA target sequence
caggtatgacatggcccttag

SEQ ID NO: 44589 - DNA, 21 bp, Artificial sequence
  SiRNA target sequence
aggtatgacatggcccttagc

SEQ ID NO: 44590 - DNA, 21 bp, Artificial sequence
  SiRNA target sequence
ggtatgacatggcccttagca

SEQ ID NO: 44591 - DNA, 21 bp, Artificial sequence
  SiRNA target sequence
gtatgacatggcccttagcag

SEQ ID NO: 44592 - DNA, 21 bp, Artificial sequence
  SiRNA target sequence
tatgacatggcccttagcagt

SEQ ID NO: 44593 - DNA, 21 bp, Artificial sequence
  SiRNA target sequence
atgacatggcccttagcagta

SEQ ID NO: 44594 - DNA, 21 bp, Artificial sequence
  SiRNA target sequence
tgacatggcccttagcagtag

SEQ ID NO: 44595 - DNA, 21 bp, Artificial sequence
  SiRNA target sequence
gacatggcccttagcagtaga

SEQ ID NO: 44596 - DNA, 21 bp, Artificial sequence
  SiRNA target sequence
acatggcccttagcagtagat

SEQ ID NO: 44597 - DNA, 21 bp, Artificial sequence
  SiRNA target sequence
catggcccttagcagtagatt

SEQ ID NO: 44598 - DNA, 21 bp, Artificial sequence
  SiRNA target sequence
atggcccttagcagtagattt

SEQ ID NO: 44599 - DNA, 21 bp, Artificial sequence
  SiRNA target sequence
tggcccttagcagtagattta

SEQ ID NO: 44600 - DNA, 21 bp, Artificial sequence
  SiRNA target sequence
ggcccttagcagtagatttaa

SEQ ID NO: 44601 - DNA, 21 bp, Artificial sequence
  SiRNA target sequence
gcccttagcagtagatttaaa

SEQ ID NO: 44602 - DNA, 21 bp, Artificial sequence
  SiRNA target sequence
cccttagcagtagatttaaat

SEQ ID NO: 44603 - DNA, 21 bp, Artificial sequence
  SiRNA target sequence
ccttagcagtagatttaaata

SEQ ID NO: 44604 - DNA, 21 bp, Artificial sequence
  SiRNA target sequence
cttagcagtagatttaaataa

SEQ ID NO: 44605 - DNA, 21 bp, Artificial sequence
  SiRNA target sequence
ttagcagtagatttaaataat

SEQ ID NO: 44606 - DNA, 21 bp, Artificial sequence
  SiRNA target sequence
tagcagtagatttaaataata

SEQ ID NO: 44607 - DNA, 21 bp, Artificial sequence
  SiRNA target sequence
agcagtagatttaaataatag

SEQ ID NO: 44608 - DNA, 21 bp, Artificial sequence
  SiRNA target sequence
gcagtagatttaaataatagt

SEQ ID NO: 44609 - DNA, 21 bp, Artificial sequence
  SiRNA target sequence
cagtagatttaaataatagtt

SEQ ID NO: 44610 - DNA, 21 bp, Artificial sequence
  SiRNA target sequence
agtagatttaaataatagttt

SEQ ID NO: 44611 - DNA, 21 bp, Artificial sequence
  SiRNA target sequence
gtagatttaaataatagttta

SEQ ID NO: 44612 - DNA, 21 bp, Artificial sequence
  SiRNA target sequence
tagatttaaataatagtttat

SEQ ID NO: 44613 - DNA, 21 bp, Artificial sequence
  SiRNA target sequence
agatttaaataatagtttatt

SEQ ID NO: 44614 - DNA, 21 bp, Artificial sequence
  SiRNA target sequence
gatttaaataatagtttatta

SEQ ID NO: 44615 - DNA, 21 bp, Artificial sequence
  SiRNA target sequence
atttaaataatagtttattag

SEQ ID NO: 44616 - DNA, 21 bp, Artificial sequence
  SiRNA target sequence
tttaaataatagtttattaga

SEQ ID NO: 44617 - DNA, 21 bp, Artificial sequence
  SiRNA target sequence
ttaaataatagtttattagat

SEQ ID NO: 44618 - DNA, 21 bp, Artificial sequence
  SiRNA target sequence
taaataatagtttattagatg

SEQ ID NO: 44619 - DNA, 21 bp, Artificial sequence
  SiRNA target sequence
aaataatagtttattagatga

SEQ ID NO: 44620 - DNA, 21 bp, Artificial sequence
  SiRNA target sequence
aataatagtttattagatgat

SEQ ID NO: 44621 - DNA, 21 bp, Artificial sequence
  SiRNA target sequence
ataatagtttattagatgatg

SEQ ID NO: 44622 - DNA, 21 bp, Artificial sequence
  SiRNA target sequence
taatagtttattagatgatgt

SEQ ID NO: 44623 - DNA, 21 bp, Artificial sequence
  SiRNA target sequence
aatagtttattagatgatgtg

SEQ ID NO: 44624 - DNA, 21 bp, Artificial sequence
  SiRNA target sequence
atagtttattagatgatgtga

SEQ ID NO: 44625 - DNA, 21 bp, Artificial sequence
  SiRNA target sequence
tagtttattagatgatgtgac

SEQ ID NO: 44626 - DNA, 21 bp, Artificial sequence
  SiRNA target sequence
agtttattagatgatgtgacg

SEQ ID NO: 44627 - DNA, 21 bp, Artificial sequence
  SiRNA target sequence
gtttattagatgatgtgacgg

SEQ ID NO: 44628 - DNA, 21 bp, Artificial sequence
  SiRNA target sequence
tttattagatgatgtgacgga

SEQ ID NO: 44629 - DNA, 21 bp, Artificial sequence
  SiRNA target sequence
ttattagatgatgtgacggag

SEQ ID NO: 44630 - DNA, 21 bp, Artificial sequence
  SiRNA target sequence
tattagatgatgtgacggaga

SEQ ID NO: 44631 - DNA, 21 bp, Artificial sequence
  SiRNA target sequence
attagatgatgtgacggagat

SEQ ID NO: 44632 - DNA, 21 bp, Artificial sequence
  SiRNA target sequence
ttagatgatgtgacggagatg

SEQ ID NO: 44633 - DNA, 21 bp, Artificial sequence
  SiRNA target sequence
tagatgatgtgacggagatgc

SEQ ID NO: 44634 - DNA, 21 bp, Artificial sequence
  SiRNA target sequence
agatgatgtgacggagatgcg

SEQ ID NO: 44635 - DNA, 21 bp, Artificial sequence
  SiRNA target sequence
gatgatgtgacggagatgcgt

SEQ ID NO: 44636 - DNA, 21 bp, Artificial sequence
  SiRNA target sequence
atgatgtgacggagatgcgta

SEQ ID NO: 44637 - DNA, 21 bp, Artificial sequence
  SiRNA target sequence
tgatgtgacggagatgcgtaa

SEQ ID NO: 44638 - DNA, 21 bp, Artificial sequence
  SiRNA target sequence
gatgtgacggagatgcgtaac

SEQ ID NO: 44639 - DNA, 21 bp, Artificial sequence
  SiRNA target sequence
atgtgacggagatgcgtaact

SEQ ID NO: 44640 - DNA, 21 bp, Artificial sequence
  SiRNA target sequence
tgtgacggagatgcgtaactt

SEQ ID NO: 44641 - DNA, 21 bp, Artificial sequence
  SiRNA target sequence
gtgacggagatgcgtaacttt

SEQ ID NO: 44642 - DNA, 21 bp, Artificial sequence
  SiRNA target sequence
tgacggagatgcgtaactttt

SEQ ID NO: 44643 - DNA, 21 bp, Artificial sequence
  SiRNA target sequence
gacggagatgcgtaacttttc

SEQ ID NO: 44644 - DNA, 21 bp, Artificial sequence
  SiRNA target sequence
acggagatgcgtaacttttcc

SEQ ID NO: 44645 - DNA, 21 bp, Artificial sequence
  SiRNA target sequence
cggagatgcgtaacttttcca

SEQ ID NO: 44646 - DNA, 21 bp, Artificial sequence
  SiRNA target sequence
ggagatgcgtaacttttccaa

SEQ ID NO: 44647 - DNA, 21 bp, Artificial sequence
  SiRNA target sequence
gagatgcgtaacttttccaag

SEQ ID NO: 44648 - DNA, 21 bp, Artificial sequence
  SiRNA target sequence
agatgcgtaacttttccaaga

SEQ ID NO: 44649 - DNA, 21 bp, Artificial sequence
  SiRNA target sequence
gatgcgtaacttttccaagaa

SEQ ID NO: 44650 - DNA, 21 bp, Artificial sequence
  SiRNA target sequence
atgcgtaacttttccaagaat

SEQ ID NO: 44651 - DNA, 21 bp, Artificial sequence
  SiRNA target sequence
tgcgtaacttttccaagaata

SEQ ID NO: 44652 - DNA, 21 bp, Artificial sequence
  SiRNA target sequence
gcgtaacttttccaagaatat

SEQ ID NO: 44653 - DNA, 21 bp, Artificial sequence
  SiRNA target sequence
cgtaacttttccaagaatatc

SEQ ID NO: 44654 - DNA, 21 bp, Artificial sequence
  SiRNA target sequence
gtaacttttccaagaatatct

SEQ ID NO: 44655 - DNA, 21 bp, Artificial sequence
  SiRNA target sequence
taacttttccaagaatatcta

SEQ ID NO: 44656 - DNA, 21 bp, Artificial sequence
  SiRNA target sequence
aacttttccaagaatatctac

SEQ ID NO: 44657 - DNA, 21 bp, Artificial sequence
  SiRNA target sequence
acttttccaagaatatctaca

SEQ ID NO: 44658 - DNA, 21 bp, Artificial sequence
  SiRNA target sequence
cttttccaagaatatctacat

SEQ ID NO: 44659 - DNA, 21 bp, Artificial sequence
  SiRNA target sequence
ttttccaagaatatctacatg

SEQ ID NO: 44660 - DNA, 21 bp, Artificial sequence
  SiRNA target sequence
tttccaagaatatctacatga

SEQ ID NO: 44661 - DNA, 21 bp, Artificial sequence
  SiRNA target sequence
ttccaagaatatctacatgag

SEQ ID NO: 44662 - DNA, 21 bp, Artificial sequence
  SiRNA target sequence
tccaagaatatctacatgaga

SEQ ID NO: 44663 - DNA, 21 bp, Artificial sequence
  SiRNA target sequence
ccaagaatatctacatgagaa

SEQ ID NO: 44664 - DNA, 21 bp, Artificial sequence
  SiRNA target sequence
caagaatatctacatgagaaa

SEQ ID NO: 44665 - DNA, 21 bp, Artificial sequence
  SiRNA target sequence
aagaatatctacatgagaaat

SEQ ID NO: 44666 - DNA, 21 bp, Artificial sequence
  SiRNA target sequence
agaatatctacatgagaaatg

SEQ ID NO: 44667 - DNA, 21 bp, Artificial sequence
  SiRNA target sequence
gaatatctacatgagaaatgt

SEQ ID NO: 44668 - DNA, 21 bp, Artificial sequence
  SiRNA target sequence
aatatctacatgagaaatgta

SEQ ID NO: 44669 - DNA, 21 bp, Artificial sequence
  SiRNA target sequence
atatctacatgagaaatgtag

SEQ ID NO: 44670 - DNA, 21 bp, Artificial sequence
  SiRNA target sequence
tatctacatgagaaatgtaga

SEQ ID NO: 44671 - DNA, 21 bp, Artificial sequence
  SiRNA target sequence
atctacatgagaaatgtagaa

SEQ ID NO: 44672 - DNA, 21 bp, Artificial sequence
  SiRNA target sequence
tctacatgagaaatgtagaac

SEQ ID NO: 44673 - DNA, 21 bp, Artificial sequence
  SiRNA target sequence
ctacatgagaaatgtagaaca

SEQ ID NO: 44674 - DNA, 21 bp, Artificial sequence
  SiRNA target sequence
tacatgagaaatgtagaacag

SEQ ID NO: 44675 - DNA, 21 bp, Artificial sequence
  SiRNA target sequence
acatgagaaatgtagaacagg

SEQ ID NO: 44676 - DNA, 21 bp, Artificial sequence
  SiRNA target sequence
catgagaaatgtagaacagga

SEQ ID NO: 44677 - DNA, 21 bp, Artificial sequence
  SiRNA target sequence
atgagaaatgtagaacaggaa

SEQ ID NO: 44678 - DNA, 21 bp, Artificial sequence
  SiRNA target sequence
tgagaaatgtagaacaggaat

SEQ ID NO: 44679 - DNA, 21 bp, Artificial sequence
  SiRNA target sequence
gagaaatgtagaacaggaatt

SEQ ID NO: 44680 - DNA, 21 bp, Artificial sequence
  SiRNA target sequence
agaaatgtagaacaggaattt

SEQ ID NO: 44681 - DNA, 21 bp, Artificial sequence
  SiRNA target sequence
gaaatgtagaacaggaatttt

SEQ ID NO: 44682 - DNA, 21 bp, Artificial sequence
  SiRNA target sequence
aaatgtagaacaggaattttg

SEQ ID NO: 44683 - DNA, 21 bp, Artificial sequence
  SiRNA target sequence
aatgtagaacaggaattttgg

SEQ ID NO: 44684 - DNA, 21 bp, Artificial sequence
  SiRNA target sequence
atgtagaacaggaattttggg

SEQ ID NO: 44685 - DNA, 21 bp, Artificial sequence
  SiRNA target sequence
tgtagaacaggaattttggga

SEQ ID NO: 44686 - DNA, 21 bp, Artificial sequence
  SiRNA target sequence
gtagaacaggaattttgggat

SEQ ID NO: 44687 - DNA, 21 bp, Artificial sequence
  SiRNA target sequence
tagaacaggaattttgggata

SEQ ID NO: 44688 - DNA, 21 bp, Artificial sequence
  SiRNA target sequence
agaacaggaattttgggataa

SEQ ID NO: 44689 - DNA, 21 bp, Artificial sequence
  SiRNA target sequence
gaacaggaattttgggataat

SEQ ID NO: 44690 - DNA, 21 bp, Artificial sequence
  SiRNA target sequence
aacaggaattttgggataatt

SEQ ID NO: 44691 - DNA, 21 bp, Artificial sequence
  SiRNA target sequence
acaggaattttgggataatta

SEQ ID NO: 44692 - DNA, 21 bp, Artificial sequence
  SiRNA target sequence
caggaattttgggataattat

SEQ ID NO: 44693 - DNA, 21 bp, Artificial sequence
  SiRNA target sequence
aggaattttgggataattatc

SEQ ID NO: 44694 - DNA, 21 bp, Artificial sequence
  SiRNA target sequence
ggaattttgggataattatca

SEQ ID NO: 44695 - DNA, 21 bp, Artificial sequence
  SiRNA target sequence
gaattttgggataattatcaa

SEQ ID NO: 44696 - DNA, 21 bp, Artificial sequence
  SiRNA target sequence
aattttgggataattatcaag

SEQ ID NO: 44697 - DNA, 21 bp, Artificial sequence
  SiRNA target sequence
attttgggataattatcaagg

SEQ ID NO: 44698 - DNA, 21 bp, Artificial sequence
  SiRNA target sequence
ttttgggataattatcaagga

SEQ ID NO: 44699 - DNA, 21 bp, Artificial sequence
  SiRNA target sequence
tttgggataattatcaaggac

SEQ ID NO: 44700 - DNA, 21 bp, Artificial sequence
  SiRNA target sequence
ttgggataattatcaaggaca

SEQ ID NO: 44701 - DNA, 21 bp, Artificial sequence
  SiRNA target sequence
tgggataattatcaaggacaa

SEQ ID NO: 44702 - DNA, 21 bp, Artificial sequence
  SiRNA target sequence
gggataattatcaaggacaaa

SEQ ID NO: 44703 - DNA, 21 bp, Artificial sequence
  SiRNA target sequence
ggataattatcaaggacaaaa

SEQ ID NO: 44704 - DNA, 21 bp, Artificial sequence
  SiRNA target sequence
gataattatcaaggacaaaat

SEQ ID NO: 44705 - DNA, 21 bp, Artificial sequence
  SiRNA target sequence
ataattatcaaggacaaaata

SEQ ID NO: 44706 - DNA, 21 bp, Artificial sequence
  SiRNA target sequence
taattatcaaggacaaaatat

SEQ ID NO: 44707 - DNA, 21 bp, Artificial sequence
  SiRNA target sequence
aattatcaaggacaaaatatc

SEQ ID NO: 44708 - DNA, 21 bp, Artificial sequence
  SiRNA target sequence
attatcaaggacaaaatatcg

SEQ ID NO: 44709 - DNA, 21 bp, Artificial sequence
  SiRNA target sequence
ttatcaaggacaaaatatcgt

SEQ ID NO: 44710 - DNA, 21 bp, Artificial sequence
  SiRNA target sequence
tatcaaggacaaaatatcgta

SEQ ID NO: 44711 - DNA, 21 bp, Artificial sequence
  SiRNA target sequence
atcaaggacaaaatatcgtag

SEQ ID NO: 44712 - DNA, 21 bp, Artificial sequence
  SiRNA target sequence
tcaaggacaaaatatcgtagt

SEQ ID NO: 44713 - DNA, 21 bp, Artificial sequence
  SiRNA target sequence
caaggacaaaatatcgtagtt

SEQ ID NO: 44714 - DNA, 21 bp, Artificial sequence
  SiRNA target sequence
aaggacaaaatatcgtagttt

SEQ ID NO: 44715 - DNA, 21 bp, Artificial sequence
  SiRNA target sequence
aggacaaaatatcgtagttta

SEQ ID NO: 44716 - DNA, 21 bp, Artificial sequence
  SiRNA target sequence
ggacaaaatatcgtagtttac

SEQ ID NO: 44717 - DNA, 21 bp, Artificial sequence
  SiRNA target sequence
gacaaaatatcgtagtttacg

SEQ ID NO: 44718 - DNA, 21 bp, Artificial sequence
  SiRNA target sequence
acaaaatatcgtagtttacga

SEQ ID NO: 44719 - DNA, 21 bp, Artificial sequence
  SiRNA target sequence
caaaatatcgtagtttacgat

SEQ ID NO: 44720 - DNA, 21 bp, Artificial sequence
  SiRNA target sequence
aaaatatcgtagtttacgatg

SEQ ID NO: 44721 - DNA, 21 bp, Artificial sequence
  SiRNA target sequence
aaatatcgtagtttacgatga

SEQ ID NO: 44722 - DNA, 21 bp, Artificial sequence
  SiRNA target sequence
aatatcgtagtttacgatgat

SEQ ID NO: 44723 - DNA, 21 bp, Artificial sequence
  SiRNA target sequence
atatcgtagtttacgatgatt

SEQ ID NO: 44724 - DNA, 21 bp, Artificial sequence
  SiRNA target sequence
tatcgtagtttacgatgattt

SEQ ID NO: 44725 - DNA, 21 bp, Artificial sequence
  SiRNA target sequence
atcgtagtttacgatgatttt

SEQ ID NO: 44726 - DNA, 21 bp, Artificial sequence
  SiRNA target sequence
tcgtagtttacgatgattttg

SEQ ID NO: 44727 - DNA, 21 bp, Artificial sequence
  SiRNA target sequence
cgtagtttacgatgattttgg

SEQ ID NO: 44728 - DNA, 21 bp, Artificial sequence
  SiRNA target sequence
gtagtttacgatgattttgga

SEQ ID NO: 44729 - DNA, 21 bp, Artificial sequence
  SiRNA target sequence
tagtttacgatgattttggac

SEQ ID NO: 44730 - DNA, 21 bp, Artificial sequence
  SiRNA target sequence
agtttacgatgattttggaca

SEQ ID NO: 44731 - DNA, 21 bp, Artificial sequence
  SiRNA target sequence
gtttacgatgattttggacaa

SEQ ID NO: 44732 - DNA, 21 bp, Artificial sequence
  SiRNA target sequence
tttacgatgattttggacaaa

SEQ ID NO: 44733 - DNA, 21 bp, Artificial sequence
  SiRNA target sequence
ttacgatgattttggacaaat

SEQ ID NO: 44734 - DNA, 21 bp, Artificial sequence
  SiRNA target sequence
tacgatgattttggacaaatg

SEQ ID NO: 44735 - DNA, 21 bp, Artificial sequence
  SiRNA target sequence
acgatgattttggacaaatga

SEQ ID NO: 44736 - DNA, 21 bp, Artificial sequence
  SiRNA target sequence
cgatgattttggacaaatgag

SEQ ID NO: 44737 - DNA, 21 bp, Artificial sequence
  SiRNA target sequence
gatgattttggacaaatgaga

SEQ ID NO: 44738 - DNA, 21 bp, Artificial sequence
  SiRNA target sequence
atgattttggacaaatgagag

SEQ ID NO: 44739 - DNA, 21 bp, Artificial sequence
  SiRNA target sequence
tgattttggacaaatgagaga

SEQ ID NO: 44740 - DNA, 21 bp, Artificial sequence
  SiRNA target sequence
gattttggacaaatgagagat

SEQ ID NO: 44741 - DNA, 21 bp, Artificial sequence
  SiRNA target sequence
attttggacaaatgagagatt

SEQ ID NO: 44742 - DNA, 21 bp, Artificial sequence
  SiRNA target sequence
ttttggacaaatgagagattc

SEQ ID NO: 44743 - DNA, 21 bp, Artificial sequence
  SiRNA target sequence
tttggacaaatgagagattca

SEQ ID NO: 44744 - DNA, 21 bp, Artificial sequence
  SiRNA target sequence
ttggacaaatgagagattcaa

SEQ ID NO: 44745 - DNA, 21 bp, Artificial sequence
  SiRNA target sequence
tggacaaatgagagattcaac

SEQ ID NO: 44746 - DNA, 21 bp, Artificial sequence
  SiRNA target sequence
ggacaaatgagagattcaaca

SEQ ID NO: 44747 - DNA, 21 bp, Artificial sequence
  SiRNA target sequence
gacaaatgagagattcaacag

SEQ ID NO: 44748 - DNA, 21 bp, Artificial sequence
  SiRNA target sequence
acaaatgagagattcaacagc

SEQ ID NO: 44749 - DNA, 21 bp, Artificial sequence
  SiRNA target sequence
caaatgagagattcaacagct

SEQ ID NO: 44750 - DNA, 21 bp, Artificial sequence
  SiRNA target sequence
aaatgagagattcaacagcta

SEQ ID NO: 44751 - DNA, 21 bp, Artificial sequence
  SiRNA target sequence
aatgagagattcaacagctaa

SEQ ID NO: 44752 - DNA, 21 bp, Artificial sequence
  SiRNA target sequence
atgagagattcaacagctaac

SEQ ID NO: 44753 - DNA, 21 bp, Artificial sequence
  SiRNA target sequence
tgagagattcaacagctaacc

SEQ ID NO: 44754 - DNA, 21 bp, Artificial sequence
  SiRNA target sequence
gagagattcaacagctaaccc

SEQ ID NO: 44755 - DNA, 21 bp, Artificial sequence
  SiRNA target sequence
agagattcaacagctaaccca

SEQ ID NO: 44756 - DNA, 21 bp, Artificial sequence
  SiRNA target sequence
gagattcaacagctaacccaa

SEQ ID NO: 44757 - DNA, 21 bp, Artificial sequence
  SiRNA target sequence
agattcaacagctaacccaaa

SEQ ID NO: 44758 - DNA, 21 bp, Artificial sequence
  SiRNA target sequence
gattcaacagctaacccaaac

SEQ ID NO: 44759 - DNA, 21 bp, Artificial sequence
  SiRNA target sequence
attcaacagctaacccaaacc

SEQ ID NO: 44760 - DNA, 21 bp, Artificial sequence
  SiRNA target sequence
ttcaacagctaacccaaaccc

SEQ ID NO: 44761 - DNA, 21 bp, Artificial sequence
  SiRNA target sequence
tcaacagctaacccaaaccca

SEQ ID NO: 44762 - DNA, 21 bp, Artificial sequence
  SiRNA target sequence
caacagctaacccaaacccag

SEQ ID NO: 44763 - DNA, 21 bp, Artificial sequence
  SiRNA target sequence
aacagctaacccaaacccaga

SEQ ID NO: 44764 - DNA, 21 bp, Artificial sequence
  SiRNA target sequence
acagctaacccaaacccagaa

SEQ ID NO: 44765 - DNA, 21 bp, Artificial sequence
  SiRNA target sequence
cagctaacccaaacccagaat

SEQ ID NO: 44766 - DNA, 21 bp, Artificial sequence
  SiRNA target sequence
agctaacccaaacccagaatt

SEQ ID NO: 44767 - DNA, 21 bp, Artificial sequence
  SiRNA target sequence
gctaacccaaacccagaattc

SEQ ID NO: 44768 - DNA, 21 bp, Artificial sequence
  SiRNA target sequence
ctaacccaaacccagaattca

SEQ ID NO: 44769 - DNA, 21 bp, Artificial sequence
  SiRNA target sequence
taacccaaacccagaattcat

SEQ ID NO: 44770 - DNA, 21 bp, Artificial sequence
  SiRNA target sequence
aacccaaacccagaattcatg

SEQ ID NO: 44771 - DNA, 21 bp, Artificial sequence
  SiRNA target sequence
acccaaacccagaattcatgg

SEQ ID NO: 44772 - DNA, 21 bp, Artificial sequence
  SiRNA target sequence
cccaaacccagaattcatgga

SEQ ID NO: 44773 - DNA, 21 bp, Artificial sequence
  SiRNA target sequence
ccaaacccagaattcatggaa

SEQ ID NO: 44774 - DNA, 21 bp, Artificial sequence
  SiRNA target sequence
caaacccagaattcatggaat

SEQ ID NO: 44775 - DNA, 21 bp, Artificial sequence
  SiRNA target sequence
aaacccagaattcatggaatt

SEQ ID NO: 44776 - DNA, 21 bp, Artificial sequence
  SiRNA target sequence
aacccagaattcatggaattg

SEQ ID NO: 44777 - DNA, 21 bp, Artificial sequence
  SiRNA target sequence
acccagaattcatggaattga

SEQ ID NO: 44778 - DNA, 21 bp, Artificial sequence
  SiRNA target sequence
cccagaattcatggaattgat

SEQ ID NO: 44779 - DNA, 21 bp, Artificial sequence
  SiRNA target sequence
ccagaattcatggaattgata

SEQ ID NO: 44780 - DNA, 21 bp, Artificial sequence
  SiRNA target sequence
cagaattcatggaattgatac

SEQ ID NO: 44781 - DNA, 21 bp, Artificial sequence
  SiRNA target sequence
agaattcatggaattgatacg

SEQ ID NO: 44782 - DNA, 21 bp, Artificial sequence
  SiRNA target sequence
gaattcatggaattgatacgt

SEQ ID NO: 44783 - DNA, 21 bp, Artificial sequence
  SiRNA target sequence
aattcatggaattgatacgta

SEQ ID NO: 44784 - DNA, 21 bp, Artificial sequence
  SiRNA target sequence
attcatggaattgatacgtac

SEQ ID NO: 44785 - DNA, 21 bp, Artificial sequence
  SiRNA target sequence
ttcatggaattgatacgtact

SEQ ID NO: 44786 - DNA, 21 bp, Artificial sequence
  SiRNA target sequence
tcatggaattgatacgtactg

SEQ ID NO: 44787 - DNA, 21 bp, Artificial sequence
  SiRNA target sequence
catggaattgatacgtactgc

SEQ ID NO: 44788 - DNA, 21 bp, Artificial sequence
  SiRNA target sequence
atggaattgatacgtactgcc

SEQ ID NO: 44789 - DNA, 21 bp, Artificial sequence
  SiRNA target sequence
tggaattgatacgtactgcca

SEQ ID NO: 44790 - DNA, 21 bp, Artificial sequence
  SiRNA target sequence
ggaattgatacgtactgccaa

SEQ ID NO: 44791 - DNA, 21 bp, Artificial sequence
  SiRNA target sequence
gaattgatacgtactgccaat

SEQ ID NO: 44792 - DNA, 21 bp, Artificial sequence
  SiRNA target sequence
aattgatacgtactgccaata

SEQ ID NO: 44793 - DNA, 21 bp, Artificial sequence
  SiRNA target sequence
attgatacgtactgccaatat

SEQ ID NO: 44794 - DNA, 21 bp, Artificial sequence
  SiRNA target sequence
ttgatacgtactgccaatatc

SEQ ID NO: 44795 - DNA, 21 bp, Artificial sequence
  SiRNA target sequence
tgatacgtactgccaatatcg

SEQ ID NO: 44796 - DNA, 21 bp, Artificial sequence
  SiRNA target sequence
gatacgtactgccaatatcgc

SEQ ID NO: 44797 - DNA, 21 bp, Artificial sequence
  SiRNA target sequence
atacgtactgccaatatcgcc

SEQ ID NO: 44798 - DNA, 21 bp, Artificial sequence
  SiRNA target sequence
tacgtactgccaatatcgccc

SEQ ID NO: 44799 - DNA, 21 bp, Artificial sequence
  SiRNA target sequence
acgtactgccaatatcgcccc

SEQ ID NO: 44800 - DNA, 21 bp, Artificial sequence
  SiRNA target sequence
cgtactgccaatatcgccccc

SEQ ID NO: 44801 - DNA, 21 bp, Artificial sequence
  SiRNA target sequence
gtactgccaatatcgccccct

SEQ ID NO: 44802 - DNA, 21 bp, Artificial sequence
  SiRNA target sequence
tactgccaatatcgcccccta

SEQ ID NO: 44803 - DNA, 21 bp, Artificial sequence
  SiRNA target sequence
actgccaatatcgccccctat

SEQ ID NO: 44804 - DNA, 21 bp, Artificial sequence
  SiRNA target sequence
ctgccaatatcgccccctatc

SEQ ID NO: 44805 - DNA, 21 bp, Artificial sequence
  SiRNA target sequence
tgccaatatcgccccctatcc

SEQ ID NO: 44806 - DNA, 21 bp, Artificial sequence
  SiRNA target sequence
gccaatatcgccccctatcct

SEQ ID NO: 44807 - DNA, 21 bp, Artificial sequence
  SiRNA target sequence
ccaatatcgccccctatcctc

SEQ ID NO: 44808 - DNA, 21 bp, Artificial sequence
  SiRNA target sequence
caatatcgccccctatcctct

SEQ ID NO: 44809 - DNA, 21 bp, Artificial sequence
  SiRNA target sequence
aatatcgccccctatcctcta

SEQ ID NO: 44810 - DNA, 21 bp, Artificial sequence
  SiRNA target sequence
atatcgccccctatcctctac

SEQ ID NO: 44811 - DNA, 21 bp, Artificial sequence
  SiRNA target sequence
tatcgccccctatcctctaca

SEQ ID NO: 44812 - DNA, 21 bp, Artificial sequence
  SiRNA target sequence
atcgccccctatcctctacac

SEQ ID NO: 44813 - DNA, 21 bp, Artificial sequence
  SiRNA target sequence
tcgccccctatcctctacaca

SEQ ID NO: 44814 - DNA, 21 bp, Artificial sequence
  SiRNA target sequence
cgccccctatcctctacacat

SEQ ID NO: 44815 - DNA, 21 bp, Artificial sequence
  SiRNA target sequence
gccccctatcctctacacatg

SEQ ID NO: 44816 - DNA, 21 bp, Artificial sequence
  SiRNA target sequence
ccccctatcctctacacatgg

SEQ ID NO: 44817 - DNA, 21 bp, Artificial sequence
  SiRNA target sequence
cccctatcctctacacatggc

SEQ ID NO: 44818 - DNA, 21 bp, Artificial sequence
  SiRNA target sequence
ccctatcctctacacatggcc

SEQ ID NO: 44819 - DNA, 21 bp, Artificial sequence
  SiRNA target sequence
cctatcctctacacatggccc

SEQ ID NO: 44820 - DNA, 21 bp, Artificial sequence
  SiRNA target sequence
ctatcctctacacatggccca

SEQ ID NO: 44821 - DNA, 21 bp, Artificial sequence
  SiRNA target sequence
tatcctctacacatggcccat

SEQ ID NO: 44822 - DNA, 21 bp, Artificial sequence
  SiRNA target sequence
atcctctacacatggcccatt

SEQ ID NO: 44823 - DNA, 21 bp, Artificial sequence
  SiRNA target sequence
tcctctacacatggcccattt

SEQ ID NO: 44824 - DNA, 21 bp, Artificial sequence
  SiRNA target sequence
cctctacacatggcccatttg

SEQ ID NO: 44825 - DNA, 21 bp, Artificial sequence
  SiRNA target sequence
ctctacacatggcccatttgg

SEQ ID NO: 44826 - DNA, 21 bp, Artificial sequence
  SiRNA target sequence
tctacacatggcccatttgga

SEQ ID NO: 44827 - DNA, 21 bp, Artificial sequence
  SiRNA target sequence
ctacacatggcccatttggaa

SEQ ID NO: 44828 - DNA, 21 bp, Artificial sequence
  SiRNA target sequence
tacacatggcccatttggaag

SEQ ID NO: 44829 - DNA, 21 bp, Artificial sequence
  SiRNA target sequence
acacatggcccatttggaaga

SEQ ID NO: 44830 - DNA, 21 bp, Artificial sequence
  SiRNA target sequence
cacatggcccatttggaagat

SEQ ID NO: 44831 - DNA, 21 bp, Artificial sequence
  SiRNA target sequence
acatggcccatttggaagata

SEQ ID NO: 44832 - DNA, 21 bp, Artificial sequence
  SiRNA target sequence
catggcccatttggaagataa

SEQ ID NO: 44833 - DNA, 21 bp, Artificial sequence
  SiRNA target sequence
atggcccatttggaagataag

SEQ ID NO: 44834 - DNA, 21 bp, Artificial sequence
  SiRNA target sequence
tggcccatttggaagataaga

SEQ ID NO: 44835 - DNA, 21 bp, Artificial sequence
  SiRNA target sequence
ggcccatttggaagataagag

SEQ ID NO: 44836 - DNA, 21 bp, Artificial sequence
  SiRNA target sequence
gcccatttggaagataagaga

SEQ ID NO: 44837 - DNA, 21 bp, Artificial sequence
  SiRNA target sequence
cccatttggaagataagagaa

SEQ ID NO: 44838 - DNA, 21 bp, Artificial sequence
  SiRNA target sequence
ccatttggaagataagagaaa

SEQ ID NO: 44839 - DNA, 21 bp, Artificial sequence
  SiRNA target sequence
catttggaagataagagaaag

SEQ ID NO: 44840 - DNA, 21 bp, Artificial sequence
  SiRNA target sequence
atttggaagataagagaaaga

SEQ ID NO: 44841 - DNA, 21 bp, Artificial sequence
  SiRNA target sequence
tttggaagataagagaaagac

SEQ ID NO: 44842 - DNA, 21 bp, Artificial sequence
  SiRNA target sequence
ttggaagataagagaaagacg

SEQ ID NO: 44843 - DNA, 21 bp, Artificial sequence
  SiRNA target sequence
tggaagataagagaaagacga

SEQ ID NO: 44844 - DNA, 21 bp, Artificial sequence
  SiRNA target sequence
ggaagataagagaaagacgaa

SEQ ID NO: 44845 - DNA, 21 bp, Artificial sequence
  SiRNA target sequence
gaagataagagaaagacgaag

SEQ ID NO: 44846 - DNA, 21 bp, Artificial sequence
  SiRNA target sequence
aagataagagaaagacgaagt

SEQ ID NO: 44847 - DNA, 21 bp, Artificial sequence
  SiRNA target sequence
agataagagaaagacgaagtt

SEQ ID NO: 44848 - DNA, 21 bp, Artificial sequence
  SiRNA target sequence
gataagagaaagacgaagttt

SEQ ID NO: 44849 - DNA, 21 bp, Artificial sequence
  SiRNA target sequence
ataagagaaagacgaagttta

SEQ ID NO: 44850 - DNA, 21 bp, Artificial sequence
  SiRNA target sequence
taagagaaagacgaagtttac

SEQ ID NO: 44851 - DNA, 21 bp, Artificial sequence
  SiRNA target sequence
aagagaaagacgaagtttacg

SEQ ID NO: 44852 - DNA, 21 bp, Artificial sequence
  SiRNA target sequence
agagaaagacgaagtttacgt

SEQ ID NO: 44853 - DNA, 21 bp, Artificial sequence
  SiRNA target sequence
gagaaagacgaagtttacgtc

SEQ ID NO: 44854 - DNA, 21 bp, Artificial sequence
  SiRNA target sequence
agaaagacgaagtttacgtcg

SEQ ID NO: 44855 - DNA, 21 bp, Artificial sequence
  SiRNA target sequence
gaaagacgaagtttacgtcga

SEQ ID NO: 44856 - DNA, 21 bp, Artificial sequence
  SiRNA target sequence
aaagacgaagtttacgtcgaa

SEQ ID NO: 44857 - DNA, 21 bp, Artificial sequence
  SiRNA target sequence
aagacgaagtttacgtcgaaa

SEQ ID NO: 44858 - DNA, 21 bp, Artificial sequence
  SiRNA target sequence
agacgaagtttacgtcgaaag

SEQ ID NO: 44859 - DNA, 21 bp, Artificial sequence
  SiRNA target sequence
gacgaagtttacgtcgaaagt

SEQ ID NO: 44860 - DNA, 21 bp, Artificial sequence
  SiRNA target sequence
acgaagtttacgtcgaaagtg

SEQ ID NO: 44861 - DNA, 21 bp, Artificial sequence
  SiRNA target sequence
cgaagtttacgtcgaaagtga

SEQ ID NO: 44862 - DNA, 21 bp, Artificial sequence
  SiRNA target sequence
gaagtttacgtcgaaagtgat

SEQ ID NO: 44863 - DNA, 21 bp, Artificial sequence
  SiRNA target sequence
aagtttacgtcgaaagtgata

SEQ ID NO: 44864 - DNA, 21 bp, Artificial sequence
  SiRNA target sequence
agtttacgtcgaaagtgataa

SEQ ID NO: 44865 - DNA, 21 bp, Artificial sequence
  SiRNA target sequence
gtttacgtcgaaagtgataat

SEQ ID NO: 44866 - DNA, 21 bp, Artificial sequence
  SiRNA target sequence
tttacgtcgaaagtgataatc

SEQ ID NO: 44867 - DNA, 21 bp, Artificial sequence
  SiRNA target sequence
ttacgtcgaaagtgataatca

SEQ ID NO: 44868 - DNA, 21 bp, Artificial sequence
  SiRNA target sequence
tacgtcgaaagtgataatcat

SEQ ID NO: 44869 - DNA, 21 bp, Artificial sequence
  SiRNA target sequence
acgtcgaaagtgataatcatg

SEQ ID NO: 44870 - DNA, 21 bp, Artificial sequence
  SiRNA target sequence
cgtcgaaagtgataatcatga

SEQ ID NO: 44871 - DNA, 21 bp, Artificial sequence
  SiRNA target sequence
gtcgaaagtgataatcatgac

SEQ ID NO: 44872 - DNA, 21 bp, Artificial sequence
  SiRNA target sequence
tcgaaagtgataatcatgaca

SEQ ID NO: 44873 - DNA, 21 bp, Artificial sequence
  SiRNA target sequence
cgaaagtgataatcatgacat

SEQ ID NO: 44874 - DNA, 21 bp, Artificial sequence
  SiRNA target sequence
gaaagtgataatcatgacatc

SEQ ID NO: 44875 - DNA, 21 bp, Artificial sequence
  SiRNA target sequence
aaagtgataatcatgacatcc

SEQ ID NO: 44876 - DNA, 21 bp, Artificial sequence
  SiRNA target sequence
aagtgataatcatgacatcca

SEQ ID NO: 44877 - DNA, 21 bp, Artificial sequence
  SiRNA target sequence
agtgataatcatgacatccaa

SEQ ID NO: 44878 - DNA, 21 bp, Artificial sequence
  SiRNA target sequence
gtgataatcatgacatccaat

SEQ ID NO: 44879 - DNA, 21 bp, Artificial sequence
  SiRNA target sequence
tgataatcatgacatccaatg

SEQ ID NO: 44880 - DNA, 21 bp, Artificial sequence
  SiRNA target sequence
gataatcatgacatccaatgt

SEQ ID NO: 44881 - DNA, 21 bp, Artificial sequence
  SiRNA target sequence
ataatcatgacatccaatgtt

SEQ ID NO: 44882 - DNA, 21 bp, Artificial sequence
  SiRNA target sequence
taatcatgacatccaatgttt

SEQ ID NO: 44883 - DNA, 21 bp, Artificial sequence
  SiRNA target sequence
aatcatgacatccaatgtttt

SEQ ID NO: 44884 - DNA, 21 bp, Artificial sequence
  SiRNA target sequence
atcatgacatccaatgttttt

SEQ ID NO: 44885 - DNA, 21 bp, Artificial sequence
  SiRNA target sequence
tcatgacatccaatgtttttg

SEQ ID NO: 44886 - DNA, 21 bp, Artificial sequence
  SiRNA target sequence
catgacatccaatgtttttga

SEQ ID NO: 44887 - DNA, 21 bp, Artificial sequence
  SiRNA target sequence
atgacatccaatgtttttgaa

SEQ ID NO: 44888 - DNA, 21 bp, Artificial sequence
  SiRNA target sequence
tgacatccaatgtttttgaac

SEQ ID NO: 44889 - DNA, 21 bp, Artificial sequence
  SiRNA target sequence
gacatccaatgtttttgaaca

SEQ ID NO: 44890 - DNA, 21 bp, Artificial sequence
  SiRNA target sequence
acatccaatgtttttgaacaa

SEQ ID NO: 44891 - DNA, 21 bp, Artificial sequence
  SiRNA target sequence
catccaatgtttttgaacaat

SEQ ID NO: 44892 - DNA, 21 bp, Artificial sequence
  SiRNA target sequence
atccaatgtttttgaacaatc

SEQ ID NO: 44893 - DNA, 21 bp, Artificial sequence
  SiRNA target sequence
tccaatgtttttgaacaatct

SEQ ID NO: 44894 - DNA, 21 bp, Artificial sequence
  SiRNA target sequence
ccaatgtttttgaacaatctg

SEQ ID NO: 44895 - DNA, 21 bp, Artificial sequence
  SiRNA target sequence
caatgtttttgaacaatctgt

SEQ ID NO: 44896 - DNA, 21 bp, Artificial sequence
  SiRNA target sequence
aatgtttttgaacaatctgta

SEQ ID NO: 44897 - DNA, 21 bp, Artificial sequence
  SiRNA target sequence
atgtttttgaacaatctgtaa

SEQ ID NO: 44898 - DNA, 21 bp, Artificial sequence
  SiRNA target sequence
tgtttttgaacaatctgtaaa

SEQ ID NO: 44899 - DNA, 21 bp, Artificial sequence
  SiRNA target sequence
gtttttgaacaatctgtaaat

SEQ ID NO: 44900 - DNA, 21 bp, Artificial sequence
  SiRNA target sequence
tttttgaacaatctgtaaatt

SEQ ID NO: 44901 - DNA, 21 bp, Artificial sequence
  SiRNA target sequence
ttttgaacaatctgtaaattc

SEQ ID NO: 44902 - DNA, 21 bp, Artificial sequence
  SiRNA target sequence
tttgaacaatctgtaaattcg

SEQ ID NO: 44903 - DNA, 21 bp, Artificial sequence
  SiRNA target sequence
ttgaacaatctgtaaattcgc

SEQ ID NO: 44904 - DNA, 21 bp, Artificial sequence
  SiRNA target sequence
tgaacaatctgtaaattcgct

SEQ ID NO: 44905 - DNA, 21 bp, Artificial sequence
  SiRNA target sequence
gaacaatctgtaaattcgctt

SEQ ID NO: 44906 - DNA, 21 bp, Artificial sequence
  SiRNA target sequence
aacaatctgtaaattcgctta

SEQ ID NO: 44907 - DNA, 21 bp, Artificial sequence
  SiRNA target sequence
acaatctgtaaattcgcttac

SEQ ID NO: 44908 - DNA, 21 bp, Artificial sequence
  SiRNA target sequence
caatctgtaaattcgcttact

SEQ ID NO: 44909 - DNA, 21 bp, Artificial sequence
  SiRNA target sequence
aatctgtaaattcgcttactt

SEQ ID NO: 44910 - DNA, 21 bp, Artificial sequence
  SiRNA target sequence
atctgtaaattcgcttacttt

SEQ ID NO: 44911 - DNA, 21 bp, Artificial sequence
  SiRNA target sequence
tctgtaaattcgcttactttt

SEQ ID NO: 44912 - DNA, 21 bp, Artificial sequence
  SiRNA target sequence
ctgtaaattcgcttacttttc

SEQ ID NO: 44913 - DNA, 21 bp, Artificial sequence
  SiRNA target sequence
tgtaaattcgcttacttttcc

SEQ ID NO: 44914 - DNA, 21 bp, Artificial sequence
  SiRNA target sequence
gtaaattcgcttacttttcct

SEQ ID NO: 44915 - DNA, 21 bp, Artificial sequence
  SiRNA target sequence
taaattcgcttacttttcctg

SEQ ID NO: 44916 - DNA, 21 bp, Artificial sequence
  SiRNA target sequence
aaattcgcttacttttcctga

SEQ ID NO: 44917 - DNA, 21 bp, Artificial sequence
  SiRNA target sequence
aattcgcttacttttcctgat

SEQ ID NO: 44918 - DNA, 21 bp, Artificial sequence
  SiRNA target sequence
attcgcttacttttcctgatg

SEQ ID NO: 44919 - DNA, 21 bp, Artificial sequence
  SiRNA target sequence
ttcgcttacttttcctgatgc

SEQ ID NO: 44920 - DNA, 21 bp, Artificial sequence
  SiRNA target sequence
tcgcttacttttcctgatgct

SEQ ID NO: 44921 - DNA, 21 bp, Artificial sequence
  SiRNA target sequence
cgcttacttttcctgatgctt

SEQ ID NO: 44922 - DNA, 21 bp, Artificial sequence
  SiRNA target sequence
gcttacttttcctgatgcttt

SEQ ID NO: 44923 - DNA, 21 bp, Artificial sequence
  SiRNA target sequence
cttacttttcctgatgctttc

SEQ ID NO: 44924 - DNA, 21 bp, Artificial sequence
  SiRNA target sequence
ttacttttcctgatgctttca

SEQ ID NO: 44925 - DNA, 21 bp, Artificial sequence
  SiRNA target sequence
tacttttcctgatgctttcag

SEQ ID NO: 44926 - DNA, 21 bp, Artificial sequence
  SiRNA target sequence
acttttcctgatgctttcaga

SEQ ID NO: 44927 - DNA, 21 bp, Artificial sequence
  SiRNA target sequence
cttttcctgatgctttcagac

SEQ ID NO: 44928 - DNA, 21 bp, Artificial sequence
  SiRNA target sequence
ttttcctgatgctttcagacg

SEQ ID NO: 44929 - DNA, 21 bp, Artificial sequence
  SiRNA target sequence
tttcctgatgctttcagacgc

SEQ ID NO: 44930 - DNA, 21 bp, Artificial sequence
  SiRNA target sequence
ttcctgatgctttcagacgca

SEQ ID NO: 44931 - DNA, 21 bp, Artificial sequence
  SiRNA target sequence
tcctgatgctttcagacgcag

SEQ ID NO: 44932 - DNA, 21 bp, Artificial sequence
  SiRNA target sequence
cctgatgctttcagacgcaga

SEQ ID NO: 44933 - DNA, 21 bp, Artificial sequence
  SiRNA target sequence
ctgatgctttcagacgcagag

SEQ ID NO: 44934 - DNA, 21 bp, Artificial sequence
  SiRNA target sequence
tgatgctttcagacgcagagt

SEQ ID NO: 44935 - DNA, 21 bp, Artificial sequence
  SiRNA target sequence
gatgctttcagacgcagagta

SEQ ID NO: 44936 - DNA, 21 bp, Artificial sequence
  SiRNA target sequence
atgctttcagacgcagagtag

SEQ ID NO: 44937 - DNA, 21 bp, Artificial sequence
  SiRNA target sequence
tgctttcagacgcagagtaga

SEQ ID NO: 44938 - DNA, 21 bp, Artificial sequence
  SiRNA target sequence
gctttcagacgcagagtagat

SEQ ID NO: 44939 - DNA, 21 bp, Artificial sequence
  SiRNA target sequence
ctttcagacgcagagtagatc

SEQ ID NO: 44940 - DNA, 21 bp, Artificial sequence
  SiRNA target sequence
tttcagacgcagagtagatct

SEQ ID NO: 44941 - DNA, 21 bp, Artificial sequence
  SiRNA target sequence
ttcagacgcagagtagatctg

SEQ ID NO: 44942 - DNA, 21 bp, Artificial sequence
  SiRNA target sequence
tcagacgcagagtagatctgt

SEQ ID NO: 44943 - DNA, 21 bp, Artificial sequence
  SiRNA target sequence
cagacgcagagtagatctgtg

SEQ ID NO: 44944 - DNA, 21 bp, Artificial sequence
  SiRNA target sequence
agacgcagagtagatctgtgt

SEQ ID NO: 44945 - DNA, 21 bp, Artificial sequence
  SiRNA target sequence
gacgcagagtagatctgtgtg

SEQ ID NO: 44946 - DNA, 21 bp, Artificial sequence
  SiRNA target sequence
acgcagagtagatctgtgtgc

SEQ ID NO: 44947 - DNA, 21 bp, Artificial sequence
  SiRNA target sequence
cgcagagtagatctgtgtgct

SEQ ID NO: 44948 - DNA, 21 bp, Artificial sequence
  SiRNA target sequence
gcagagtagatctgtgtgctg

SEQ ID NO: 44949 - DNA, 21 bp, Artificial sequence
  SiRNA target sequence
cagagtagatctgtgtgctga

SEQ ID NO: 44950 - DNA, 21 bp, Artificial sequence
  SiRNA target sequence
agagtagatctgtgtgctgaa

SEQ ID NO: 44951 - DNA, 21 bp, Artificial sequence
  SiRNA target sequence
gagtagatctgtgtgctgaag

SEQ ID NO: 44952 - DNA, 21 bp, Artificial sequence
  SiRNA target sequence
agtagatctgtgtgctgaagt

SEQ ID NO: 44953 - DNA, 21 bp, Artificial sequence
  SiRNA target sequence
gtagatctgtgtgctgaagtg

SEQ ID NO: 44954 - DNA, 21 bp, Artificial sequence
  SiRNA target sequence
tagatctgtgtgctgaagtgc

SEQ ID NO: 44955 - DNA, 21 bp, Artificial sequence
  SiRNA target sequence
agatctgtgtgctgaagtgcg

SEQ ID NO: 44956 - DNA, 21 bp, Artificial sequence
  SiRNA target sequence
gatctgtgtgctgaagtgcgc

SEQ ID NO: 44957 - DNA, 21 bp, Artificial sequence
  SiRNA target sequence
atctgtgtgctgaagtgcgca

SEQ ID NO: 44958 - DNA, 21 bp, Artificial sequence
  SiRNA target sequence
tctgtgtgctgaagtgcgcaa

SEQ ID NO: 44959 - DNA, 21 bp, Artificial sequence
  SiRNA target sequence
ctgtgtgctgaagtgcgcaat

SEQ ID NO: 44960 - DNA, 21 bp, Artificial sequence
  SiRNA target sequence
tgtgtgctgaagtgcgcaata

SEQ ID NO: 44961 - DNA, 21 bp, Artificial sequence
  SiRNA target sequence
gtgtgctgaagtgcgcaataa

SEQ ID NO: 44962 - DNA, 21 bp, Artificial sequence
  SiRNA target sequence
tgtgctgaagtgcgcaataag

SEQ ID NO: 44963 - DNA, 21 bp, Artificial sequence
  SiRNA target sequence
gtgctgaagtgcgcaataagg

SEQ ID NO: 44964 - DNA, 21 bp, Artificial sequence
  SiRNA target sequence
tgctgaagtgcgcaataagga

SEQ ID NO: 44965 - DNA, 21 bp, Artificial sequence
  SiRNA target sequence
gctgaagtgcgcaataaggaa

SEQ ID NO: 44966 - DNA, 21 bp, Artificial sequence
  SiRNA target sequence
ctgaagtgcgcaataaggaag

SEQ ID NO: 44967 - DNA, 21 bp, Artificial sequence
  SiRNA target sequence
tgaagtgcgcaataaggaaga

SEQ ID NO: 44968 - DNA, 21 bp, Artificial sequence
  SiRNA target sequence
gaagtgcgcaataaggaagaa

SEQ ID NO: 44969 - DNA, 21 bp, Artificial sequence
  SiRNA target sequence
aagtgcgcaataaggaagaat

SEQ ID NO: 44970 - DNA, 21 bp, Artificial sequence
  SiRNA target sequence
agtgcgcaataaggaagaata

SEQ ID NO: 44971 - DNA, 21 bp, Artificial sequence
  SiRNA target sequence
gtgcgcaataaggaagaatat

SEQ ID NO: 44972 - DNA, 21 bp, Artificial sequence
  SiRNA target sequence
tgcgcaataaggaagaatata

SEQ ID NO: 44973 - DNA, 21 bp, Artificial sequence
  SiRNA target sequence
gcgcaataaggaagaatatac

SEQ ID NO: 44974 - DNA, 21 bp, Artificial sequence
  SiRNA target sequence
cgcaataaggaagaatatacg

SEQ ID NO: 44975 - DNA, 21 bp, Artificial sequence
  SiRNA target sequence
gcaataaggaagaatatacga

SEQ ID NO: 44976 - DNA, 21 bp, Artificial sequence
  SiRNA target sequence
caataaggaagaatatacgaa

SEQ ID NO: 44977 - DNA, 21 bp, Artificial sequence
  SiRNA target sequence
aataaggaagaatatacgaag

SEQ ID NO: 44978 - DNA, 21 bp, Artificial sequence
  SiRNA target sequence
ataaggaagaatatacgaagg

SEQ ID NO: 44979 - DNA, 21 bp, Artificial sequence
  SiRNA target sequence
taaggaagaatatacgaagga

SEQ ID NO: 44980 - DNA, 21 bp, Artificial sequence
  SiRNA target sequence
aaggaagaatatacgaaggaa

SEQ ID NO: 44981 - DNA, 21 bp, Artificial sequence
  SiRNA target sequence
aggaagaatatacgaaggaag

SEQ ID NO: 44982 - DNA, 21 bp, Artificial sequence
  SiRNA target sequence
ggaagaatatacgaaggaagg

SEQ ID NO: 44983 - DNA, 21 bp, Artificial sequence
  SiRNA target sequence
gaagaatatacgaaggaaggt

SEQ ID NO: 44984 - DNA, 21 bp, Artificial sequence
  SiRNA target sequence
aagaatatacgaaggaaggtt

SEQ ID NO: 44985 - DNA, 21 bp, Artificial sequence
  SiRNA target sequence
agaatatacgaaggaaggtta

SEQ ID NO: 44986 - DNA, 21 bp, Artificial sequence
  SiRNA target sequence
gaatatacgaaggaaggttat

SEQ ID NO: 44987 - DNA, 21 bp, Artificial sequence
  SiRNA target sequence
aatatacgaaggaaggttatt

SEQ ID NO: 44988 - DNA, 21 bp, Artificial sequence
  SiRNA target sequence
atatacgaaggaaggttattc

SEQ ID NO: 44989 - DNA, 21 bp, Artificial sequence
  SiRNA target sequence
tatacgaaggaaggttattct

SEQ ID NO: 44990 - DNA, 21 bp, Artificial sequence
  SiRNA target sequence
atacgaaggaaggttattcta

SEQ ID NO: 44991 - DNA, 21 bp, Artificial sequence
  SiRNA target sequence
tacgaaggaaggttattctaa

SEQ ID NO: 44992 - DNA, 21 bp, Artificial sequence
  SiRNA target sequence
acgaaggaaggttattctaag

SEQ ID NO: 44993 - DNA, 21 bp, Artificial sequence
  SiRNA target sequence
cgaaggaaggttattctaagc

SEQ ID NO: 44994 - DNA, 21 bp, Artificial sequence
  SiRNA target sequence
gaaggaaggttattctaagca

SEQ ID NO: 44995 - DNA, 21 bp, Artificial sequence
  SiRNA target sequence
aaggaaggttattctaagcag

SEQ ID NO: 44996 - DNA, 21 bp, Artificial sequence
  SiRNA target sequence
aggaaggttattctaagcaga

SEQ ID NO: 44997 - DNA, 21 bp, Artificial sequence
  SiRNA target sequence
ggaaggttattctaagcagaa

SEQ ID NO: 44998 - DNA, 21 bp, Artificial sequence
  SiRNA target sequence
gaaggttattctaagcagaag

SEQ ID NO: 44999 - DNA, 21 bp, Artificial sequence
  SiRNA target sequence
aaggttattctaagcagaagg

SEQ ID NO: 45000 - DNA, 21 bp, Artificial sequence
  SiRNA target sequence
aggttattctaagcagaaggg

SEQ ID NO: 45001 - DNA, 21 bp, Artificial sequence
  SiRNA target sequence
ggttattctaagcagaaggga

SEQ ID NO: 45002 - DNA, 21 bp, Artificial sequence
  SiRNA target sequence
gttattctaagcagaagggat

SEQ ID NO: 45003 - DNA, 21 bp, Artificial sequence
  SiRNA target sequence
ttattctaagcagaagggatg

SEQ ID NO: 45004 - DNA, 21 bp, Artificial sequence
  SiRNA target sequence
tattctaagcagaagggatgc

SEQ ID NO: 45005 - DNA, 21 bp, Artificial sequence
  SiRNA target sequence
attctaagcagaagggatgca

SEQ ID NO: 45006 - DNA, 21 bp, Artificial sequence
  SiRNA target sequence
ttctaagcagaagggatgcat

SEQ ID NO: 45007 - DNA, 21 bp, Artificial sequence
  SiRNA target sequence
tctaagcagaagggatgcatg

SEQ ID NO: 45008 - DNA, 21 bp, Artificial sequence
  SiRNA target sequence
ctaagcagaagggatgcatgg

SEQ ID NO: 45009 - DNA, 21 bp, Artificial sequence
  SiRNA target sequence
taagcagaagggatgcatggt

SEQ ID NO: 45010 - DNA, 21 bp, Artificial sequence
  SiRNA target sequence
aagcagaagggatgcatggtt

SEQ ID NO: 45011 - DNA, 21 bp, Artificial sequence
  SiRNA target sequence
agcagaagggatgcatggtta

SEQ ID NO: 45012 - DNA, 21 bp, Artificial sequence
  SiRNA target sequence
gcagaagggatgcatggttaa

SEQ ID NO: 45013 - DNA, 21 bp, Artificial sequence
  SiRNA target sequence
cagaagggatgcatggttaag

SEQ ID NO: 45014 - DNA, 21 bp, Artificial sequence
  SiRNA target sequence
agaagggatgcatggttaagc

SEQ ID NO: 45015 - DNA, 21 bp, Artificial sequence
  SiRNA target sequence
gaagggatgcatggttaagcg

SEQ ID NO: 45016 - DNA, 21 bp, Artificial sequence
  SiRNA target sequence
aagggatgcatggttaagcga

SEQ ID NO: 45017 - DNA, 21 bp, Artificial sequence
  SiRNA target sequence
agggatgcatggttaagcgat

SEQ ID NO: 45018 - DNA, 21 bp, Artificial sequence
  SiRNA target sequence
gggatgcatggttaagcgatt

SEQ ID NO: 45019 - DNA, 21 bp, Artificial sequence
  SiRNA target sequence
ggatgcatggttaagcgatta

SEQ ID NO: 45020 - DNA, 21 bp, Artificial sequence
  SiRNA target sequence
gatgcatggttaagcgattag

SEQ ID NO: 45021 - DNA, 21 bp, Artificial sequence
  SiRNA target sequence
atgcatggttaagcgattaga

SEQ ID NO: 45022 - DNA, 21 bp, Artificial sequence
  SiRNA target sequence
tgcatggttaagcgattagat

SEQ ID NO: 45023 - DNA, 21 bp, Artificial sequence
  SiRNA target sequence
gcatggttaagcgattagatc

SEQ ID NO: 45024 - DNA, 21 bp, Artificial sequence
  SiRNA target sequence
catggttaagcgattagatcg

SEQ ID NO: 45025 - DNA, 21 bp, Artificial sequence
  SiRNA target sequence
atggttaagcgattagatcgt

SEQ ID NO: 45026 - DNA, 21 bp, Artificial sequence
  SiRNA target sequence
tggttaagcgattagatcgtg

SEQ ID NO: 45027 - DNA, 21 bp, Artificial sequence
  SiRNA target sequence
ggttaagcgattagatcgtga

SEQ ID NO: 45028 - DNA, 21 bp, Artificial sequence
  SiRNA target sequence
gttaagcgattagatcgtgaa

SEQ ID NO: 45029 - DNA, 21 bp, Artificial sequence
  SiRNA target sequence
ttaagcgattagatcgtgaaa

SEQ ID NO: 45030 - DNA, 21 bp, Artificial sequence
  SiRNA target sequence
taagcgattagatcgtgaaaa

SEQ ID NO: 45031 - DNA, 21 bp, Artificial sequence
  SiRNA target sequence
aagcgattagatcgtgaaaag

SEQ ID NO: 45032 - DNA, 21 bp, Artificial sequence
  SiRNA target sequence
agcgattagatcgtgaaaagg

SEQ ID NO: 45033 - DNA, 21 bp, Artificial sequence
  SiRNA target sequence
gcgattagatcgtgaaaaggt

SEQ ID NO: 45034 - DNA, 21 bp, Artificial sequence
  SiRNA target sequence
cgattagatcgtgaaaaggtg

SEQ ID NO: 45035 - DNA, 21 bp, Artificial sequence
  SiRNA target sequence
gattagatcgtgaaaaggtgc

SEQ ID NO: 45036 - DNA, 21 bp, Artificial sequence
  SiRNA target sequence
attagatcgtgaaaaggtgca

SEQ ID NO: 45037 - DNA, 21 bp, Artificial sequence
  SiRNA target sequence
ttagatcgtgaaaaggtgcag

SEQ ID NO: 45038 - DNA, 21 bp, Artificial sequence
  SiRNA target sequence
tagatcgtgaaaaggtgcaga

SEQ ID NO: 45039 - DNA, 21 bp, Artificial sequence
  SiRNA target sequence
agatcgtgaaaaggtgcagaa

SEQ ID NO: 45040 - DNA, 21 bp, Artificial sequence
  SiRNA target sequence
gatcgtgaaaaggtgcagaag

SEQ ID NO: 45041 - DNA, 21 bp, Artificial sequence
  SiRNA target sequence
atcgtgaaaaggtgcagaagt

SEQ ID NO: 45042 - DNA, 21 bp, Artificial sequence
  SiRNA target sequence
tcgtgaaaaggtgcagaagtt

SEQ ID NO: 45043 - DNA, 21 bp, Artificial sequence
  SiRNA target sequence
cgtgaaaaggtgcagaagttg

SEQ ID NO: 45044 - DNA, 21 bp, Artificial sequence
  SiRNA target sequence
gtgaaaaggtgcagaagttga

SEQ ID NO: 45045 - DNA, 21 bp, Artificial sequence
  SiRNA target sequence
tgaaaaggtgcagaagttgac

SEQ ID NO: 45046 - DNA, 21 bp, Artificial sequence
  SiRNA target sequence
gaaaaggtgcagaagttgaca

SEQ ID NO: 45047 - DNA, 21 bp, Artificial sequence
  SiRNA target sequence
aaaaggtgcagaagttgacag

SEQ ID NO: 45048 - DNA, 21 bp, Artificial sequence
  SiRNA target sequence
aaaggtgcagaagttgacagg

SEQ ID NO: 45049 - DNA, 21 bp, Artificial sequence
  SiRNA target sequence
aaggtgcagaagttgacagga

SEQ ID NO: 45050 - DNA, 21 bp, Artificial sequence
  SiRNA target sequence
aggtgcagaagttgacaggag

SEQ ID NO: 45051 - DNA, 21 bp, Artificial sequence
  SiRNA target sequence
ggtgcagaagttgacaggaga

SEQ ID NO: 45052 - DNA, 21 bp, Artificial sequence
  SiRNA target sequence
gtgcagaagttgacaggagat

SEQ ID NO: 45053 - DNA, 21 bp, Artificial sequence
  SiRNA target sequence
tgcagaagttgacaggagata

SEQ ID NO: 45054 - DNA, 21 bp, Artificial sequence
  SiRNA target sequence
gcagaagttgacaggagatat

SEQ ID NO: 45055 - DNA, 21 bp, Artificial sequence
  SiRNA target sequence
cagaagttgacaggagatatt

SEQ ID NO: 45056 - DNA, 21 bp, Artificial sequence
  SiRNA target sequence
agaagttgacaggagatattc

SEQ ID NO: 45057 - DNA, 21 bp, Artificial sequence
  SiRNA target sequence
gaagttgacaggagatattca

SEQ ID NO: 45058 - DNA, 21 bp, Artificial sequence
  SiRNA target sequence
aagttgacaggagatattcac

SEQ ID NO: 45059 - DNA, 21 bp, Artificial sequence
  SiRNA target sequence
agttgacaggagatattcact

SEQ ID NO: 45060 - DNA, 21 bp, Artificial sequence
  SiRNA target sequence
gttgacaggagatattcactc

SEQ ID NO: 45061 - DNA, 21 bp, Artificial sequence
  SiRNA target sequence
ttgacaggagatattcactca

SEQ ID NO: 45062 - DNA, 21 bp, Artificial sequence
  SiRNA target sequence
tgacaggagatattcactcaa

SEQ ID NO: 45063 - DNA, 21 bp, Artificial sequence
  SiRNA target sequence
gacaggagatattcactcaac

SEQ ID NO: 45064 - DNA, 21 bp, Artificial sequence
  SiRNA target sequence
acaggagatattcactcaacg

SEQ ID NO: 45065 - DNA, 21 bp, Artificial sequence
  SiRNA target sequence
caggagatattcactcaacga

SEQ ID NO: 45066 - DNA, 21 bp, Artificial sequence
  SiRNA target sequence
aggagatattcactcaacgaa

SEQ ID NO: 45067 - DNA, 21 bp, Artificial sequence
  SiRNA target sequence
ggagatattcactcaacgaaa

SEQ ID NO: 45068 - DNA, 21 bp, Artificial sequence
  SiRNA target sequence
gagatattcactcaacgaaac

SEQ ID NO: 45069 - DNA, 21 bp, Artificial sequence
  SiRNA target sequence
agatattcactcaacgaaacc

SEQ ID NO: 45070 - DNA, 21 bp, Artificial sequence
  SiRNA target sequence
gatattcactcaacgaaacca

SEQ ID NO: 45071 - DNA, 21 bp, Artificial sequence
  SiRNA target sequence
atattcactcaacgaaaccat

SEQ ID NO: 45072 - DNA, 21 bp, Artificial sequence
  SiRNA target sequence
tattcactcaacgaaaccata

SEQ ID NO: 45073 - DNA, 21 bp, Artificial sequence
  SiRNA target sequence
attcactcaacgaaaccatat

SEQ ID NO: 45074 - DNA, 21 bp, Artificial sequence
  SiRNA target sequence
ttcactcaacgaaaccatatt

SEQ ID NO: 45075 - DNA, 21 bp, Artificial sequence
  SiRNA target sequence
tcactcaacgaaaccatattt

SEQ ID NO: 45076 - DNA, 21 bp, Artificial sequence
  SiRNA target sequence
cactcaacgaaaccatatttg

SEQ ID NO: 45077 - DNA, 21 bp, Artificial sequence
  SiRNA target sequence
actcaacgaaaccatatttgg

SEQ ID NO: 45078 - DNA, 21 bp, Artificial sequence
  SiRNA target sequence
ctcaacgaaaccatatttggt

SEQ ID NO: 45079 - DNA, 21 bp, Artificial sequence
  SiRNA target sequence
tcaacgaaaccatatttggtt

SEQ ID NO: 45080 - DNA, 21 bp, Artificial sequence
  SiRNA target sequence
caacgaaaccatatttggttg

SEQ ID NO: 45081 - DNA, 21 bp, Artificial sequence
  SiRNA target sequence
aacgaaaccatatttggttga

SEQ ID NO: 45082 - DNA, 21 bp, Artificial sequence
  SiRNA target sequence
acgaaaccatatttggttgac

SEQ ID NO: 45083 - DNA, 21 bp, Artificial sequence
  SiRNA target sequence
cgaaaccatatttggttgact

SEQ ID NO: 45084 - DNA, 21 bp, Artificial sequence
  SiRNA target sequence
gaaaccatatttggttgactt

SEQ ID NO: 45085 - DNA, 21 bp, Artificial sequence
  SiRNA target sequence
aaaccatatttggttgactta

SEQ ID NO: 45086 - DNA, 21 bp, Artificial sequence
  SiRNA target sequence
aaccatatttggttgacttag

SEQ ID NO: 45087 - DNA, 21 bp, Artificial sequence
  SiRNA target sequence
accatatttggttgacttagt

SEQ ID NO: 45088 - DNA, 21 bp, Artificial sequence
  SiRNA target sequence
ccatatttggttgacttagtg

SEQ ID NO: 45089 - DNA, 21 bp, Artificial sequence
  SiRNA target sequence
catatttggttgacttagtga

SEQ ID NO: 45090 - DNA, 21 bp, Artificial sequence
  SiRNA target sequence
atatttggttgacttagtgaa

SEQ ID NO: 45091 - DNA, 21 bp, Artificial sequence
  SiRNA target sequence
tatttggttgacttagtgaat

SEQ ID NO: 45092 - DNA, 21 bp, Artificial sequence
  SiRNA target sequence
atttggttgacttagtgaatg

SEQ ID NO: 45093 - DNA, 21 bp, Artificial sequence
  SiRNA target sequence
tttggttgacttagtgaatgc

SEQ ID NO: 45094 - DNA, 21 bp, Artificial sequence
  SiRNA target sequence
ttggttgacttagtgaatgca

SEQ ID NO: 45095 - DNA, 21 bp, Artificial sequence
  SiRNA target sequence
tggttgacttagtgaatgcag

SEQ ID NO: 45096 - DNA, 21 bp, Artificial sequence
  SiRNA target sequence
ggttgacttagtgaatgcaga

SEQ ID NO: 45097 - DNA, 21 bp, Artificial sequence
  SiRNA target sequence
gttgacttagtgaatgcagag

SEQ ID NO: 45098 - DNA, 21 bp, Artificial sequence
  SiRNA target sequence
ttgacttagtgaatgcagaga

SEQ ID NO: 45099 - DNA, 21 bp, Artificial sequence
  SiRNA target sequence
tgacttagtgaatgcagagac

SEQ ID NO: 45100 - DNA, 21 bp, Artificial sequence
  SiRNA target sequence
gacttagtgaatgcagagacc

SEQ ID NO: 45101 - DNA, 21 bp, Artificial sequence
  SiRNA target sequence
acttagtgaatgcagagaccg

SEQ ID NO: 45102 - DNA, 21 bp, Artificial sequence
  SiRNA target sequence
cttagtgaatgcagagaccgg

SEQ ID NO: 45103 - DNA, 21 bp, Artificial sequence
  SiRNA target sequence
ttagtgaatgcagagaccgga

SEQ ID NO: 45104 - DNA, 21 bp, Artificial sequence
  SiRNA target sequence
tagtgaatgcagagaccggag

SEQ ID NO: 45105 - DNA, 21 bp, Artificial sequence
  SiRNA target sequence
agtgaatgcagagaccggaga

SEQ ID NO: 45106 - DNA, 21 bp, Artificial sequence
  SiRNA target sequence
gtgaatgcagagaccggagaa

SEQ ID NO: 45107 - DNA, 21 bp, Artificial sequence
  SiRNA target sequence
tgaatgcagagaccggagaaa

SEQ ID NO: 45108 - DNA, 21 bp, Artificial sequence
  SiRNA target sequence
gaatgcagagaccggagaaaa

SEQ ID NO: 45109 - DNA, 21 bp, Artificial sequence
  SiRNA target sequence
aatgcagagaccggagaaaaa

SEQ ID NO: 45110 - DNA, 21 bp, Artificial sequence
  SiRNA target sequence
atgcagagaccggagaaaaat

SEQ ID NO: 45111 - DNA, 21 bp, Artificial sequence
  SiRNA target sequence
tgcagagaccggagaaaaata

SEQ ID NO: 45112 - DNA, 21 bp, Artificial sequence
  SiRNA target sequence
gcagagaccggagaaaaatat

SEQ ID NO: 45113 - DNA, 21 bp, Artificial sequence
  SiRNA target sequence
cagagaccggagaaaaatata

SEQ ID NO: 45114 - DNA, 21 bp, Artificial sequence
  SiRNA target sequence
agagaccggagaaaaatataa

SEQ ID NO: 45115 - DNA, 21 bp, Artificial sequence
  SiRNA target sequence
gagaccggagaaaaatataag

SEQ ID NO: 45116 - DNA, 21 bp, Artificial sequence
  SiRNA target sequence
agaccggagaaaaatataaga

SEQ ID NO: 45117 - DNA, 21 bp, Artificial sequence
  SiRNA target sequence
gaccggagaaaaatataagac

SEQ ID NO: 45118 - DNA, 21 bp, Artificial sequence
  SiRNA target sequence
accggagaaaaatataagact

SEQ ID NO: 45119 - DNA, 21 bp, Artificial sequence
  SiRNA target sequence
ccggagaaaaatataagactg

SEQ ID NO: 45120 - DNA, 21 bp, Artificial sequence
  SiRNA target sequence
cggagaaaaatataagactga

SEQ ID NO: 45121 - DNA, 21 bp, Artificial sequence
  SiRNA target sequence
ggagaaaaatataagactgac

SEQ ID NO: 45122 - DNA, 21 bp, Artificial sequence
  SiRNA target sequence
gagaaaaatataagactgaca

SEQ ID NO: 45123 - DNA, 21 bp, Artificial sequence
  SiRNA target sequence
agaaaaatataagactgacat

SEQ ID NO: 45124 - DNA, 21 bp, Artificial sequence
  SiRNA target sequence
gaaaaatataagactgacatt

SEQ ID NO: 45125 - DNA, 21 bp, Artificial sequence
  SiRNA target sequence
aaaaatataagactgacattg

SEQ ID NO: 45126 - DNA, 21 bp, Artificial sequence
  SiRNA target sequence
aaaatataagactgacattga

SEQ ID NO: 45127 - DNA, 21 bp, Artificial sequence
  SiRNA target sequence
aaatataagactgacattgaa

SEQ ID NO: 45128 - DNA, 21 bp, Artificial sequence
  SiRNA target sequence
aatataagactgacattgaat

SEQ ID NO: 45129 - DNA, 21 bp, Artificial sequence
  SiRNA target sequence
atataagactgacattgaata

SEQ ID NO: 45130 - DNA, 21 bp, Artificial sequence
  SiRNA target sequence
tataagactgacattgaatat

SEQ ID NO: 45131 - DNA, 21 bp, Artificial sequence
  SiRNA target sequence
ataagactgacattgaatatg

SEQ ID NO: 45132 - DNA, 21 bp, Artificial sequence
  SiRNA target sequence
taagactgacattgaatatga

SEQ ID NO: 45133 - DNA, 21 bp, Artificial sequence
  SiRNA target sequence
aagactgacattgaatatgaa

SEQ ID NO: 45134 - DNA, 21 bp, Artificial sequence
  SiRNA target sequence
agactgacattgaatatgaag

SEQ ID NO: 45135 - DNA, 21 bp, Artificial sequence
  SiRNA target sequence
gactgacattgaatatgaaga

SEQ ID NO: 45136 - DNA, 21 bp, Artificial sequence
  SiRNA target sequence
actgacattgaatatgaagac

SEQ ID NO: 45137 - DNA, 21 bp, Artificial sequence
  SiRNA target sequence
ctgacattgaatatgaagact

SEQ ID NO: 45138 - DNA, 21 bp, Artificial sequence
  SiRNA target sequence
tgacattgaatatgaagactt

SEQ ID NO: 45139 - DNA, 21 bp, Artificial sequence
  SiRNA target sequence
gacattgaatatgaagacttt

SEQ ID NO: 45140 - DNA, 21 bp, Artificial sequence
  SiRNA target sequence
acattgaatatgaagactttt

SEQ ID NO: 45141 - DNA, 21 bp, Artificial sequence
  SiRNA target sequence
cattgaatatgaagacttttt

SEQ ID NO: 45142 - DNA, 21 bp, Artificial sequence
  SiRNA target sequence
attgaatatgaagacttttta

SEQ ID NO: 45143 - DNA, 21 bp, Artificial sequence
  SiRNA target sequence
ttgaatatgaagactttttag

SEQ ID NO: 45144 - DNA, 21 bp, Artificial sequence
  SiRNA target sequence
tgaatatgaagactttttaga

SEQ ID NO: 45145 - DNA, 21 bp, Artificial sequence
  SiRNA target sequence
gaatatgaagactttttagat

SEQ ID NO: 45146 - DNA, 21 bp, Artificial sequence
  SiRNA target sequence
aatatgaagactttttagata

SEQ ID NO: 45147 - DNA, 21 bp, Artificial sequence
  SiRNA target sequence
atatgaagactttttagatat

SEQ ID NO: 45148 - DNA, 21 bp, Artificial sequence
  SiRNA target sequence
tatgaagactttttagatatg

SEQ ID NO: 45149 - DNA, 21 bp, Artificial sequence
  SiRNA target sequence
atgaagactttttagatatgt

SEQ ID NO: 45150 - DNA, 21 bp, Artificial sequence
  SiRNA target sequence
tgaagactttttagatatgtg

SEQ ID NO: 45151 - DNA, 21 bp, Artificial sequence
  SiRNA target sequence
gaagactttttagatatgtgc

SEQ ID NO: 45152 - DNA, 21 bp, Artificial sequence
  SiRNA target sequence
aagactttttagatatgtgct

SEQ ID NO: 45153 - DNA, 21 bp, Artificial sequence
  SiRNA target sequence
agactttttagatatgtgctt

SEQ ID NO: 45154 - DNA, 21 bp, Artificial sequence
  SiRNA target sequence
gactttttagatatgtgcttg

SEQ ID NO: 45155 - DNA, 21 bp, Artificial sequence
  SiRNA target sequence
actttttagatatgtgcttgg

SEQ ID NO: 45156 - DNA, 21 bp, Artificial sequence
  SiRNA target sequence
ctttttagatatgtgcttgga

SEQ ID NO: 45157 - DNA, 21 bp, Artificial sequence
  SiRNA target sequence
tttttagatatgtgcttggag

SEQ ID NO: 45158 - DNA, 21 bp, Artificial sequence
  SiRNA target sequence
ttttagatatgtgcttggaga

SEQ ID NO: 45159 - DNA, 21 bp, Artificial sequence
  SiRNA target sequence
tttagatatgtgcttggagaa

SEQ ID NO: 45160 - DNA, 21 bp, Artificial sequence
  SiRNA target sequence
ttagatatgtgcttggagaaa

SEQ ID NO: 45161 - DNA, 21 bp, Artificial sequence
  SiRNA target sequence
tagatatgtgcttggagaaaa

SEQ ID NO: 45162 - DNA, 21 bp, Artificial sequence
  SiRNA target sequence
agatatgtgcttggagaaaac

SEQ ID NO: 45163 - DNA, 21 bp, Artificial sequence
  SiRNA target sequence
gatatgtgcttggagaaaacc

SEQ ID NO: 45164 - DNA, 21 bp, Artificial sequence
  SiRNA target sequence
atatgtgcttggagaaaacca

SEQ ID NO: 45165 - DNA, 21 bp, Artificial sequence
  SiRNA target sequence
tatgtgcttggagaaaaccaa

SEQ ID NO: 45166 - DNA, 21 bp, Artificial sequence
  SiRNA target sequence
atgtgcttggagaaaaccaag

SEQ ID NO: 45167 - DNA, 21 bp, Artificial sequence
  SiRNA target sequence
tgtgcttggagaaaaccaaga

SEQ ID NO: 45168 - DNA, 21 bp, Artificial sequence
  SiRNA target sequence
gtgcttggagaaaaccaagac

SEQ ID NO: 45169 - DNA, 21 bp, Artificial sequence
  SiRNA target sequence
tgcttggagaaaaccaagacg

SEQ ID NO: 45170 - DNA, 21 bp, Artificial sequence
  SiRNA target sequence
gcttggagaaaaccaagacgt

SEQ ID NO: 45171 - DNA, 21 bp, Artificial sequence
  SiRNA target sequence
cttggagaaaaccaagacgtg

SEQ ID NO: 45172 - DNA, 21 bp, Artificial sequence
  SiRNA target sequence
ttggagaaaaccaagacgtgt

SEQ ID NO: 45173 - DNA, 21 bp, Artificial sequence
  SiRNA target sequence
tggagaaaaccaagacgtgtc

SEQ ID NO: 45174 - DNA, 21 bp, Artificial sequence
  SiRNA target sequence
ggagaaaaccaagacgtgtcg

SEQ ID NO: 45175 - DNA, 21 bp, Artificial sequence
  SiRNA target sequence
gagaaaaccaagacgtgtcga

SEQ ID NO: 45176 - DNA, 21 bp, Artificial sequence
  SiRNA target sequence
agaaaaccaagacgtgtcgag

SEQ ID NO: 45177 - DNA, 21 bp, Artificial sequence
  SiRNA target sequence
gaaaaccaagacgtgtcgaga

SEQ ID NO: 45178 - DNA, 21 bp, Artificial sequence
  SiRNA target sequence
aaaaccaagacgtgtcgagat

SEQ ID NO: 45179 - DNA, 21 bp, Artificial sequence
  SiRNA target sequence
aaaccaagacgtgtcgagatg

SEQ ID NO: 45180 - DNA, 21 bp, Artificial sequence
  SiRNA target sequence
aaccaagacgtgtcgagatga

SEQ ID NO: 45181 - DNA, 21 bp, Artificial sequence
  SiRNA target sequence
accaagacgtgtcgagatgag

SEQ ID NO: 45182 - DNA, 21 bp, Artificial sequence
  SiRNA target sequence
ccaagacgtgtcgagatgagt

SEQ ID NO: 45183 - DNA, 21 bp, Artificial sequence
  SiRNA target sequence
caagacgtgtcgagatgagtc

SEQ ID NO: 45184 - DNA, 21 bp, Artificial sequence
  SiRNA target sequence
aagacgtgtcgagatgagtct

SEQ ID NO: 45185 - DNA, 21 bp, Artificial sequence
  SiRNA target sequence
agacgtgtcgagatgagtctg

SEQ ID NO: 45186 - DNA, 21 bp, Artificial sequence
  SiRNA target sequence
gacgtgtcgagatgagtctgc

SEQ ID NO: 45187 - DNA, 21 bp, Artificial sequence
  SiRNA target sequence
acgtgtcgagatgagtctgcc

SEQ ID NO: 45188 - DNA, 21 bp, Artificial sequence
  SiRNA target sequence
cgtgtcgagatgagtctgcca

SEQ ID NO: 45189 - DNA, 21 bp, Artificial sequence
  SiRNA target sequence
gtgtcgagatgagtctgccaa

SEQ ID NO: 45190 - DNA, 21 bp, Artificial sequence
  SiRNA target sequence
tgtcgagatgagtctgccaaa

SEQ ID NO: 45191 - DNA, 21 bp, Artificial sequence
  SiRNA target sequence
gtcgagatgagtctgccaaac

SEQ ID NO: 45192 - DNA, 21 bp, Artificial sequence
  SiRNA target sequence
tcgagatgagtctgccaaact

SEQ ID NO: 45193 - DNA, 21 bp, Artificial sequence
  SiRNA target sequence
cgagatgagtctgccaaactc

SEQ ID NO: 45194 - DNA, 21 bp, Artificial sequence
  SiRNA target sequence
gagatgagtctgccaaactca

SEQ ID NO: 45195 - DNA, 21 bp, Artificial sequence
  SiRNA target sequence
agatgagtctgccaaactcaa

SEQ ID NO: 45196 - DNA, 21 bp, Artificial sequence
  SiRNA target sequence
gatgagtctgccaaactcaat

SEQ ID NO: 45197 - DNA, 21 bp, Artificial sequence
  SiRNA target sequence
atgagtctgccaaactcaatg

SEQ ID NO: 45198 - DNA, 21 bp, Artificial sequence
  SiRNA target sequence
tgagtctgccaaactcaatga

SEQ ID NO: 45199 - DNA, 21 bp, Artificial sequence
  SiRNA target sequence
gagtctgccaaactcaatgaa

SEQ ID NO: 45200 - DNA, 21 bp, Artificial sequence
  SiRNA target sequence
agtctgccaaactcaatgaat

SEQ ID NO: 45201 - DNA, 21 bp, Artificial sequence
  SiRNA target sequence
gtctgccaaactcaatgaatt

SEQ ID NO: 45202 - DNA, 21 bp, Artificial sequence
  SiRNA target sequence
tctgccaaactcaatgaattt

SEQ ID NO: 45203 - DNA, 21 bp, Artificial sequence
  SiRNA target sequence
ctgccaaactcaatgaatttc

SEQ ID NO: 45204 - DNA, 21 bp, Artificial sequence
  SiRNA target sequence
tgccaaactcaatgaatttct

SEQ ID NO: 45205 - DNA, 21 bp, Artificial sequence
  SiRNA target sequence
gccaaactcaatgaatttctt

SEQ ID NO: 45206 - DNA, 21 bp, Artificial sequence
  SiRNA target sequence
ccaaactcaatgaatttctta

SEQ ID NO: 45207 - DNA, 21 bp, Artificial sequence
  SiRNA target sequence
caaactcaatgaatttcttat

SEQ ID NO: 45208 - DNA, 21 bp, Artificial sequence
  SiRNA target sequence
aaactcaatgaatttcttatg

SEQ ID NO: 45209 - DNA, 21 bp, Artificial sequence
  SiRNA target sequence
aactcaatgaatttcttatga

SEQ ID NO: 45210 - DNA, 21 bp, Artificial sequence
  SiRNA target sequence
actcaatgaatttcttatgaa

SEQ ID NO: 45211 - DNA, 21 bp, Artificial sequence
  SiRNA target sequence
ctcaatgaatttcttatgaat

SEQ ID NO: 45212 - DNA, 21 bp, Artificial sequence
  SiRNA target sequence
tcaatgaatttcttatgaatt

SEQ ID NO: 45213 - DNA, 21 bp, Artificial sequence
  SiRNA target sequence
caatgaatttcttatgaatta

SEQ ID NO: 45214 - DNA, 21 bp, Artificial sequence
  SiRNA target sequence
aatgaatttcttatgaattat

SEQ ID NO: 45215 - DNA, 21 bp, Artificial sequence
  SiRNA target sequence
atgaatttcttatgaattatg

SEQ ID NO: 45216 - DNA, 21 bp, Artificial sequence
  SiRNA target sequence
tgaatttcttatgaattatgc

SEQ ID NO: 45217 - DNA, 21 bp, Artificial sequence
  SiRNA target sequence
gaatttcttatgaattatgct

SEQ ID NO: 45218 - DNA, 21 bp, Artificial sequence
  SiRNA target sequence
aatttcttatgaattatgctg

SEQ ID NO: 45219 - DNA, 21 bp, Artificial sequence
  SiRNA target sequence
atttcttatgaattatgctga

SEQ ID NO: 45220 - DNA, 21 bp, Artificial sequence
  SiRNA target sequence
tttcttatgaattatgctgaa

SEQ ID NO: 45221 - DNA, 21 bp, Artificial sequence
  SiRNA target sequence
ttcttatgaattatgctgaac

SEQ ID NO: 45222 - DNA, 21 bp, Artificial sequence
  SiRNA target sequence
tcttatgaattatgctgaaca

SEQ ID NO: 45223 - DNA, 21 bp, Artificial sequence
  SiRNA target sequence
cttatgaattatgctgaacaa

SEQ ID NO: 45224 - DNA, 21 bp, Artificial sequence
  SiRNA target sequence
ttatgaattatgctgaacaac

SEQ ID NO: 45225 - DNA, 21 bp, Artificial sequence
  SiRNA target sequence
tatgaattatgctgaacaacg

SEQ ID NO: 45226 - DNA, 21 bp, Artificial sequence
  SiRNA target sequence
atgaattatgctgaacaacgc

SEQ ID NO: 45227 - DNA, 21 bp, Artificial sequence
  SiRNA target sequence
tgaattatgctgaacaacgca

SEQ ID NO: 45228 - DNA, 21 bp, Artificial sequence
  SiRNA target sequence
gaattatgctgaacaacgcaa

SEQ ID NO: 45229 - DNA, 21 bp, Artificial sequence
  SiRNA target sequence
aattatgctgaacaacgcaaa

SEQ ID NO: 45230 - DNA, 21 bp, Artificial sequence
  SiRNA target sequence
attatgctgaacaacgcaaag

SEQ ID NO: 45231 - DNA, 21 bp, Artificial sequence
  SiRNA target sequence
ttatgctgaacaacgcaaaga

SEQ ID NO: 45232 - DNA, 21 bp, Artificial sequence
  SiRNA target sequence
tatgctgaacaacgcaaagac

SEQ ID NO: 45233 - DNA, 21 bp, Artificial sequence
  SiRNA target sequence
atgctgaacaacgcaaagaca

SEQ ID NO: 45234 - DNA, 21 bp, Artificial sequence
  SiRNA target sequence
tgctgaacaacgcaaagacag

SEQ ID NO: 45235 - DNA, 21 bp, Artificial sequence
  SiRNA target sequence
gctgaacaacgcaaagacaga

SEQ ID NO: 45236 - DNA, 21 bp, Artificial sequence
  SiRNA target sequence
ctgaacaacgcaaagacagaa

SEQ ID NO: 45237 - DNA, 21 bp, Artificial sequence
  SiRNA target sequence
tgaacaacgcaaagacagaag

SEQ ID NO: 45238 - DNA, 21 bp, Artificial sequence
  SiRNA target sequence
gaacaacgcaaagacagaagt

SEQ ID NO: 45239 - DNA, 21 bp, Artificial sequence
  SiRNA target sequence
aacaacgcaaagacagaagta

SEQ ID NO: 45240 - DNA, 21 bp, Artificial sequence
  SiRNA target sequence
acaacgcaaagacagaagtag

SEQ ID NO: 45241 - DNA, 21 bp, Artificial sequence
  SiRNA target sequence
caacgcaaagacagaagtaga

SEQ ID NO: 45242 - DNA, 21 bp, Artificial sequence
  SiRNA target sequence
aacgcaaagacagaagtagag

SEQ ID NO: 45243 - DNA, 21 bp, Artificial sequence
  SiRNA target sequence
acgcaaagacagaagtagaga

SEQ ID NO: 45244 - DNA, 21 bp, Artificial sequence
  SiRNA target sequence
cgcaaagacagaagtagagat

SEQ ID NO: 45245 - DNA, 21 bp, Artificial sequence
  SiRNA target sequence
gcaaagacagaagtagagata

SEQ ID NO: 45246 - DNA, 21 bp, Artificial sequence
  SiRNA target sequence
caaagacagaagtagagatac

SEQ ID NO: 45247 - DNA, 21 bp, Artificial sequence
  SiRNA target sequence
aaagacagaagtagagatact

SEQ ID NO: 45248 - DNA, 21 bp, Artificial sequence
  SiRNA target sequence
aagacagaagtagagatactt

SEQ ID NO: 45249 - DNA, 21 bp, Artificial sequence
  SiRNA target sequence
agacagaagtagagatacttt

SEQ ID NO: 45250 - DNA, 21 bp, Artificial sequence
  SiRNA target sequence
gacagaagtagagatactttt

SEQ ID NO: 45251 - DNA, 21 bp, Artificial sequence
  SiRNA target sequence
acagaagtagagatactttta

SEQ ID NO: 45252 - DNA, 21 bp, Artificial sequence
  SiRNA target sequence
cagaagtagagatacttttat

SEQ ID NO: 45253 - DNA, 21 bp, Artificial sequence
  SiRNA target sequence
agaagtagagatacttttatc

SEQ ID NO: 45254 - DNA, 21 bp, Artificial sequence
  SiRNA target sequence
gaagtagagatacttttatcc

SEQ ID NO: 45255 - DNA, 21 bp, Artificial sequence
  SiRNA target sequence
aagtagagatacttttatcca

SEQ ID NO: 45256 - DNA, 21 bp, Artificial sequence
  SiRNA target sequence
agtagagatacttttatccat

SEQ ID NO: 45257 - DNA, 21 bp, Artificial sequence
  SiRNA target sequence
gtagagatacttttatccatc

SEQ ID NO: 45258 - DNA, 21 bp, Artificial sequence
  SiRNA target sequence
tagagatacttttatccatcc

SEQ ID NO: 45259 - DNA, 21 bp, Artificial sequence
  SiRNA target sequence
agagatacttttatccatcct

SEQ ID NO: 45260 - DNA, 21 bp, Artificial sequence
  SiRNA target sequence
gagatacttttatccatcctg

SEQ ID NO: 45261 - DNA, 21 bp, Artificial sequence
  SiRNA target sequence
agatacttttatccatcctga

SEQ ID NO: 45262 - DNA, 21 bp, Artificial sequence
  SiRNA target sequence
gatacttttatccatcctgaa

SEQ ID NO: 45263 - DNA, 21 bp, Artificial sequence
  SiRNA target sequence
atacttttatccatcctgaac

SEQ ID NO: 45264 - DNA, 21 bp, Artificial sequence
  SiRNA target sequence
tacttttatccatcctgaacc

SEQ ID NO: 45265 - DNA, 21 bp, Artificial sequence
  SiRNA target sequence
acttttatccatcctgaacct

SEQ ID NO: 45266 - DNA, 21 bp, Artificial sequence
  SiRNA target sequence
cttttatccatcctgaacctg

SEQ ID NO: 45267 - DNA, 21 bp, Artificial sequence
  SiRNA target sequence
ttttatccatcctgaacctga

SEQ ID NO: 45268 - DNA, 21 bp, Artificial sequence
  SiRNA target sequence
tttatccatcctgaacctgaa

SEQ ID NO: 45269 - DNA, 21 bp, Artificial sequence
  SiRNA target sequence
ttatccatcctgaacctgaat

SEQ ID NO: 45270 - DNA, 21 bp, Artificial sequence
  SiRNA target sequence
tatccatcctgaacctgaata

SEQ ID NO: 45271 - DNA, 21 bp, Artificial sequence
  SiRNA target sequence
atccatcctgaacctgaatat

SEQ ID NO: 45272 - DNA, 21 bp, Artificial sequence
  SiRNA target sequence
tccatcctgaacctgaatatg

SEQ ID NO: 45273 - DNA, 21 bp, Artificial sequence
  SiRNA target sequence
ccatcctgaacctgaatatga

SEQ ID NO: 45274 - DNA, 21 bp, Artificial sequence
  SiRNA target sequence
catcctgaacctgaatatgac

SEQ ID NO: 45275 - DNA, 21 bp, Artificial sequence
  SiRNA target sequence
atcctgaacctgaatatgacg

SEQ ID NO: 45276 - DNA, 21 bp, Artificial sequence
  SiRNA target sequence
tcctgaacctgaatatgacga

SEQ ID NO: 45277 - DNA, 21 bp, Artificial sequence
  SiRNA target sequence
cctgaacctgaatatgacgat

SEQ ID NO: 45278 - DNA, 21 bp, Artificial sequence
  SiRNA target sequence
ctgaacctgaatatgacgatg

SEQ ID NO: 45279 - DNA, 21 bp, Artificial sequence
  SiRNA target sequence
tgaacctgaatatgacgatga

SEQ ID NO: 45280 - DNA, 21 bp, Artificial sequence
  SiRNA target sequence
gaacctgaatatgacgatgat

SEQ ID NO: 45281 - DNA, 21 bp, Artificial sequence
  SiRNA target sequence
aacctgaatatgacgatgatg

SEQ ID NO: 45282 - DNA, 21 bp, Artificial sequence
  SiRNA target sequence
acctgaatatgacgatgatga

SEQ ID NO: 45283 - DNA, 21 bp, Artificial sequence
  SiRNA target sequence
cctgaatatgacgatgatgag

SEQ ID NO: 45284 - DNA, 21 bp, Artificial sequence
  SiRNA target sequence
ctgaatatgacgatgatgagt

SEQ ID NO: 45285 - DNA, 21 bp, Artificial sequence
  SiRNA target sequence
tgaatatgacgatgatgagtt

SEQ ID NO: 45286 - DNA, 21 bp, Artificial sequence
  SiRNA target sequence
gaatatgacgatgatgagttc

SEQ ID NO: 45287 - DNA, 21 bp, Artificial sequence
  SiRNA target sequence
aatatgacgatgatgagttca

SEQ ID NO: 45288 - DNA, 21 bp, Artificial sequence
  SiRNA target sequence
atatgacgatgatgagttcaa

SEQ ID NO: 45289 - DNA, 21 bp, Artificial sequence
  SiRNA target sequence
tatgacgatgatgagttcaag

SEQ ID NO: 45290 - DNA, 21 bp, Artificial sequence
  SiRNA target sequence
atgacgatgatgagttcaagg

SEQ ID NO: 45291 - DNA, 21 bp, Artificial sequence
  SiRNA target sequence
tgacgatgatgagttcaagga

SEQ ID NO: 45292 - DNA, 21 bp, Artificial sequence
  SiRNA target sequence
gacgatgatgagttcaaggac

SEQ ID NO: 45293 - DNA, 21 bp, Artificial sequence
  SiRNA target sequence
acgatgatgagttcaaggaca

SEQ ID NO: 45294 - DNA, 21 bp, Artificial sequence
  SiRNA target sequence
cgatgatgagttcaaggacac

SEQ ID NO: 45295 - DNA, 21 bp, Artificial sequence
  SiRNA target sequence
gatgatgagttcaaggacaca

SEQ ID NO: 45296 - DNA, 21 bp, Artificial sequence
  SiRNA target sequence
atgatgagttcaaggacacat

SEQ ID NO: 45297 - DNA, 21 bp, Artificial sequence
  SiRNA target sequence
tgatgagttcaaggacacatt

SEQ ID NO: 45298 - DNA, 21 bp, Artificial sequence
  SiRNA target sequence
gatgagttcaaggacacatta

SEQ ID NO: 45299 - DNA, 21 bp, Artificial sequence
  SiRNA target sequence
atgagttcaaggacacattag

SEQ ID NO: 45300 - DNA, 21 bp, Artificial sequence
  SiRNA target sequence
tgagttcaaggacacattaga

SEQ ID NO: 45301 - DNA, 21 bp, Artificial sequence
  SiRNA target sequence
gagttcaaggacacattagaa

SEQ ID NO: 45302 - DNA, 21 bp, Artificial sequence
  SiRNA target sequence
agttcaaggacacattagaag

SEQ ID NO: 45303 - DNA, 21 bp, Artificial sequence
  SiRNA target sequence
gttcaaggacacattagaagt

SEQ ID NO: 45304 - DNA, 21 bp, Artificial sequence
  SiRNA target sequence
ttcaaggacacattagaagta

SEQ ID NO: 45305 - DNA, 21 bp, Artificial sequence
  SiRNA target sequence
tcaaggacacattagaagtac

SEQ ID NO: 45306 - DNA, 21 bp, Artificial sequence
  SiRNA target sequence
caaggacacattagaagtaca

SEQ ID NO: 45307 - DNA, 21 bp, Artificial sequence
  SiRNA target sequence
aaggacacattagaagtacag

SEQ ID NO: 45308 - DNA, 21 bp, Artificial sequence
  SiRNA target sequence
aggacacattagaagtacaga

SEQ ID NO: 45309 - DNA, 21 bp, Artificial sequence
  SiRNA target sequence
ggacacattagaagtacagat

SEQ ID NO: 45310 - DNA, 21 bp, Artificial sequence
  SiRNA target sequence
gacacattagaagtacagatg

SEQ ID NO: 45311 - DNA, 21 bp, Artificial sequence
  SiRNA target sequence
acacattagaagtacagatgc

SEQ ID NO: 45312 - DNA, 21 bp, Artificial sequence
  SiRNA target sequence
cacattagaagtacagatgca

SEQ ID NO: 45313 - DNA, 21 bp, Artificial sequence
  SiRNA target sequence
acattagaagtacagatgcaa

SEQ ID NO: 45314 - DNA, 21 bp, Artificial sequence
  SiRNA target sequence
cattagaagtacagatgcaaa

SEQ ID NO: 45315 - DNA, 21 bp, Artificial sequence
  SiRNA target sequence
attagaagtacagatgcaaat

SEQ ID NO: 45316 - DNA, 21 bp, Artificial sequence
  SiRNA target sequence
ttagaagtacagatgcaaatt

SEQ ID NO: 45317 - DNA, 21 bp, Artificial sequence
  SiRNA target sequence
tagaagtacagatgcaaattg

SEQ ID NO: 45318 - DNA, 21 bp, Artificial sequence
  SiRNA target sequence
agaagtacagatgcaaattga

SEQ ID NO: 45319 - DNA, 21 bp, Artificial sequence
  SiRNA target sequence
gaagtacagatgcaaattgat

SEQ ID NO: 45320 - DNA, 21 bp, Artificial sequence
  SiRNA target sequence
aagtacagatgcaaattgatg

SEQ ID NO: 45321 - DNA, 21 bp, Artificial sequence
  SiRNA target sequence
agtacagatgcaaattgatgc

SEQ ID NO: 45322 - DNA, 21 bp, Artificial sequence
  SiRNA target sequence
gtacagatgcaaattgatgct

SEQ ID NO: 45323 - DNA, 21 bp, Artificial sequence
  SiRNA target sequence
tacagatgcaaattgatgctc

SEQ ID NO: 45324 - DNA, 21 bp, Artificial sequence
  SiRNA target sequence
acagatgcaaattgatgctcc

SEQ ID NO: 45325 - DNA, 21 bp, Artificial sequence
  SiRNA target sequence
cagatgcaaattgatgctcct

SEQ ID NO: 45326 - DNA, 21 bp, Artificial sequence
  SiRNA target sequence
agatgcaaattgatgctccta

SEQ ID NO: 45327 - DNA, 21 bp, Artificial sequence
  SiRNA target sequence
gatgcaaattgatgctcctaa

SEQ ID NO: 45328 - DNA, 21 bp, Artificial sequence
  SiRNA target sequence
atgcaaattgatgctcctaat

SEQ ID NO: 45329 - DNA, 21 bp, Artificial sequence
  SiRNA target sequence
tgcaaattgatgctcctaatg

SEQ ID NO: 45330 - DNA, 21 bp, Artificial sequence
  SiRNA target sequence
gcaaattgatgctcctaatga

SEQ ID NO: 45331 - DNA, 21 bp, Artificial sequence
  SiRNA target sequence
caaattgatgctcctaatgat

SEQ ID NO: 45332 - DNA, 21 bp, Artificial sequence
  SiRNA target sequence
aaattgatgctcctaatgatg

SEQ ID NO: 45333 - DNA, 21 bp, Artificial sequence
  SiRNA target sequence
aattgatgctcctaatgatga

SEQ ID NO: 45334 - DNA, 21 bp, Artificial sequence
  SiRNA target sequence
attgatgctcctaatgatgac

SEQ ID NO: 45335 - DNA, 21 bp, Artificial sequence
  SiRNA target sequence
ttgatgctcctaatgatgacc

SEQ ID NO: 45336 - DNA, 21 bp, Artificial sequence
  SiRNA target sequence
tgatgctcctaatgatgacct

SEQ ID NO: 45337 - DNA, 21 bp, Artificial sequence
  SiRNA target sequence
gatgctcctaatgatgacctt

SEQ ID NO: 45338 - DNA, 21 bp, Artificial sequence
  SiRNA target sequence
atgctcctaatgatgaccttg

SEQ ID NO: 45339 - DNA, 21 bp, Artificial sequence
  SiRNA target sequence
tgctcctaatgatgaccttgt

SEQ ID NO: 45340 - DNA, 21 bp, Artificial sequence
  SiRNA target sequence
gctcctaatgatgaccttgtt

SEQ ID NO: 45341 - DNA, 21 bp, Artificial sequence
  SiRNA target sequence
ctcctaatgatgaccttgttc

SEQ ID NO: 45342 - DNA, 21 bp, Artificial sequence
  SiRNA target sequence
tcctaatgatgaccttgttct

SEQ ID NO: 45343 - DNA, 21 bp, Artificial sequence
  SiRNA target sequence
cctaatgatgaccttgttctc

SEQ ID NO: 45344 - DNA, 21 bp, Artificial sequence
  SiRNA target sequence
ctaatgatgaccttgttctca

SEQ ID NO: 45345 - DNA, 21 bp, Artificial sequence
  SiRNA target sequence
taatgatgaccttgttctcat

SEQ ID NO: 45346 - DNA, 21 bp, Artificial sequence
  SiRNA target sequence
aatgatgaccttgttctcatt

SEQ ID NO: 45347 - DNA, 21 bp, Artificial sequence
  SiRNA target sequence
atgatgaccttgttctcattg

SEQ ID NO: 45348 - DNA, 21 bp, Artificial sequence
  SiRNA target sequence
tgatgaccttgttctcattga

SEQ ID NO: 45349 - DNA, 21 bp, Artificial sequence
  SiRNA target sequence
gatgaccttgttctcattgaa

SEQ ID NO: 45350 - DNA, 21 bp, Artificial sequence
  SiRNA target sequence
atgaccttgttctcattgaac

SEQ ID NO: 45351 - DNA, 21 bp, Artificial sequence
  SiRNA target sequence
tgaccttgttctcattgaaca

SEQ ID NO: 45352 - DNA, 21 bp, Artificial sequence
  SiRNA target sequence
gaccttgttctcattgaacaa

SEQ ID NO: 45353 - DNA, 21 bp, Artificial sequence
  SiRNA target sequence
accttgttctcattgaacaag

SEQ ID NO: 45354 - DNA, 21 bp, Artificial sequence
  SiRNA target sequence
ccttgttctcattgaacaaga

SEQ ID NO: 45355 - DNA, 21 bp, Artificial sequence
  SiRNA target sequence
cttgttctcattgaacaagat

SEQ ID NO: 45356 - DNA, 21 bp, Artificial sequence
  SiRNA target sequence
ttgttctcattgaacaagata

SEQ ID NO: 45357 - DNA, 21 bp, Artificial sequence
  SiRNA target sequence
tgttctcattgaacaagatag

SEQ ID NO: 45358 - DNA, 21 bp, Artificial sequence
  SiRNA target sequence
gttctcattgaacaagataga

SEQ ID NO: 45359 - DNA, 21 bp, Artificial sequence
  SiRNA target sequence
ttctcattgaacaagatagat

SEQ ID NO: 45360 - DNA, 21 bp, Artificial sequence
  SiRNA target sequence
tctcattgaacaagatagatt

SEQ ID NO: 45361 - DNA, 21 bp, Artificial sequence
  SiRNA target sequence
ctcattgaacaagatagattg

SEQ ID NO: 45362 - DNA, 21 bp, Artificial sequence
  SiRNA target sequence
tcattgaacaagatagattgc

SEQ ID NO: 45363 - DNA, 21 bp, Artificial sequence
  SiRNA target sequence
cattgaacaagatagattgcg

SEQ ID NO: 45364 - DNA, 21 bp, Artificial sequence
  SiRNA target sequence
attgaacaagatagattgcga

SEQ ID NO: 45365 - DNA, 21 bp, Artificial sequence
  SiRNA target sequence
ttgaacaagatagattgcgag

SEQ ID NO: 45366 - DNA, 21 bp, Artificial sequence
  SiRNA target sequence
tgaacaagatagattgcgaga

SEQ ID NO: 45367 - DNA, 21 bp, Artificial sequence
  SiRNA target sequence
gaacaagatagattgcgagag

SEQ ID NO: 45368 - DNA, 21 bp, Artificial sequence
  SiRNA target sequence
aacaagatagattgcgagaga

SEQ ID NO: 45369 - DNA, 21 bp, Artificial sequence
  SiRNA target sequence
acaagatagattgcgagagat

SEQ ID NO: 45370 - DNA, 21 bp, Artificial sequence
  SiRNA target sequence
caagatagattgcgagagatg

SEQ ID NO: 45371 - DNA, 21 bp, Artificial sequence
  SiRNA target sequence
aagatagattgcgagagatga

SEQ ID NO: 45372 - DNA, 21 bp, Artificial sequence
  SiRNA target sequence
agatagattgcgagagatgat

SEQ ID NO: 45373 - DNA, 21 bp, Artificial sequence
  SiRNA target sequence
gatagattgcgagagatgatt

SEQ ID NO: 45374 - DNA, 21 bp, Artificial sequence
  SiRNA target sequence
atagattgcgagagatgattg

SEQ ID NO: 45375 - DNA, 21 bp, Artificial sequence
  SiRNA target sequence
tagattgcgagagatgattga

SEQ ID NO: 45376 - DNA, 21 bp, Artificial sequence
  SiRNA target sequence
agattgcgagagatgattgat

SEQ ID NO: 45377 - DNA, 21 bp, Artificial sequence
  SiRNA target sequence
gattgcgagagatgattgatt

SEQ ID NO: 45378 - DNA, 21 bp, Artificial sequence
  SiRNA target sequence
attgcgagagatgattgattc

SEQ ID NO: 45379 - DNA, 21 bp, Artificial sequence
  SiRNA target sequence
ttgcgagagatgattgattca

SEQ ID NO: 45380 - DNA, 21 bp, Artificial sequence
  SiRNA target sequence
tgcgagagatgattgattcat

SEQ ID NO: 45381 - DNA, 21 bp, Artificial sequence
  SiRNA target sequence
gcgagagatgattgattcatg

SEQ ID NO: 45382 - DNA, 21 bp, Artificial sequence
  SiRNA target sequence
cgagagatgattgattcatgt

SEQ ID NO: 45383 - DNA, 21 bp, Artificial sequence
  SiRNA target sequence
gagagatgattgattcatgta

SEQ ID NO: 45384 - DNA, 21 bp, Artificial sequence
  SiRNA target sequence
agagatgattgattcatgtac

SEQ ID NO: 45385 - DNA, 21 bp, Artificial sequence
  SiRNA target sequence
gagatgattgattcatgtacc

SEQ ID NO: 45386 - DNA, 21 bp, Artificial sequence
  SiRNA target sequence
agatgattgattcatgtaccg

SEQ ID NO: 45387 - DNA, 21 bp, Artificial sequence
  SiRNA target sequence
gatgattgattcatgtaccgg

SEQ ID NO: 45388 - DNA, 21 bp, Artificial sequence
  SiRNA target sequence
atgattgattcatgtaccggt

SEQ ID NO: 45389 - DNA, 21 bp, Artificial sequence
  SiRNA target sequence
tgattgattcatgtaccggtg

SEQ ID NO: 45390 - DNA, 21 bp, Artificial sequence
  SiRNA target sequence
gattgattcatgtaccggtgt

SEQ ID NO: 45391 - DNA, 21 bp, Artificial sequence
  SiRNA target sequence
attgattcatgtaccggtgtt

SEQ ID NO: 45392 - DNA, 21 bp, Artificial sequence
  SiRNA target sequence
ttgattcatgtaccggtgttg

SEQ ID NO: 45393 - DNA, 21 bp, Artificial sequence
  SiRNA target sequence
tgattcatgtaccggtgttgt

SEQ ID NO: 45394 - DNA, 21 bp, Artificial sequence
  SiRNA target sequence
gattcatgtaccggtgttgtt

SEQ ID NO: 45395 - DNA, 21 bp, Artificial sequence
  SiRNA target sequence
attcatgtaccggtgttgttt

SEQ ID NO: 45396 - DNA, 21 bp, Artificial sequence
  SiRNA target sequence
ttcatgtaccggtgttgttta

SEQ ID NO: 45397 - DNA, 21 bp, Artificial sequence
  SiRNA target sequence
tcatgtaccggtgttgtttat

SEQ ID NO: 45398 - DNA, 21 bp, Artificial sequence
  SiRNA target sequence
catgtaccggtgttgtttatg

SEQ ID NO: 45399 - DNA, 21 bp, Artificial sequence
  SiRNA target sequence
atgtaccggtgttgtttatga

SEQ ID NO: 45400 - DNA, 21 bp, Artificial sequence
  SiRNA target sequence
tgtaccggtgttgtttatgat

SEQ ID NO: 45401 - DNA, 21 bp, Artificial sequence
  SiRNA target sequence
gtaccggtgttgtttatgatt

SEQ ID NO: 45402 - DNA, 21 bp, Artificial sequence
  SiRNA target sequence
taccggtgttgtttatgattg

SEQ ID NO: 45403 - DNA, 21 bp, Artificial sequence
  SiRNA target sequence
accggtgttgtttatgattgc

SEQ ID NO: 45404 - DNA, 21 bp, Artificial sequence
  SiRNA target sequence
ccggtgttgtttatgattgca

SEQ ID NO: 45405 - DNA, 21 bp, Artificial sequence
  SiRNA target sequence
cggtgttgtttatgattgcaa

SEQ ID NO: 45406 - DNA, 21 bp, Artificial sequence
  SiRNA target sequence
ggtgttgtttatgattgcaaa

SEQ ID NO: 45407 - DNA, 21 bp, Artificial sequence
  SiRNA target sequence
gtgttgtttatgattgcaaac

SEQ ID NO: 45408 - DNA, 21 bp, Artificial sequence
  SiRNA target sequence
tgttgtttatgattgcaaaca

SEQ ID NO: 45409 - DNA, 21 bp, Artificial sequence
  SiRNA target sequence
gttgtttatgattgcaaacaa

SEQ ID NO: 45410 - DNA, 21 bp, Artificial sequence
  SiRNA target sequence
ttgtttatgattgcaaacaac

SEQ ID NO: 45411 - DNA, 21 bp, Artificial sequence
  SiRNA target sequence
tgtttatgattgcaaacaaca

SEQ ID NO: 45412 - DNA, 21 bp, Artificial sequence
  SiRNA target sequence
gtttatgattgcaaacaacaa

SEQ ID NO: 45413 - DNA, 21 bp, Artificial sequence
  SiRNA target sequence
tttatgattgcaaacaacaag

SEQ ID NO: 45414 - DNA, 21 bp, Artificial sequence
  SiRNA target sequence
ttatgattgcaaacaacaagt

SEQ ID NO: 45415 - DNA, 21 bp, Artificial sequence
  SiRNA target sequence
tatgattgcaaacaacaagta

SEQ ID NO: 45416 - DNA, 21 bp, Artificial sequence
  SiRNA target sequence
atgattgcaaacaacaagtag

SEQ ID NO: 45417 - DNA, 21 bp, Artificial sequence
  SiRNA target sequence
tgattgcaaacaacaagtagt

SEQ ID NO: 45418 - DNA, 21 bp, Artificial sequence
  SiRNA target sequence
gattgcaaacaacaagtagtg

SEQ ID NO: 45419 - DNA, 21 bp, Artificial sequence
  SiRNA target sequence
attgcaaacaacaagtagtga

SEQ ID NO: 45420 - DNA, 21 bp, Artificial sequence
  SiRNA target sequence
ttgcaaacaacaagtagtgaa

SEQ ID NO: 45421 - DNA, 21 bp, Artificial sequence
  SiRNA target sequence
tgcaaacaacaagtagtgaag

SEQ ID NO: 45422 - DNA, 21 bp, Artificial sequence
  SiRNA target sequence
gcaaacaacaagtagtgaaga

SEQ ID NO: 45423 - DNA, 21 bp, Artificial sequence
  SiRNA target sequence
caaacaacaagtagtgaagat

SEQ ID NO: 45424 - DNA, 21 bp, Artificial sequence
  SiRNA target sequence
aaacaacaagtagtgaagata

SEQ ID NO: 45425 - DNA, 21 bp, Artificial sequence
  SiRNA target sequence
aacaacaagtagtgaagatat

SEQ ID NO: 45426 - DNA, 21 bp, Artificial sequence
  SiRNA target sequence
acaacaagtagtgaagatatc

SEQ ID NO: 45427 - DNA, 21 bp, Artificial sequence
  SiRNA target sequence
caacaagtagtgaagatatca

SEQ ID NO: 45428 - DNA, 21 bp, Artificial sequence
  SiRNA target sequence
aacaagtagtgaagatatcaa

SEQ ID NO: 45429 - DNA, 21 bp, Artificial sequence
  SiRNA target sequence
acaagtagtgaagatatcaaa

SEQ ID NO: 45430 - DNA, 21 bp, Artificial sequence
  SiRNA target sequence
caagtagtgaagatatcaaaa

SEQ ID NO: 45431 - DNA, 21 bp, Artificial sequence
  SiRNA target sequence
aagtagtgaagatatcaaaac

SEQ ID NO: 45432 - DNA, 21 bp, Artificial sequence
  SiRNA target sequence
agtagtgaagatatcaaaact

SEQ ID NO: 45433 - DNA, 21 bp, Artificial sequence
  SiRNA target sequence
gtagtgaagatatcaaaactc

SEQ ID NO: 45434 - DNA, 21 bp, Artificial sequence
  SiRNA target sequence
tagtgaagatatcaaaactcg

SEQ ID NO: 45435 - DNA, 21 bp, Artificial sequence
  SiRNA target sequence
agtgaagatatcaaaactcgc

SEQ ID NO: 45436 - DNA, 21 bp, Artificial sequence
  SiRNA target sequence
gtgaagatatcaaaactcgct

SEQ ID NO: 45437 - DNA, 21 bp, Artificial sequence
  SiRNA target sequence
tgaagatatcaaaactcgctt

SEQ ID NO: 45438 - DNA, 21 bp, Artificial sequence
  SiRNA target sequence
gaagatatcaaaactcgcttt

SEQ ID NO: 45439 - DNA, 21 bp, Artificial sequence
  SiRNA target sequence
aagatatcaaaactcgctttt

SEQ ID NO: 45440 - DNA, 21 bp, Artificial sequence
  SiRNA target sequence
agatatcaaaactcgcttttg

SEQ ID NO: 45441 - DNA, 21 bp, Artificial sequence
  SiRNA target sequence
gatatcaaaactcgcttttga

SEQ ID NO: 45442 - DNA, 21 bp, Artificial sequence
  SiRNA target sequence
atatcaaaactcgcttttgat

SEQ ID NO: 45443 - DNA, 21 bp, Artificial sequence
  SiRNA target sequence
tatcaaaactcgcttttgatc

SEQ ID NO: 45444 - DNA, 21 bp, Artificial sequence
  SiRNA target sequence
atcaaaactcgcttttgatct

SEQ ID NO: 45445 - DNA, 21 bp, Artificial sequence
  SiRNA target sequence
tcaaaactcgcttttgatctt

SEQ ID NO: 45446 - DNA, 21 bp, Artificial sequence
  SiRNA target sequence
caaaactcgcttttgatcttg

SEQ ID NO: 45447 - DNA, 21 bp, Artificial sequence
  SiRNA target sequence
aaaactcgcttttgatcttgc

SEQ ID NO: 45448 - DNA, 21 bp, Artificial sequence
  SiRNA target sequence
aaactcgcttttgatcttgcc

SEQ ID NO: 45449 - DNA, 21 bp, Artificial sequence
  SiRNA target sequence
aactcgcttttgatcttgccc

SEQ ID NO: 45450 - DNA, 21 bp, Artificial sequence
  SiRNA target sequence
actcgcttttgatcttgcccc

SEQ ID NO: 45451 - DNA, 21 bp, Artificial sequence
  SiRNA target sequence
ctcgcttttgatcttgcccca

SEQ ID NO: 45452 - DNA, 21 bp, Artificial sequence
  SiRNA target sequence
tcgcttttgatcttgccccat

SEQ ID NO: 45453 - DNA, 21 bp, Artificial sequence
  SiRNA target sequence
cgcttttgatcttgccccatt

SEQ ID NO: 45454 - DNA, 21 bp, Artificial sequence
  SiRNA target sequence
gcttttgatcttgccccatta

SEQ ID NO: 45455 - DNA, 21 bp, Artificial sequence
  SiRNA target sequence
cttttgatcttgccccattag

SEQ ID NO: 45456 - DNA, 21 bp, Artificial sequence
  SiRNA target sequence
ttttgatcttgccccattaga

SEQ ID NO: 45457 - DNA, 21 bp, Artificial sequence
  SiRNA target sequence
tttgatcttgccccattagac

SEQ ID NO: 45458 - DNA, 21 bp, Artificial sequence
  SiRNA target sequence
ttgatcttgccccattagact

SEQ ID NO: 45459 - DNA, 21 bp, Artificial sequence
  SiRNA target sequence
tgatcttgccccattagacta

SEQ ID NO: 45460 - DNA, 21 bp, Artificial sequence
  SiRNA target sequence
gatcttgccccattagactat

SEQ ID NO: 45461 - DNA, 21 bp, Artificial sequence
  SiRNA target sequence
atcttgccccattagactatg

SEQ ID NO: 45462 - DNA, 21 bp, Artificial sequence
  SiRNA target sequence
tcttgccccattagactatga

SEQ ID NO: 45463 - DNA, 21 bp, Artificial sequence
  SiRNA target sequence
cttgccccattagactatgat

SEQ ID NO: 45464 - DNA, 21 bp, Artificial sequence
  SiRNA target sequence
ttgccccattagactatgatg

SEQ ID NO: 45465 - DNA, 21 bp, Artificial sequence
  SiRNA target sequence
tgccccattagactatgatga

SEQ ID NO: 45466 - DNA, 21 bp, Artificial sequence
  SiRNA target sequence
gccccattagactatgatgaa

SEQ ID NO: 45467 - DNA, 21 bp, Artificial sequence
  SiRNA target sequence
ccccattagactatgatgaac

SEQ ID NO: 45468 - DNA, 21 bp, Artificial sequence
  SiRNA target sequence
cccattagactatgatgaaca

SEQ ID NO: 45469 - DNA, 21 bp, Artificial sequence
  SiRNA target sequence
ccattagactatgatgaacaa

SEQ ID NO: 45470 - DNA, 21 bp, Artificial sequence
  SiRNA target sequence
cattagactatgatgaacaaa

SEQ ID NO: 45471 - DNA, 21 bp, Artificial sequence
  SiRNA target sequence
attagactatgatgaacaaat

SEQ ID NO: 45472 - DNA, 21 bp, Artificial sequence
  SiRNA target sequence
ttagactatgatgaacaaatg

SEQ ID NO: 45473 - DNA, 21 bp, Artificial sequence
  SiRNA target sequence
tagactatgatgaacaaatgc

SEQ ID NO: 45474 - DNA, 21 bp, Artificial sequence
  SiRNA target sequence
agactatgatgaacaaatgca

SEQ ID NO: 45475 - DNA, 21 bp, Artificial sequence
  SiRNA target sequence
gactatgatgaacaaatgcaa

SEQ ID NO: 45476 - DNA, 21 bp, Artificial sequence
  SiRNA target sequence
actatgatgaacaaatgcaac

SEQ ID NO: 45477 - DNA, 21 bp, Artificial sequence
  SiRNA target sequence
ctatgatgaacaaatgcaacg

SEQ ID NO: 45478 - DNA, 21 bp, Artificial sequence
  SiRNA target sequence
tatgatgaacaaatgcaacga

SEQ ID NO: 45479 - DNA, 21 bp, Artificial sequence
  SiRNA target sequence
atgatgaacaaatgcaacgaa

SEQ ID NO: 45480 - DNA, 21 bp, Artificial sequence
  SiRNA target sequence
tgatgaacaaatgcaacgaat

SEQ ID NO: 45481 - DNA, 21 bp, Artificial sequence
  SiRNA target sequence
gatgaacaaatgcaacgaatt

SEQ ID NO: 45482 - DNA, 21 bp, Artificial sequence
  SiRNA target sequence
atgaacaaatgcaacgaatta

SEQ ID NO: 45483 - DNA, 21 bp, Artificial sequence
  SiRNA target sequence
tgaacaaatgcaacgaattaa

SEQ ID NO: 45484 - DNA, 21 bp, Artificial sequence
  SiRNA target sequence
gaacaaatgcaacgaattaag

SEQ ID NO: 45485 - DNA, 21 bp, Artificial sequence
  SiRNA target sequence
aacaaatgcaacgaattaagg

SEQ ID NO: 45486 - DNA, 21 bp, Artificial sequence
  SiRNA target sequence
acaaatgcaacgaattaagga

SEQ ID NO: 45487 - DNA, 21 bp, Artificial sequence
  SiRNA target sequence
caaatgcaacgaattaaggaa

SEQ ID NO: 45488 - DNA, 21 bp, Artificial sequence
  SiRNA target sequence
aaatgcaacgaattaaggaaa

SEQ ID NO: 45489 - DNA, 21 bp, Artificial sequence
  SiRNA target sequence
aatgcaacgaattaaggaaat

SEQ ID NO: 45490 - DNA, 21 bp, Artificial sequence
  SiRNA target sequence
atgcaacgaattaaggaaatg

SEQ ID NO: 45491 - DNA, 21 bp, Artificial sequence
  SiRNA target sequence
tgcaacgaattaaggaaatga

SEQ ID NO: 45492 - DNA, 21 bp, Artificial sequence
  SiRNA target sequence
gcaacgaattaaggaaatgaa

SEQ ID NO: 45493 - DNA, 21 bp, Artificial sequence
  SiRNA target sequence
caacgaattaaggaaatgaag

SEQ ID NO: 45494 - DNA, 21 bp, Artificial sequence
  SiRNA target sequence
aacgaattaaggaaatgaagt

SEQ ID NO: 45495 - DNA, 21 bp, Artificial sequence
  SiRNA target sequence
acgaattaaggaaatgaagta

SEQ ID NO: 45496 - DNA, 21 bp, Artificial sequence
  SiRNA target sequence
cgaattaaggaaatgaagtat

SEQ ID NO: 45497 - DNA, 21 bp, Artificial sequence
  SiRNA target sequence
gaattaaggaaatgaagtatt

SEQ ID NO: 45498 - DNA, 21 bp, Artificial sequence
  SiRNA target sequence
aattaaggaaatgaagtatta

SEQ ID NO: 45499 - DNA, 21 bp, Artificial sequence
  SiRNA target sequence
attaaggaaatgaagtattac

SEQ ID NO: 45500 - DNA, 21 bp, Artificial sequence
  SiRNA target sequence
ttaaggaaatgaagtattacc

SEQ ID NO: 45501 - DNA, 21 bp, Artificial sequence
  SiRNA target sequence
taaggaaatgaagtattacca

SEQ ID NO: 45502 - DNA, 21 bp, Artificial sequence
  SiRNA target sequence
aaggaaatgaagtattaccag

SEQ ID NO: 45503 - DNA, 21 bp, Artificial sequence
  SiRNA target sequence
aggaaatgaagtattaccaga

SEQ ID NO: 45504 - DNA, 21 bp, Artificial sequence
  SiRNA target sequence
ggaaatgaagtattaccagaa

SEQ ID NO: 45505 - DNA, 21 bp, Artificial sequence
  SiRNA target sequence
gaaatgaagtattaccagaaa

SEQ ID NO: 45506 - DNA, 21 bp, Artificial sequence
  SiRNA target sequence
aaatgaagtattaccagaaag

SEQ ID NO: 45507 - DNA, 21 bp, Artificial sequence
  SiRNA target sequence
aatgaagtattaccagaaagt

SEQ ID NO: 45508 - DNA, 21 bp, Artificial sequence
  SiRNA target sequence
atgaagtattaccagaaagtc

SEQ ID NO: 45509 - DNA, 21 bp, Artificial sequence
  SiRNA target sequence
tgaagtattaccagaaagtcg

SEQ ID NO: 45510 - DNA, 21 bp, Artificial sequence
  SiRNA target sequence
gaagtattaccagaaagtcgc

SEQ ID NO: 45511 - DNA, 21 bp, Artificial sequence
  SiRNA target sequence
aagtattaccagaaagtcgca

SEQ ID NO: 45512 - DNA, 21 bp, Artificial sequence
  SiRNA target sequence
agtattaccagaaagtcgcaa

SEQ ID NO: 45513 - DNA, 21 bp, Artificial sequence
  SiRNA target sequence
gtattaccagaaagtcgcaag

SEQ ID NO: 45514 - DNA, 21 bp, Artificial sequence
  SiRNA target sequence
tattaccagaaagtcgcaagt

SEQ ID NO: 45515 - DNA, 21 bp, Artificial sequence
  SiRNA target sequence
attaccagaaagtcgcaagtg

SEQ ID NO: 45516 - DNA, 21 bp, Artificial sequence
  SiRNA target sequence
ttaccagaaagtcgcaagtgg

SEQ ID NO: 45517 - DNA, 21 bp, Artificial sequence
  SiRNA target sequence
taccagaaagtcgcaagtggc

SEQ ID NO: 45518 - DNA, 21 bp, Artificial sequence
  SiRNA target sequence
accagaaagtcgcaagtggcg

SEQ ID NO: 45519 - DNA, 21 bp, Artificial sequence
  SiRNA target sequence
ccagaaagtcgcaagtggcgt

SEQ ID NO: 45520 - DNA, 21 bp, Artificial sequence
  SiRNA target sequence
cagaaagtcgcaagtggcgta

SEQ ID NO: 45521 - DNA, 21 bp, Artificial sequence
  SiRNA target sequence
agaaagtcgcaagtggcgtat

SEQ ID NO: 45522 - DNA, 21 bp, Artificial sequence
  SiRNA target sequence
gaaagtcgcaagtggcgtatc

SEQ ID NO: 45523 - DNA, 21 bp, Artificial sequence
  SiRNA target sequence
aaagtcgcaagtggcgtatca

SEQ ID NO: 45524 - DNA, 21 bp, Artificial sequence
  SiRNA target sequence
aagtcgcaagtggcgtatcat

SEQ ID NO: 45525 - DNA, 21 bp, Artificial sequence
  SiRNA target sequence
agtcgcaagtggcgtatcata

SEQ ID NO: 45526 - DNA, 21 bp, Artificial sequence
  SiRNA target sequence
gtcgcaagtggcgtatcatat

SEQ ID NO: 45527 - DNA, 21 bp, Artificial sequence
  SiRNA target sequence
tcgcaagtggcgtatcatatt

SEQ ID NO: 45528 - DNA, 21 bp, Artificial sequence
  SiRNA target sequence
cgcaagtggcgtatcatattt

SEQ ID NO: 45529 - DNA, 21 bp, Artificial sequence
  SiRNA target sequence
gcaagtggcgtatcatatttg

SEQ ID NO: 45530 - DNA, 21 bp, Artificial sequence
  SiRNA target sequence
caagtggcgtatcatatttga

SEQ ID NO: 45531 - DNA, 21 bp, Artificial sequence
  SiRNA target sequence
aagtggcgtatcatatttgaa

SEQ ID NO: 45532 - DNA, 21 bp, Artificial sequence
  SiRNA target sequence
agtggcgtatcatatttgaag

SEQ ID NO: 45533 - DNA, 21 bp, Artificial sequence
  SiRNA target sequence
gtggcgtatcatatttgaaga

SEQ ID NO: 45534 - DNA, 21 bp, Artificial sequence
  SiRNA target sequence
tggcgtatcatatttgaagaa

SEQ ID NO: 45535 - DNA, 21 bp, Artificial sequence
  SiRNA target sequence
ggcgtatcatatttgaagaaa

SEQ ID NO: 45536 - DNA, 21 bp, Artificial sequence
  SiRNA target sequence
gcgtatcatatttgaagaaag

SEQ ID NO: 45537 - DNA, 21 bp, Artificial sequence
  SiRNA target sequence
cgtatcatatttgaagaaagt

SEQ ID NO: 45538 - DNA, 21 bp, Artificial sequence
  SiRNA target sequence
gtatcatatttgaagaaagtt

SEQ ID NO: 45539 - DNA, 21 bp, Artificial sequence
  SiRNA target sequence
tatcatatttgaagaaagttt

SEQ ID NO: 45540 - DNA, 21 bp, Artificial sequence
  SiRNA target sequence
atcatatttgaagaaagtttt

SEQ ID NO: 45541 - DNA, 21 bp, Artificial sequence
  SiRNA target sequence
tcatatttgaagaaagttttg

SEQ ID NO: 45542 - DNA, 21 bp, Artificial sequence
  SiRNA target sequence
catatttgaagaaagttttgg

SEQ ID NO: 45543 - DNA, 21 bp, Artificial sequence
  SiRNA target sequence
atatttgaagaaagttttgga

SEQ ID NO: 45544 - DNA, 21 bp, Artificial sequence
  SiRNA target sequence
tatttgaagaaagttttggat

SEQ ID NO: 45545 - DNA, 21 bp, Artificial sequence
  SiRNA target sequence
atttgaagaaagttttggatg

SEQ ID NO: 45546 - DNA, 21 bp, Artificial sequence
  SiRNA target sequence
tttgaagaaagttttggatgc

SEQ ID NO: 45547 - DNA, 21 bp, Artificial sequence
  SiRNA target sequence
ttgaagaaagttttggatgca

SEQ ID NO: 45548 - DNA, 21 bp, Artificial sequence
  SiRNA target sequence
tgaagaaagttttggatgcag

SEQ ID NO: 45549 - DNA, 21 bp, Artificial sequence
  SiRNA target sequence
gaagaaagttttggatgcagg

SEQ ID NO: 45550 - DNA, 21 bp, Artificial sequence
  SiRNA target sequence
aagaaagttttggatgcaggt

SEQ ID NO: 45551 - DNA, 21 bp, Artificial sequence
  SiRNA target sequence
agaaagttttggatgcaggtc

SEQ ID NO: 45552 - DNA, 21 bp, Artificial sequence
  SiRNA target sequence
gaaagttttggatgcaggtct

SEQ ID NO: 45553 - DNA, 21 bp, Artificial sequence
  SiRNA target sequence
aaagttttggatgcaggtctt

SEQ ID NO: 45554 - DNA, 21 bp, Artificial sequence
  SiRNA target sequence
aagttttggatgcaggtcttg

SEQ ID NO: 45555 - DNA, 21 bp, Artificial sequence
  SiRNA target sequence
agttttggatgcaggtcttgc

SEQ ID NO: 45556 - DNA, 21 bp, Artificial sequence
  SiRNA target sequence
gttttggatgcaggtcttgca

SEQ ID NO: 45557 - DNA, 21 bp, Artificial sequence
  SiRNA target sequence
ttttggatgcaggtcttgcaa

SEQ ID NO: 45558 - DNA, 21 bp, Artificial sequence
  SiRNA target sequence
tttggatgcaggtcttgcaat

SEQ ID NO: 45559 - DNA, 21 bp, Artificial sequence
  SiRNA target sequence
ttggatgcaggtcttgcaatt

SEQ ID NO: 45560 - DNA, 21 bp, Artificial sequence
  SiRNA target sequence
tggatgcaggtcttgcaattt

SEQ ID NO: 45561 - DNA, 21 bp, Artificial sequence
  SiRNA target sequence
ggatgcaggtcttgcaatttg

SEQ ID NO: 45562 - DNA, 21 bp, Artificial sequence
  SiRNA target sequence
gatgcaggtcttgcaatttgc

SEQ ID NO: 45563 - DNA, 21 bp, Artificial sequence
  SiRNA target sequence
atgcaggtcttgcaatttgca

SEQ ID NO: 45564 - DNA, 21 bp, Artificial sequence
  SiRNA target sequence
tgcaggtcttgcaatttgcaa

SEQ ID NO: 45565 - DNA, 21 bp, Artificial sequence
  SiRNA target sequence
gcaggtcttgcaatttgcaag

SEQ ID NO: 45566 - DNA, 21 bp, Artificial sequence
  SiRNA target sequence
caggtcttgcaatttgcaaga

SEQ ID NO: 45567 - DNA, 21 bp, Artificial sequence
  SiRNA target sequence
aggtcttgcaatttgcaagac

SEQ ID NO: 45568 - DNA, 21 bp, Artificial sequence
  SiRNA target sequence
ggtcttgcaatttgcaagact

SEQ ID NO: 45569 - DNA, 21 bp, Artificial sequence
  SiRNA target sequence
gtcttgcaatttgcaagactt

SEQ ID NO: 45570 - DNA, 21 bp, Artificial sequence
  SiRNA target sequence
tcttgcaatttgcaagacttg

SEQ ID NO: 45571 - DNA, 21 bp, Artificial sequence
  SiRNA target sequence
cttgcaatttgcaagacttgg

SEQ ID NO: 45572 - DNA, 21 bp, Artificial sequence
  SiRNA target sequence
ttgcaatttgcaagacttgga

SEQ ID NO: 45573 - DNA, 21 bp, Artificial sequence
  SiRNA target sequence
tgcaatttgcaagacttggat

SEQ ID NO: 45574 - DNA, 21 bp, Artificial sequence
  SiRNA target sequence
gcaatttgcaagacttggatt

SEQ ID NO: 45575 - DNA, 21 bp, Artificial sequence
  SiRNA target sequence
caatttgcaagacttggattg

SEQ ID NO: 45576 - DNA, 21 bp, Artificial sequence
  SiRNA target sequence
aatttgcaagacttggattga

SEQ ID NO: 45577 - DNA, 21 bp, Artificial sequence
  SiRNA target sequence
atttgcaagacttggattgaa

SEQ ID NO: 45578 - DNA, 21 bp, Artificial sequence
  SiRNA target sequence
tttgcaagacttggattgaag

SEQ ID NO: 45579 - DNA, 21 bp, Artificial sequence
  SiRNA target sequence
ttgcaagacttggattgaaga

SEQ ID NO: 45580 - DNA, 21 bp, Artificial sequence
  SiRNA target sequence
tgcaagacttggattgaagaa

SEQ ID NO: 45581 - DNA, 21 bp, Artificial sequence
  SiRNA target sequence
gcaagacttggattgaagaaa

SEQ ID NO: 45582 - DNA, 21 bp, Artificial sequence
  SiRNA target sequence
caagacttggattgaagaaac

SEQ ID NO: 45583 - DNA, 21 bp, Artificial sequence
  SiRNA target sequence
aagacttggattgaagaaact

SEQ ID NO: 45584 - DNA, 21 bp, Artificial sequence
  SiRNA target sequence
agacttggattgaagaaactg

SEQ ID NO: 45585 - DNA, 21 bp, Artificial sequence
  SiRNA target sequence
gacttggattgaagaaactgt

SEQ ID NO: 45586 - DNA, 21 bp, Artificial sequence
  SiRNA target sequence
acttggattgaagaaactgtc

SEQ ID NO: 45587 - DNA, 21 bp, Artificial sequence
  SiRNA target sequence
cttggattgaagaaactgtca

SEQ ID NO: 45588 - DNA, 21 bp, Artificial sequence
  SiRNA target sequence
ttggattgaagaaactgtcaa

SEQ ID NO: 45589 - DNA, 21 bp, Artificial sequence
  SiRNA target sequence
tggattgaagaaactgtcaaa

SEQ ID NO: 45590 - DNA, 21 bp, Artificial sequence
  SiRNA target sequence
ggattgaagaaactgtcaaat

SEQ ID NO: 45591 - DNA, 21 bp, Artificial sequence
  SiRNA target sequence
gattgaagaaactgtcaaata

SEQ ID NO: 45592 - DNA, 21 bp, Artificial sequence
  SiRNA target sequence
attgaagaaactgtcaaatat

SEQ ID NO: 45593 - DNA, 21 bp, Artificial sequence
  SiRNA target sequence
ttgaagaaactgtcaaatatg

SEQ ID NO: 45594 - DNA, 21 bp, Artificial sequence
  SiRNA target sequence
tgaagaaactgtcaaatatgt

SEQ ID NO: 45595 - DNA, 21 bp, Artificial sequence
  SiRNA target sequence
gaagaaactgtcaaatatgtg

SEQ ID NO: 45596 - DNA, 21 bp, Artificial sequence
  SiRNA target sequence
aagaaactgtcaaatatgtgc

SEQ ID NO: 45597 - DNA, 21 bp, Artificial sequence
  SiRNA target sequence
agaaactgtcaaatatgtgca

SEQ ID NO: 45598 - DNA, 21 bp, Artificial sequence
  SiRNA target sequence
gaaactgtcaaatatgtgcag

SEQ ID NO: 45599 - DNA, 21 bp, Artificial sequence
  SiRNA target sequence
aaactgtcaaatatgtgcagg

SEQ ID NO: 45600 - DNA, 21 bp, Artificial sequence
  SiRNA target sequence
aactgtcaaatatgtgcagga

SEQ ID NO: 45601 - DNA, 21 bp, Artificial sequence
  SiRNA target sequence
actgtcaaatatgtgcaggaa

SEQ ID NO: 45602 - DNA, 21 bp, Artificial sequence
  SiRNA target sequence
ctgtcaaatatgtgcaggaac

SEQ ID NO: 45603 - DNA, 21 bp, Artificial sequence
  SiRNA target sequence
tgtcaaatatgtgcaggaaca

SEQ ID NO: 45604 - DNA, 21 bp, Artificial sequence
  SiRNA target sequence
gtcaaatatgtgcaggaacac

SEQ ID NO: 45605 - DNA, 21 bp, Artificial sequence
  SiRNA target sequence
tcaaatatgtgcaggaacacc

SEQ ID NO: 45606 - DNA, 21 bp, Artificial sequence
  SiRNA target sequence
caaatatgtgcaggaacaccc

SEQ ID NO: 45607 - DNA, 21 bp, Artificial sequence
  SiRNA target sequence
aaatatgtgcaggaacaccct

SEQ ID NO: 45608 - DNA, 21 bp, Artificial sequence
  SiRNA target sequence
aatatgtgcaggaacaccctt

SEQ ID NO: 45609 - DNA, 21 bp, Artificial sequence
  SiRNA target sequence
atatgtgcaggaacacccttg

SEQ ID NO: 45610 - DNA, 21 bp, Artificial sequence
  SiRNA target sequence
tatgtgcaggaacacccttgg

SEQ ID NO: 45611 - DNA, 21 bp, Artificial sequence
  SiRNA target sequence
atgtgcaggaacacccttgga

SEQ ID NO: 45612 - DNA, 21 bp, Artificial sequence
  SiRNA target sequence
tgtgcaggaacacccttggac

SEQ ID NO: 45613 - DNA, 21 bp, Artificial sequence
  SiRNA target sequence
gtgcaggaacacccttggacc

SEQ ID NO: 45614 - DNA, 21 bp, Artificial sequence
  SiRNA target sequence
tgcaggaacacccttggacca

SEQ ID NO: 45615 - DNA, 21 bp, Artificial sequence
  SiRNA target sequence
gcaggaacacccttggaccac

SEQ ID NO: 45616 - DNA, 21 bp, Artificial sequence
  SiRNA target sequence
caggaacacccttggaccaca

SEQ ID NO: 45617 - DNA, 21 bp, Artificial sequence
  SiRNA target sequence
aggaacacccttggaccacag

SEQ ID NO: 45618 - DNA, 21 bp, Artificial sequence
  SiRNA target sequence
ggaacacccttggaccacagc

SEQ ID NO: 45619 - DNA, 21 bp, Artificial sequence
  SiRNA target sequence
gaacacccttggaccacagca

SEQ ID NO: 45620 - DNA, 21 bp, Artificial sequence
  SiRNA target sequence
aacacccttggaccacagcaa

SEQ ID NO: 45621 - DNA, 21 bp, Artificial sequence
  SiRNA target sequence
acacccttggaccacagcaat

SEQ ID NO: 45622 - DNA, 21 bp, Artificial sequence
  SiRNA target sequence
cacccttggaccacagcaatg

SEQ ID NO: 45623 - DNA, 21 bp, Artificial sequence
  SiRNA target sequence
acccttggaccacagcaatgg

SEQ ID NO: 45624 - DNA, 21 bp, Artificial sequence
  SiRNA target sequence
cccttggaccacagcaatggc

SEQ ID NO: 45625 - DNA, 21 bp, Artificial sequence
  SiRNA target sequence
ccttggaccacagcaatggcc

SEQ ID NO: 45626 - DNA, 21 bp, Artificial sequence
  SiRNA target sequence
cttggaccacagcaatggcca

SEQ ID NO: 45627 - DNA, 21 bp, Artificial sequence
  SiRNA target sequence
ttggaccacagcaatggccat

SEQ ID NO: 45628 - DNA, 21 bp, Artificial sequence
  SiRNA target sequence
tggaccacagcaatggccatt

SEQ ID NO: 45629 - DNA, 21 bp, Artificial sequence
  SiRNA target sequence
ggaccacagcaatggccattt

SEQ ID NO: 45630 - DNA, 21 bp, Artificial sequence
  SiRNA target sequence
gaccacagcaatggccatttt

SEQ ID NO: 45631 - DNA, 21 bp, Artificial sequence
  SiRNA target sequence
accacagcaatggccatttta

SEQ ID NO: 45632 - DNA, 21 bp, Artificial sequence
  SiRNA target sequence
ccacagcaatggccattttag

SEQ ID NO: 45633 - DNA, 21 bp, Artificial sequence
  SiRNA target sequence
cacagcaatggccattttagg

SEQ ID NO: 45634 - DNA, 21 bp, Artificial sequence
  SiRNA target sequence
acagcaatggccattttagga

SEQ ID NO: 45635 - DNA, 21 bp, Artificial sequence
  SiRNA target sequence
cagcaatggccattttaggaa

SEQ ID NO: 45636 - DNA, 21 bp, Artificial sequence
  SiRNA target sequence
agcaatggccattttaggaac

SEQ ID NO: 45637 - DNA, 21 bp, Artificial sequence
  SiRNA target sequence
gcaatggccattttaggaacc

SEQ ID NO: 45638 - DNA, 21 bp, Artificial sequence
  SiRNA target sequence
caatggccattttaggaaccc

SEQ ID NO: 45639 - DNA, 21 bp, Artificial sequence
  SiRNA target sequence
aatggccattttaggaaccct

SEQ ID NO: 45640 - DNA, 21 bp, Artificial sequence
  SiRNA target sequence
atggccattttaggaacccta

SEQ ID NO: 45641 - DNA, 21 bp, Artificial sequence
  SiRNA target sequence
tggccattttaggaaccctat

SEQ ID NO: 45642 - DNA, 21 bp, Artificial sequence
  SiRNA target sequence
ggccattttaggaaccctatt

SEQ ID NO: 45643 - DNA, 21 bp, Artificial sequence
  SiRNA target sequence
gccattttaggaaccctatta

SEQ ID NO: 45644 - DNA, 21 bp, Artificial sequence
  SiRNA target sequence
ccattttaggaaccctattag

SEQ ID NO: 45645 - DNA, 21 bp, Artificial sequence
  SiRNA target sequence
cattttaggaaccctattagg

SEQ ID NO: 45646 - DNA, 21 bp, Artificial sequence
  SiRNA target sequence
attttaggaaccctattaggt

SEQ ID NO: 45647 - DNA, 21 bp, Artificial sequence
  SiRNA target sequence
ttttaggaaccctattaggta

SEQ ID NO: 45648 - DNA, 21 bp, Artificial sequence
  SiRNA target sequence
tttaggaaccctattaggtat

SEQ ID NO: 45649 - DNA, 21 bp, Artificial sequence
  SiRNA target sequence
ttaggaaccctattaggtatt

SEQ ID NO: 45650 - DNA, 21 bp, Artificial sequence
  SiRNA target sequence
taggaaccctattaggtattc

SEQ ID NO: 45651 - DNA, 21 bp, Artificial sequence
  SiRNA target sequence
aggaaccctattaggtattct

SEQ ID NO: 45652 - DNA, 21 bp, Artificial sequence
  SiRNA target sequence
ggaaccctattaggtattctt

SEQ ID NO: 45653 - DNA, 21 bp, Artificial sequence
  SiRNA target sequence
gaaccctattaggtattctta

SEQ ID NO: 45654 - DNA, 21 bp, Artificial sequence
  SiRNA target sequence
aaccctattaggtattcttac

SEQ ID NO: 45655 - DNA, 21 bp, Artificial sequence
  SiRNA target sequence
accctattaggtattcttacc

SEQ ID NO: 45656 - DNA, 21 bp, Artificial sequence
  SiRNA target sequence
ccctattaggtattcttaccg

SEQ ID NO: 45657 - DNA, 21 bp, Artificial sequence
  SiRNA target sequence
cctattaggtattcttaccgt

SEQ ID NO: 45658 - DNA, 21 bp, Artificial sequence
  SiRNA target sequence
ctattaggtattcttaccgta

SEQ ID NO: 45659 - DNA, 21 bp, Artificial sequence
  SiRNA target sequence
tattaggtattcttaccgtag

SEQ ID NO: 45660 - DNA, 21 bp, Artificial sequence
  SiRNA target sequence
attaggtattcttaccgtagt

SEQ ID NO: 45661 - DNA, 21 bp, Artificial sequence
  SiRNA target sequence
ttaggtattcttaccgtagta

SEQ ID NO: 45662 - DNA, 21 bp, Artificial sequence
  SiRNA target sequence
taggtattcttaccgtagtag

SEQ ID NO: 45663 - DNA, 21 bp, Artificial sequence
  SiRNA target sequence
aggtattcttaccgtagtagg

SEQ ID NO: 45664 - DNA, 21 bp, Artificial sequence
  SiRNA target sequence
ggtattcttaccgtagtagga

SEQ ID NO: 45665 - DNA, 21 bp, Artificial sequence
  SiRNA target sequence
gtattcttaccgtagtaggat

SEQ ID NO: 45666 - DNA, 21 bp, Artificial sequence
  SiRNA target sequence
tattcttaccgtagtaggatt

SEQ ID NO: 45667 - DNA, 21 bp, Artificial sequence
  SiRNA target sequence
attcttaccgtagtaggattt

SEQ ID NO: 45668 - DNA, 21 bp, Artificial sequence
  SiRNA target sequence
ttcttaccgtagtaggatttt

SEQ ID NO: 45669 - DNA, 21 bp, Artificial sequence
  SiRNA target sequence
tcttaccgtagtaggattttg

SEQ ID NO: 45670 - DNA, 21 bp, Artificial sequence
  SiRNA target sequence
cttaccgtagtaggattttgg

SEQ ID NO: 45671 - DNA, 21 bp, Artificial sequence
  SiRNA target sequence
ttaccgtagtaggattttgga

SEQ ID NO: 45672 - DNA, 21 bp, Artificial sequence
  SiRNA target sequence
taccgtagtaggattttggaa

SEQ ID NO: 45673 - DNA, 21 bp, Artificial sequence
  SiRNA target sequence
accgtagtaggattttggaaa

SEQ ID NO: 45674 - DNA, 21 bp, Artificial sequence
  SiRNA target sequence
ccgtagtaggattttggaaat

SEQ ID NO: 45675 - DNA, 21 bp, Artificial sequence
  SiRNA target sequence
cgtagtaggattttggaaatg

SEQ ID NO: 45676 - DNA, 21 bp, Artificial sequence
  SiRNA target sequence
gtagtaggattttggaaatgg

SEQ ID NO: 45677 - DNA, 21 bp, Artificial sequence
  SiRNA target sequence
tagtaggattttggaaatggc

SEQ ID NO: 45678 - DNA, 21 bp, Artificial sequence
  SiRNA target sequence
agtaggattttggaaatggct

SEQ ID NO: 45679 - DNA, 21 bp, Artificial sequence
  SiRNA target sequence
gtaggattttggaaatggctt

SEQ ID NO: 45680 - DNA, 21 bp, Artificial sequence
  SiRNA target sequence
taggattttggaaatggcttt

SEQ ID NO: 45681 - DNA, 21 bp, Artificial sequence
  SiRNA target sequence
aggattttggaaatggctttg

SEQ ID NO: 45682 - DNA, 21 bp, Artificial sequence
  SiRNA target sequence
ggattttggaaatggctttgc

SEQ ID NO: 45683 - DNA, 21 bp, Artificial sequence
  SiRNA target sequence
gattttggaaatggctttgca

SEQ ID NO: 45684 - DNA, 21 bp, Artificial sequence
  SiRNA target sequence
attttggaaatggctttgcag

SEQ ID NO: 45685 - DNA, 21 bp, Artificial sequence
  SiRNA target sequence
ttttggaaatggctttgcagt

SEQ ID NO: 45686 - DNA, 21 bp, Artificial sequence
  SiRNA target sequence
tttggaaatggctttgcagtg

SEQ ID NO: 45687 - DNA, 21 bp, Artificial sequence
  SiRNA target sequence
ttggaaatggctttgcagtgg

SEQ ID NO: 45688 - DNA, 21 bp, Artificial sequence
  SiRNA target sequence
tggaaatggctttgcagtgga

SEQ ID NO: 45689 - DNA, 21 bp, Artificial sequence
  SiRNA target sequence
ggaaatggctttgcagtggag

SEQ ID NO: 45690 - DNA, 21 bp, Artificial sequence
  SiRNA target sequence
gaaatggctttgcagtggaga

SEQ ID NO: 45691 - DNA, 21 bp, Artificial sequence
  SiRNA target sequence
aaatggctttgcagtggagaa

SEQ ID NO: 45692 - DNA, 21 bp, Artificial sequence
  SiRNA target sequence
aatggctttgcagtggagaaa

SEQ ID NO: 45693 - DNA, 21 bp, Artificial sequence
  SiRNA target sequence
atggctttgcagtggagaaaa

SEQ ID NO: 45694 - DNA, 21 bp, Artificial sequence
  SiRNA target sequence
tggctttgcagtggagaaaag

SEQ ID NO: 45695 - DNA, 21 bp, Artificial sequence
  SiRNA target sequence
ggctttgcagtggagaaaaga

SEQ ID NO: 45696 - DNA, 21 bp, Artificial sequence
  SiRNA target sequence
gctttgcagtggagaaaagaa

SEQ ID NO: 45697 - DNA, 21 bp, Artificial sequence
  SiRNA target sequence
ctttgcagtggagaaaagaag

SEQ ID NO: 45698 - DNA, 21 bp, Artificial sequence
  SiRNA target sequence
tttgcagtggagaaaagaaga

SEQ ID NO: 45699 - DNA, 21 bp, Artificial sequence
  SiRNA target sequence
ttgcagtggagaaaagaagaa

SEQ ID NO: 45700 - DNA, 21 bp, Artificial sequence
  SiRNA target sequence
tgcagtggagaaaagaagaaa

SEQ ID NO: 45701 - DNA, 21 bp, Artificial sequence
  SiRNA target sequence
gcagtggagaaaagaagaaac

SEQ ID NO: 45702 - DNA, 21 bp, Artificial sequence
  SiRNA target sequence
cagtggagaaaagaagaaacc

SEQ ID NO: 45703 - DNA, 21 bp, Artificial sequence
  SiRNA target sequence
agtggagaaaagaagaaacca

SEQ ID NO: 45704 - DNA, 21 bp, Artificial sequence
  SiRNA target sequence
gtggagaaaagaagaaaccac

SEQ ID NO: 45705 - DNA, 21 bp, Artificial sequence
  SiRNA target sequence
tggagaaaagaagaaaccaca

SEQ ID NO: 45706 - DNA, 21 bp, Artificial sequence
  SiRNA target sequence
ggagaaaagaagaaaccacaa

SEQ ID NO: 45707 - DNA, 21 bp, Artificial sequence
  SiRNA target sequence
gagaaaagaagaaaccacaag

SEQ ID NO: 45708 - DNA, 21 bp, Artificial sequence
  SiRNA target sequence
agaaaagaagaaaccacaagc

SEQ ID NO: 45709 - DNA, 21 bp, Artificial sequence
  SiRNA target sequence
gaaaagaagaaaccacaagct

SEQ ID NO: 45710 - DNA, 21 bp, Artificial sequence
  SiRNA target sequence
aaaagaagaaaccacaagcta

SEQ ID NO: 45711 - DNA, 21 bp, Artificial sequence
  SiRNA target sequence
aaagaagaaaccacaagctac

SEQ ID NO: 45712 - DNA, 21 bp, Artificial sequence
  SiRNA target sequence
aagaagaaaccacaagctaca

SEQ ID NO: 45713 - DNA, 21 bp, Artificial sequence
  SiRNA target sequence
agaagaaaccacaagctacaa

SEQ ID NO: 45714 - DNA, 21 bp, Artificial sequence
  SiRNA target sequence
gaagaaaccacaagctacaaa

SEQ ID NO: 45715 - DNA, 21 bp, Artificial sequence
  SiRNA target sequence
aagaaaccacaagctacaaaa

SEQ ID NO: 45716 - DNA, 21 bp, Artificial sequence
  SiRNA target sequence
agaaaccacaagctacaaaac

SEQ ID NO: 45717 - DNA, 21 bp, Artificial sequence
  SiRNA target sequence
gaaaccacaagctacaaaacg

SEQ ID NO: 45718 - DNA, 21 bp, Artificial sequence
  SiRNA target sequence
aaaccacaagctacaaaacga

SEQ ID NO: 45719 - DNA, 21 bp, Artificial sequence
  SiRNA target sequence
aaccacaagctacaaaacgac

SEQ ID NO: 45720 - DNA, 21 bp, Artificial sequence
  SiRNA target sequence
accacaagctacaaaacgaca

SEQ ID NO: 45721 - DNA, 21 bp, Artificial sequence
  SiRNA target sequence
ccacaagctacaaaacgacat

SEQ ID NO: 45722 - DNA, 21 bp, Artificial sequence
  SiRNA target sequence
cacaagctacaaaacgacatt

SEQ ID NO: 45723 - DNA, 21 bp, Artificial sequence
  SiRNA target sequence
acaagctacaaaacgacattt

SEQ ID NO: 45724 - DNA, 21 bp, Artificial sequence
  SiRNA target sequence
caagctacaaaacgacatttt

SEQ ID NO: 45725 - DNA, 21 bp, Artificial sequence
  SiRNA target sequence
aagctacaaaacgacattttg

SEQ ID NO: 45726 - DNA, 21 bp, Artificial sequence
  SiRNA target sequence
agctacaaaacgacattttgt

SEQ ID NO: 45727 - DNA, 21 bp, Artificial sequence
  SiRNA target sequence
gctacaaaacgacattttgtc

SEQ ID NO: 45728 - DNA, 21 bp, Artificial sequence
  SiRNA target sequence
ctacaaaacgacattttgtca

SEQ ID NO: 45729 - DNA, 21 bp, Artificial sequence
  SiRNA target sequence
tacaaaacgacattttgtcaa

SEQ ID NO: 45730 - DNA, 21 bp, Artificial sequence
  SiRNA target sequence
acaaaacgacattttgtcaat

SEQ ID NO: 45731 - DNA, 21 bp, Artificial sequence
  SiRNA target sequence
caaaacgacattttgtcaata

SEQ ID NO: 45732 - DNA, 21 bp, Artificial sequence
  SiRNA target sequence
aaaacgacattttgtcaatac

SEQ ID NO: 45733 - DNA, 21 bp, Artificial sequence
  SiRNA target sequence
aaacgacattttgtcaatact

SEQ ID NO: 45734 - DNA, 21 bp, Artificial sequence
  SiRNA target sequence
aacgacattttgtcaatactg

SEQ ID NO: 45735 - DNA, 21 bp, Artificial sequence
  SiRNA target sequence
acgacattttgtcaatactgg

SEQ ID NO: 45736 - DNA, 21 bp, Artificial sequence
  SiRNA target sequence
cgacattttgtcaatactggt

SEQ ID NO: 45737 - DNA, 21 bp, Artificial sequence
  SiRNA target sequence
gacattttgtcaatactggtg

SEQ ID NO: 45738 - DNA, 21 bp, Artificial sequence
  SiRNA target sequence
acattttgtcaatactggtgt

SEQ ID NO: 45739 - DNA, 21 bp, Artificial sequence
  SiRNA target sequence
cattttgtcaatactggtgtg

SEQ ID NO: 45740 - DNA, 21 bp, Artificial sequence
  SiRNA target sequence
attttgtcaatactggtgtga

SEQ ID NO: 45741 - DNA, 21 bp, Artificial sequence
  SiRNA target sequence
ttttgtcaatactggtgtgac

SEQ ID NO: 45742 - DNA, 21 bp, Artificial sequence
  SiRNA target sequence
tttgtcaatactggtgtgact

SEQ ID NO: 45743 - DNA, 21 bp, Artificial sequence
  SiRNA target sequence
ttgtcaatactggtgtgactc

SEQ ID NO: 45744 - DNA, 21 bp, Artificial sequence
  SiRNA target sequence
tgtcaatactggtgtgactct

SEQ ID NO: 45745 - DNA, 21 bp, Artificial sequence
  SiRNA target sequence
gtcaatactggtgtgactctt

SEQ ID NO: 45746 - DNA, 21 bp, Artificial sequence
  SiRNA target sequence
tcaatactggtgtgactcttg

SEQ ID NO: 45747 - DNA, 21 bp, Artificial sequence
  SiRNA target sequence
caatactggtgtgactcttgt

SEQ ID NO: 45748 - DNA, 21 bp, Artificial sequence
  SiRNA target sequence
aatactggtgtgactcttgtc

SEQ ID NO: 45749 - DNA, 21 bp, Artificial sequence
  SiRNA target sequence
atactggtgtgactcttgtca

SEQ ID NO: 45750 - DNA, 21 bp, Artificial sequence
  SiRNA target sequence
tactggtgtgactcttgtcat

SEQ ID NO: 45751 - DNA, 21 bp, Artificial sequence
  SiRNA target sequence
actggtgtgactcttgtcata

SEQ ID NO: 45752 - DNA, 21 bp, Artificial sequence
  SiRNA target sequence
ctggtgtgactcttgtcatac

SEQ ID NO: 45753 - DNA, 21 bp, Artificial sequence
  SiRNA target sequence
tggtgtgactcttgtcatacc

SEQ ID NO: 45754 - DNA, 21 bp, Artificial sequence
  SiRNA target sequence
ggtgtgactcttgtcatacca

SEQ ID NO: 45755 - DNA, 21 bp, Artificial sequence
  SiRNA target sequence
gtgtgactcttgtcataccac

SEQ ID NO: 45756 - DNA, 21 bp, Artificial sequence
  SiRNA target sequence
tgtgactcttgtcataccaca

SEQ ID NO: 45757 - DNA, 21 bp, Artificial sequence
  SiRNA target sequence
gtgactcttgtcataccacat

SEQ ID NO: 45758 - DNA, 21 bp, Artificial sequence
  SiRNA target sequence
tgactcttgtcataccacatc

SEQ ID NO: 45759 - DNA, 21 bp, Artificial sequence
  SiRNA target sequence
gactcttgtcataccacatcg

SEQ ID NO: 45760 - DNA, 21 bp, Artificial sequence
  SiRNA target sequence
actcttgtcataccacatcga

SEQ ID NO: 45761 - DNA, 21 bp, Artificial sequence
  SiRNA target sequence
ctcttgtcataccacatcgag

SEQ ID NO: 45762 - DNA, 21 bp, Artificial sequence
  SiRNA target sequence
tcttgtcataccacatcgaga

SEQ ID NO: 45763 - DNA, 21 bp, Artificial sequence
  SiRNA target sequence
cttgtcataccacatcgagac

SEQ ID NO: 45764 - DNA, 21 bp, Artificial sequence
  SiRNA target sequence
ttgtcataccacatcgagacc

SEQ ID NO: 45765 - DNA, 21 bp, Artificial sequence
  SiRNA target sequence
tgtcataccacatcgagacct

SEQ ID NO: 45766 - DNA, 21 bp, Artificial sequence
  SiRNA target sequence
gtcataccacatcgagacctc

SEQ ID NO: 45767 - DNA, 21 bp, Artificial sequence
  SiRNA target sequence
tcataccacatcgagacctca

SEQ ID NO: 45768 - DNA, 21 bp, Artificial sequence
  SiRNA target sequence
cataccacatcgagacctcaa

SEQ ID NO: 45769 - DNA, 21 bp, Artificial sequence
  SiRNA target sequence
ataccacatcgagacctcaat

SEQ ID NO: 45770 - DNA, 21 bp, Artificial sequence
  SiRNA target sequence
taccacatcgagacctcaata

SEQ ID NO: 45771 - DNA, 21 bp, Artificial sequence
  SiRNA target sequence
accacatcgagacctcaataa

SEQ ID NO: 45772 - DNA, 21 bp, Artificial sequence
  SiRNA target sequence
ccacatcgagacctcaataag

SEQ ID NO: 45773 - DNA, 21 bp, Artificial sequence
  SiRNA target sequence
cacatcgagacctcaataagt

SEQ ID NO: 45774 - DNA, 21 bp, Artificial sequence
  SiRNA target sequence
acatcgagacctcaataagtt

SEQ ID NO: 45775 - DNA, 21 bp, Artificial sequence
  SiRNA target sequence
catcgagacctcaataagttt

SEQ ID NO: 45776 - DNA, 21 bp, Artificial sequence
  SiRNA target sequence
atcgagacctcaataagtttt

SEQ ID NO: 45777 - DNA, 21 bp, Artificial sequence
  SiRNA target sequence
tcgagacctcaataagttttg

SEQ ID NO: 45778 - DNA, 21 bp, Artificial sequence
  SiRNA target sequence
cgagacctcaataagttttgg

SEQ ID NO: 45779 - DNA, 21 bp, Artificial sequence
  SiRNA target sequence
gagacctcaataagttttggc

SEQ ID NO: 45780 - DNA, 21 bp, Artificial sequence
  SiRNA target sequence
agacctcaataagttttggca

SEQ ID NO: 45781 - DNA, 21 bp, Artificial sequence
  SiRNA target sequence
gacctcaataagttttggcag

SEQ ID NO: 45782 - DNA, 21 bp, Artificial sequence
  SiRNA target sequence
acctcaataagttttggcagt

SEQ ID NO: 45783 - DNA, 21 bp, Artificial sequence
  SiRNA target sequence
cctcaataagttttggcagtt

SEQ ID NO: 45784 - DNA, 21 bp, Artificial sequence
  SiRNA target sequence
ctcaataagttttggcagttg

SEQ ID NO: 45785 - DNA, 21 bp, Artificial sequence
  SiRNA target sequence
tcaataagttttggcagttgg

SEQ ID NO: 45786 - DNA, 21 bp, Artificial sequence
  SiRNA target sequence
caataagttttggcagttgga

SEQ ID NO: 45787 - DNA, 21 bp, Artificial sequence
  SiRNA target sequence
aataagttttggcagttggat

SEQ ID NO: 45788 - DNA, 21 bp, Artificial sequence
  SiRNA target sequence
ataagttttggcagttggatg

SEQ ID NO: 45789 - DNA, 21 bp, Artificial sequence
  SiRNA target sequence
taagttttggcagttggatga

SEQ ID NO: 45790 - DNA, 21 bp, Artificial sequence
  SiRNA target sequence
aagttttggcagttggatgaa

SEQ ID NO: 45791 - DNA, 21 bp, Artificial sequence
  SiRNA target sequence
agttttggcagttggatgaaa

SEQ ID NO: 45792 - DNA, 21 bp, Artificial sequence
  SiRNA target sequence
gttttggcagttggatgaaac

SEQ ID NO: 45793 - DNA, 21 bp, Artificial sequence
  SiRNA target sequence
ttttggcagttggatgaaaca

SEQ ID NO: 45794 - DNA, 21 bp, Artificial sequence
  SiRNA target sequence
tttggcagttggatgaaacat

SEQ ID NO: 45795 - DNA, 21 bp, Artificial sequence
  SiRNA target sequence
ttggcagttggatgaaacatt

SEQ ID NO: 45796 - DNA, 21 bp, Artificial sequence
  SiRNA target sequence
tggcagttggatgaaacatta

SEQ ID NO: 45797 - DNA, 21 bp, Artificial sequence
  SiRNA target sequence
ggcagttggatgaaacattag

SEQ ID NO: 45798 - DNA, 21 bp, Artificial sequence
  SiRNA target sequence
gcagttggatgaaacattaga

SEQ ID NO: 45799 - DNA, 21 bp, Artificial sequence
  SiRNA target sequence
cagttggatgaaacattagac

SEQ ID NO: 45800 - DNA, 21 bp, Artificial sequence
  SiRNA target sequence
agttggatgaaacattagacg

SEQ ID NO: 45801 - DNA, 21 bp, Artificial sequence
  SiRNA target sequence
gttggatgaaacattagacgt

SEQ ID NO: 45802 - DNA, 21 bp, Artificial sequence
  SiRNA target sequence
ttggatgaaacattagacgta

SEQ ID NO: 45803 - DNA, 21 bp, Artificial sequence
  SiRNA target sequence
tggatgaaacattagacgtat

SEQ ID NO: 45804 - DNA, 21 bp, Artificial sequence
  SiRNA target sequence
ggatgaaacattagacgtatc

SEQ ID NO: 45805 - DNA, 21 bp, Artificial sequence
  SiRNA target sequence
gatgaaacattagacgtatcc

SEQ ID NO: 45806 - DNA, 21 bp, Artificial sequence
  SiRNA target sequence
atgaaacattagacgtatcca

SEQ ID NO: 45807 - DNA, 21 bp, Artificial sequence
  SiRNA target sequence
tgaaacattagacgtatccaa

SEQ ID NO: 45808 - DNA, 21 bp, Artificial sequence
  SiRNA target sequence
gaaacattagacgtatccaac

SEQ ID NO: 45809 - DNA, 21 bp, Artificial sequence
  SiRNA target sequence
aaacattagacgtatccaaca

SEQ ID NO: 45810 - DNA, 21 bp, Artificial sequence
  SiRNA target sequence
aacattagacgtatccaacat

SEQ ID NO: 45811 - DNA, 21 bp, Artificial sequence
  SiRNA target sequence
acattagacgtatccaacatg

SEQ ID NO: 45812 - DNA, 21 bp, Artificial sequence
  SiRNA target sequence
cattagacgtatccaacatgc

SEQ ID NO: 45813 - DNA, 21 bp, Artificial sequence
  SiRNA target sequence
attagacgtatccaacatgcg

SEQ ID NO: 45814 - DNA, 21 bp, Artificial sequence
  SiRNA target sequence
ttagacgtatccaacatgcgt

SEQ ID NO: 45815 - DNA, 21 bp, Artificial sequence
  SiRNA target sequence
tagacgtatccaacatgcgtg

SEQ ID NO: 45816 - DNA, 21 bp, Artificial sequence
  SiRNA target sequence
agacgtatccaacatgcgtgt

SEQ ID NO: 45817 - DNA, 21 bp, Artificial sequence
  SiRNA target sequence
gacgtatccaacatgcgtgtt

SEQ ID NO: 45818 - DNA, 21 bp, Artificial sequence
  SiRNA target sequence
acgtatccaacatgcgtgttg

SEQ ID NO: 45819 - DNA, 21 bp, Artificial sequence
  SiRNA target sequence
cgtatccaacatgcgtgttgg

SEQ ID NO: 45820 - DNA, 21 bp, Artificial sequence
  SiRNA target sequence
gtatccaacatgcgtgttgga

SEQ ID NO: 45821 - DNA, 21 bp, Artificial sequence
  SiRNA target sequence
tatccaacatgcgtgttggag

SEQ ID NO: 45822 - DNA, 21 bp, Artificial sequence
  SiRNA target sequence
atccaacatgcgtgttggaga

SEQ ID NO: 45823 - DNA, 21 bp, Artificial sequence
  SiRNA target sequence
tccaacatgcgtgttggagat

SEQ ID NO: 45824 - DNA, 21 bp, Artificial sequence
  SiRNA target sequence
ccaacatgcgtgttggagatg

SEQ ID NO: 45825 - DNA, 21 bp, Artificial sequence
  SiRNA target sequence
caacatgcgtgttggagatgt

SEQ ID NO: 45826 - DNA, 21 bp, Artificial sequence
  SiRNA target sequence
aacatgcgtgttggagatgtt

SEQ ID NO: 45827 - DNA, 21 bp, Artificial sequence
  SiRNA target sequence
acatgcgtgttggagatgttg

SEQ ID NO: 45828 - DNA, 21 bp, Artificial sequence
  SiRNA target sequence
catgcgtgttggagatgttga

SEQ ID NO: 45829 - DNA, 21 bp, Artificial sequence
  SiRNA target sequence
atgcgtgttggagatgttgaa

SEQ ID NO: 45830 - DNA, 21 bp, Artificial sequence
  SiRNA target sequence
tgcgtgttggagatgttgaag

SEQ ID NO: 45831 - DNA, 21 bp, Artificial sequence
  SiRNA target sequence
gcgtgttggagatgttgaaga

SEQ ID NO: 45832 - DNA, 21 bp, Artificial sequence
  SiRNA target sequence
cgtgttggagatgttgaagat

SEQ ID NO: 45833 - DNA, 21 bp, Artificial sequence
  SiRNA target sequence
gtgttggagatgttgaagatc

SEQ ID NO: 45834 - DNA, 21 bp, Artificial sequence
  SiRNA target sequence
tgttggagatgttgaagatca

SEQ ID NO: 45835 - DNA, 21 bp, Artificial sequence
  SiRNA target sequence
gttggagatgttgaagatcat

SEQ ID NO: 45836 - DNA, 21 bp, Artificial sequence
  SiRNA target sequence
ttggagatgttgaagatcatc

SEQ ID NO: 45837 - DNA, 21 bp, Artificial sequence
  SiRNA target sequence
tggagatgttgaagatcatct

SEQ ID NO: 45838 - DNA, 21 bp, Artificial sequence
  SiRNA target sequence
ggagatgttgaagatcatctg

SEQ ID NO: 45839 - DNA, 21 bp, Artificial sequence
  SiRNA target sequence
gagatgttgaagatcatctgg

SEQ ID NO: 45840 - DNA, 21 bp, Artificial sequence
  SiRNA target sequence
agatgttgaagatcatctggc

SEQ ID NO: 45841 - DNA, 21 bp, Artificial sequence
  SiRNA target sequence
gatgttgaagatcatctggcg

SEQ ID NO: 45842 - DNA, 21 bp, Artificial sequence
  SiRNA target sequence
atgttgaagatcatctggcgg

SEQ ID NO: 45843 - DNA, 21 bp, Artificial sequence
  SiRNA target sequence
tgttgaagatcatctggcggc

SEQ ID NO: 45844 - DNA, 21 bp, Artificial sequence
  SiRNA target sequence
gttgaagatcatctggcggcc

SEQ ID NO: 45845 - DNA, 21 bp, Artificial sequence
  SiRNA target sequence
ttgaagatcatctggcggcct

SEQ ID NO: 45846 - DNA, 21 bp, Artificial sequence
  SiRNA target sequence
tgaagatcatctggcggcctt

SEQ ID NO: 45847 - DNA, 21 bp, Artificial sequence
  SiRNA target sequence
gaagatcatctggcggcctta

SEQ ID NO: 45848 - DNA, 21 bp, Artificial sequence
  SiRNA target sequence
aagatcatctggcggccttac

SEQ ID NO: 45849 - DNA, 21 bp, Artificial sequence
  SiRNA target sequence
agatcatctggcggccttact

SEQ ID NO: 45850 - DNA, 21 bp, Artificial sequence
  SiRNA target sequence
gatcatctggcggccttactt

SEQ ID NO: 45851 - DNA, 21 bp, Artificial sequence
  SiRNA target sequence
atcatctggcggccttactta

SEQ ID NO: 45852 - DNA, 21 bp, Artificial sequence
  SiRNA target sequence
tcatctggcggccttacttaa

SEQ ID NO: 45853 - DNA, 21 bp, Artificial sequence
  SiRNA target sequence
catctggcggccttacttaaa

SEQ ID NO: 45854 - DNA, 21 bp, Artificial sequence
  SiRNA target sequence
atctggcggccttacttaaac

SEQ ID NO: 45855 - DNA, 21 bp, Artificial sequence
  SiRNA target sequence
tctggcggccttacttaaacc

SEQ ID NO: 45856 - DNA, 21 bp, Artificial sequence
  SiRNA target sequence
ctggcggccttacttaaaccc

SEQ ID NO: 45857 - DNA, 21 bp, Artificial sequence
  SiRNA target sequence
tggcggccttacttaaaccca

SEQ ID NO: 45858 - DNA, 21 bp, Artificial sequence
  SiRNA target sequence
ggcggccttacttaaacccag

SEQ ID NO: 45859 - DNA, 21 bp, Artificial sequence
  SiRNA target sequence
gcggccttacttaaacccaga

SEQ ID NO: 45860 - DNA, 21 bp, Artificial sequence
  SiRNA target sequence
cggccttacttaaacccagac

SEQ ID NO: 45861 - DNA, 21 bp, Artificial sequence
  SiRNA target sequence
ggccttacttaaacccagaca

SEQ ID NO: 45862 - DNA, 21 bp, Artificial sequence
  SiRNA target sequence
gccttacttaaacccagacat

SEQ ID NO: 45863 - DNA, 21 bp, Artificial sequence
  SiRNA target sequence
ccttacttaaacccagacatc

SEQ ID NO: 45864 - DNA, 21 bp, Artificial sequence
  SiRNA target sequence
cttacttaaacccagacatcg

SEQ ID NO: 45865 - DNA, 21 bp, Artificial sequence
  SiRNA target sequence
ttacttaaacccagacatcgt

SEQ ID NO: 45866 - DNA, 21 bp, Artificial sequence
  SiRNA target sequence
tacttaaacccagacatcgtg

SEQ ID NO: 45867 - DNA, 21 bp, Artificial sequence
  SiRNA target sequence
acttaaacccagacatcgtgt

SEQ ID NO: 45868 - DNA, 21 bp, Artificial sequence
  SiRNA target sequence
cttaaacccagacatcgtgtt

SEQ ID NO: 45869 - DNA, 21 bp, Artificial sequence
  SiRNA target sequence
ttaaacccagacatcgtgttg

SEQ ID NO: 45870 - DNA, 21 bp, Artificial sequence
  SiRNA target sequence
taaacccagacatcgtgttgt

SEQ ID NO: 45871 - DNA, 21 bp, Artificial sequence
  SiRNA target sequence
aaacccagacatcgtgttgtc

SEQ ID NO: 45872 - DNA, 21 bp, Artificial sequence
  SiRNA target sequence
aacccagacatcgtgttgtca

SEQ ID NO: 45873 - DNA, 21 bp, Artificial sequence
  SiRNA target sequence
acccagacatcgtgttgtcat

SEQ ID NO: 45874 - DNA, 21 bp, Artificial sequence
  SiRNA target sequence
cccagacatcgtgttgtcatt

SEQ ID NO: 45875 - DNA, 21 bp, Artificial sequence
  SiRNA target sequence
ccagacatcgtgttgtcattg

SEQ ID NO: 45876 - DNA, 21 bp, Artificial sequence
  SiRNA target sequence
cagacatcgtgttgtcattgt

SEQ ID NO: 45877 - DNA, 21 bp, Artificial sequence
  SiRNA target sequence
agacatcgtgttgtcattgta

SEQ ID NO: 45878 - DNA, 21 bp, Artificial sequence
  SiRNA target sequence
gacatcgtgttgtcattgtac

SEQ ID NO: 45879 - DNA, 21 bp, Artificial sequence
  SiRNA target sequence
acatcgtgttgtcattgtacc

SEQ ID NO: 45880 - DNA, 21 bp, Artificial sequence
  SiRNA target sequence
catcgtgttgtcattgtacct

SEQ ID NO: 45881 - DNA, 21 bp, Artificial sequence
  SiRNA target sequence
atcgtgttgtcattgtaccta

SEQ ID NO: 45882 - DNA, 21 bp, Artificial sequence
  SiRNA target sequence
tcgtgttgtcattgtacctag

SEQ ID NO: 45883 - DNA, 21 bp, Artificial sequence
  SiRNA target sequence
cgtgttgtcattgtacctagg

SEQ ID NO: 45884 - DNA, 21 bp, Artificial sequence
  SiRNA target sequence
gtgttgtcattgtacctaggg

SEQ ID NO: 45885 - DNA, 21 bp, Artificial sequence
  SiRNA target sequence
tgttgtcattgtacctagggt

SEQ ID NO: 45886 - DNA, 21 bp, Artificial sequence
  SiRNA target sequence
gttgtcattgtacctagggtg

SEQ ID NO: 45887 - DNA, 21 bp, Artificial sequence
  SiRNA target sequence
ttgtcattgtacctagggtga

SEQ ID NO: 45888 - DNA, 21 bp, Artificial sequence
  SiRNA target sequence
tgtcattgtacctagggtgac

SEQ ID NO: 45889 - DNA, 21 bp, Artificial sequence
  SiRNA target sequence
gtcattgtacctagggtgact

SEQ ID NO: 45890 - DNA, 21 bp, Artificial sequence
  SiRNA target sequence
tcattgtacctagggtgacta

SEQ ID NO: 45891 - DNA, 21 bp, Artificial sequence
  SiRNA target sequence
cattgtacctagggtgactaa

SEQ ID NO: 45892 - DNA, 21 bp, Artificial sequence
  SiRNA target sequence
attgtacctagggtgactaaa

SEQ ID NO: 45893 - DNA, 21 bp, Artificial sequence
  SiRNA target sequence
ttgtacctagggtgactaaat

SEQ ID NO: 45894 - DNA, 21 bp, Artificial sequence
  SiRNA target sequence
tgtacctagggtgactaaatt

SEQ ID NO: 45895 - DNA, 21 bp, Artificial sequence
  SiRNA target sequence
gtacctagggtgactaaattc

SEQ ID NO: 45896 - DNA, 21 bp, Artificial sequence
  SiRNA target sequence
tacctagggtgactaaattca

SEQ ID NO: 45897 - DNA, 21 bp, Artificial sequence
  SiRNA target sequence
acctagggtgactaaattcat

SEQ ID NO: 45898 - DNA, 21 bp, Artificial sequence
  SiRNA target sequence
cctagggtgactaaattcatt

SEQ ID NO: 45899 - DNA, 21 bp, Artificial sequence
  SiRNA target sequence
ctagggtgactaaattcattt

SEQ ID NO: 45900 - DNA, 21 bp, Artificial sequence
  SiRNA target sequence
tagggtgactaaattcatttt

SEQ ID NO: 45901 - DNA, 21 bp, Artificial sequence
  SiRNA target sequence
agggtgactaaattcattttg

SEQ ID NO: 45902 - DNA, 21 bp, Artificial sequence
  SiRNA target sequence
gggtgactaaattcattttga

SEQ ID NO: 45903 - DNA, 21 bp, Artificial sequence
  SiRNA target sequence
ggtgactaaattcattttgag

SEQ ID NO: 45904 - DNA, 21 bp, Artificial sequence
  SiRNA target sequence
gtgactaaattcattttgagt

SEQ ID NO: 45905 - DNA, 21 bp, Artificial sequence
  SiRNA target sequence
tgactaaattcattttgagta

SEQ ID NO: 45906 - DNA, 21 bp, Artificial sequence
  SiRNA target sequence
gactaaattcattttgagtat

SEQ ID NO: 45907 - DNA, 21 bp, Artificial sequence
  SiRNA target sequence
actaaattcattttgagtatt

SEQ ID NO: 45908 - DNA, 21 bp, Artificial sequence
  SiRNA target sequence
ctaaattcattttgagtatta

SEQ ID NO: 45909 - DNA, 21 bp, Artificial sequence
  SiRNA target sequence
taaattcattttgagtattat

SEQ ID NO: 45910 - DNA, 21 bp, Artificial sequence
  SiRNA target sequence
aaattcattttgagtattatt

SEQ ID NO: 45911 - DNA, 21 bp, Artificial sequence
  SiRNA target sequence
aattcattttgagtattattg

SEQ ID NO: 45912 - DNA, 21 bp, Artificial sequence
  SiRNA target sequence
attcattttgagtattattga

SEQ ID NO: 45913 - DNA, 21 bp, Artificial sequence
  SiRNA target sequence
ttcattttgagtattattgat

SEQ ID NO: 45914 - DNA, 21 bp, Artificial sequence
  SiRNA target sequence
tcattttgagtattattgata

SEQ ID NO: 45915 - DNA, 21 bp, Artificial sequence
  SiRNA target sequence
cattttgagtattattgataa

SEQ ID NO: 45916 - DNA, 21 bp, Artificial sequence
  SiRNA target sequence
attttgagtattattgataac

SEQ ID NO: 45917 - DNA, 21 bp, Artificial sequence
  SiRNA target sequence
ttttgagtattattgataacc

SEQ ID NO: 45918 - DNA, 21 bp, Artificial sequence
  SiRNA target sequence
tttgagtattattgataacca

SEQ ID NO: 45919 - DNA, 21 bp, Artificial sequence
  SiRNA target sequence
ttgagtattattgataaccac

SEQ ID NO: 45920 - DNA, 21 bp, Artificial sequence
  SiRNA target sequence
tgagtattattgataaccact

SEQ ID NO: 45921 - DNA, 21 bp, Artificial sequence
  SiRNA target sequence
gagtattattgataaccactc

SEQ ID NO: 45922 - DNA, 21 bp, Artificial sequence
  SiRNA target sequence
agtattattgataaccactcg

SEQ ID NO: 45923 - DNA, 21 bp, Artificial sequence
  SiRNA target sequence
gtattattgataaccactcga

SEQ ID NO: 45924 - DNA, 21 bp, Artificial sequence
  SiRNA target sequence
tattattgataaccactcgaa

SEQ ID NO: 45925 - DNA, 21 bp, Artificial sequence
  SiRNA target sequence
attattgataaccactcgaaa

SEQ ID NO: 45926 - DNA, 21 bp, Artificial sequence
  SiRNA target sequence
ttattgataaccactcgaaac

SEQ ID NO: 45927 - DNA, 21 bp, Artificial sequence
  SiRNA target sequence
tattgataaccactcgaaact

SEQ ID NO: 45928 - DNA, 21 bp, Artificial sequence
  SiRNA target sequence
attgataaccactcgaaactc

SEQ ID NO: 45929 - DNA, 21 bp, Artificial sequence
  SiRNA target sequence
ttgataaccactcgaaactct

SEQ ID NO: 45930 - DNA, 21 bp, Artificial sequence
  SiRNA target sequence
tgataaccactcgaaactctt

SEQ ID NO: 45931 - DNA, 21 bp, Artificial sequence
  SiRNA target sequence
gataaccactcgaaactcttt

SEQ ID NO: 45932 - DNA, 21 bp, Artificial sequence
  SiRNA target sequence
ataaccactcgaaactctttg

SEQ ID NO: 45933 - DNA, 21 bp, Artificial sequence
  SiRNA target sequence
taaccactcgaaactctttga

SEQ ID NO: 45934 - DNA, 21 bp, Artificial sequence
  SiRNA target sequence
aaccactcgaaactctttgat

SEQ ID NO: 45935 - DNA, 21 bp, Artificial sequence
  SiRNA target sequence
accactcgaaactctttgata

SEQ ID NO: 45936 - DNA, 21 bp, Artificial sequence
  SiRNA target sequence
ccactcgaaactctttgataa

SEQ ID NO: 45937 - DNA, 21 bp, Artificial sequence
  SiRNA target sequence
cactcgaaactctttgataaa

SEQ ID NO: 45938 - DNA, 21 bp, Artificial sequence
  SiRNA target sequence
actcgaaactctttgataaaa

SEQ ID NO: 45939 - DNA, 21 bp, Artificial sequence
  SiRNA target sequence
ctcgaaactctttgataaaac

SEQ ID NO: 45940 - DNA, 21 bp, Artificial sequence
  SiRNA target sequence
tcgaaactctttgataaaacg

SEQ ID NO: 45941 - DNA, 21 bp, Artificial sequence
  SiRNA target sequence
cgaaactctttgataaaacga

SEQ ID NO: 45942 - DNA, 21 bp, Artificial sequence
  SiRNA target sequence
gaaactctttgataaaacgat

SEQ ID NO: 45943 - DNA, 21 bp, Artificial sequence
  SiRNA target sequence
aaactctttgataaaacgatt

SEQ ID NO: 45944 - DNA, 21 bp, Artificial sequence
  SiRNA target sequence
aactctttgataaaacgattt

SEQ ID NO: 45945 - DNA, 21 bp, Artificial sequence
  SiRNA target sequence
actctttgataaaacgatttt

SEQ ID NO: 45946 - DNA, 21 bp, Artificial sequence
  SiRNA target sequence
ctctttgataaaacgatttta

SEQ ID NO: 45947 - DNA, 21 bp, Artificial sequence
  SiRNA target sequence
tctttgataaaacgattttaa

SEQ ID NO: 45948 - DNA, 21 bp, Artificial sequence
  SiRNA target sequence
ctttgataaaacgattttaat

SEQ ID NO: 45949 - DNA, 21 bp, Artificial sequence
  SiRNA target sequence
tttgataaaacgattttaatt

SEQ ID NO: 45950 - DNA, 21 bp, Artificial sequence
  SiRNA target sequence
ttgataaaacgattttaatta

SEQ ID NO: 45951 - DNA, 21 bp, Artificial sequence
  SiRNA target sequence
tgataaaacgattttaattac

SEQ ID NO: 45952 - DNA, 21 bp, Artificial sequence
  SiRNA target sequence
gataaaacgattttaattacc

SEQ ID NO: 45953 - DNA, 21 bp, Artificial sequence
  SiRNA target sequence
ataaaacgattttaattacca

SEQ ID NO: 45954 - DNA, 21 bp, Artificial sequence
  SiRNA target sequence
taaaacgattttaattaccaa

SEQ ID NO: 45955 - DNA, 21 bp, Artificial sequence
  SiRNA target sequence
aaaacgattttaattaccaag

SEQ ID NO: 45956 - DNA, 21 bp, Artificial sequence
  SiRNA target sequence
aaacgattttaattaccaaga

SEQ ID NO: 45957 - DNA, 21 bp, Artificial sequence
  SiRNA target sequence
aacgattttaattaccaagaa

SEQ ID NO: 45958 - DNA, 21 bp, Artificial sequence
  SiRNA target sequence
acgattttaattaccaagaac

SEQ ID NO: 45959 - DNA, 21 bp, Artificial sequence
  SiRNA target sequence
cgattttaattaccaagaacc

SEQ ID NO: 45960 - DNA, 21 bp, Artificial sequence
  SiRNA target sequence
gattttaattaccaagaaccg

SEQ ID NO: 45961 - DNA, 21 bp, Artificial sequence
  SiRNA target sequence
attttaattaccaagaaccga

SEQ ID NO: 45962 - DNA, 21 bp, Artificial sequence
  SiRNA target sequence
ttttaattaccaagaaccgat

SEQ ID NO: 45963 - DNA, 21 bp, Artificial sequence
  SiRNA target sequence
tttaattaccaagaaccgatt

SEQ ID NO: 45964 - DNA, 21 bp, Artificial sequence
  SiRNA target sequence
ttaattaccaagaaccgattc

SEQ ID NO: 45965 - DNA, 21 bp, Artificial sequence
  SiRNA target sequence
taattaccaagaaccgattct

SEQ ID NO: 45966 - DNA, 21 bp, Artificial sequence
  SiRNA target sequence
aattaccaagaaccgattctt

SEQ ID NO: 45967 - DNA, 21 bp, Artificial sequence
  SiRNA target sequence
attaccaagaaccgattcttt

SEQ ID NO: 45968 - DNA, 21 bp, Artificial sequence
  SiRNA target sequence
ttaccaagaaccgattcttta

SEQ ID NO: 45969 - DNA, 21 bp, Artificial sequence
  SiRNA target sequence
taccaagaaccgattctttac

SEQ ID NO: 45970 - DNA, 21 bp, Artificial sequence
  SiRNA target sequence
accaagaaccgattctttact

SEQ ID NO: 45971 - DNA, 21 bp, Artificial sequence
  SiRNA target sequence
ccaagaaccgattctttactt

SEQ ID NO: 45972 - DNA, 21 bp, Artificial sequence
  SiRNA target sequence
caagaaccgattctttactta

SEQ ID NO: 45973 - DNA, 21 bp, Artificial sequence
  SiRNA target sequence
aagaaccgattctttacttat

SEQ ID NO: 45974 - DNA, 21 bp, Artificial sequence
  SiRNA target sequence
agaaccgattctttacttatg

SEQ ID NO: 45975 - DNA, 21 bp, Artificial sequence
  SiRNA target sequence
gaaccgattctttacttatga

SEQ ID NO: 45976 - DNA, 21 bp, Artificial sequence
  SiRNA target sequence
aaccgattctttacttatgaa

SEQ ID NO: 45977 - DNA, 21 bp, Artificial sequence
  SiRNA target sequence
accgattctttacttatgaaa

SEQ ID NO: 45978 - DNA, 21 bp, Artificial sequence
  SiRNA target sequence
ccgattctttacttatgaaaa

SEQ ID NO: 45979 - DNA, 21 bp, Artificial sequence
  SiRNA target sequence
cgattctttacttatgaaaat

SEQ ID NO: 45980 - DNA, 21 bp, Artificial sequence
  SiRNA target sequence
gattctttacttatgaaaata

SEQ ID NO: 45981 - DNA, 21 bp, Artificial sequence
  SiRNA target sequence
attctttacttatgaaaataa

SEQ ID NO: 45982 - DNA, 21 bp, Artificial sequence
  SiRNA target sequence
ttctttacttatgaaaataaa

SEQ ID NO: 45983 - DNA, 21 bp, Artificial sequence
  SiRNA target sequence
tctttacttatgaaaataaat

SEQ ID NO: 45984 - DNA, 21 bp, Artificial sequence
  SiRNA target sequence
ctttacttatgaaaataaata

SEQ ID NO: 45985 - DNA, 21 bp, Artificial sequence
  SiRNA target sequence
tttacttatgaaaataaatat

SEQ ID NO: 45986 - DNA, 21 bp, Artificial sequence
  SiRNA target sequence
ttacttatgaaaataaatata

SEQ ID NO: 45987 - DNA, 21 bp, Artificial sequence
  SiRNA target sequence
tacttatgaaaataaatatat

SEQ ID NO: 45988 - DNA, 21 bp, Artificial sequence
  SiRNA target sequence
acttatgaaaataaatatatt

SEQ ID NO: 45989 - DNA, 21 bp, Artificial sequence
  SiRNA target sequence
cttatgaaaataaatatattg

SEQ ID NO: 45990 - DNA, 21 bp, Artificial sequence
  SiRNA target sequence
ttatgaaaataaatatattga

SEQ ID NO: 45991 - DNA, 21 bp, Artificial sequence
  SiRNA target sequence
tatgaaaataaatatattgaa

SEQ ID NO: 45992 - DNA, 21 bp, Artificial sequence
  SiRNA target sequence
atgaaaataaatatattgaat

SEQ ID NO: 45993 - DNA, 21 bp, Artificial sequence
  SiRNA target sequence
tgaaaataaatatattgaatt

SEQ ID NO: 45994 - DNA, 21 bp, Artificial sequence
  SiRNA target sequence
gaaaataaatatattgaattg

SEQ ID NO: 45995 - DNA, 21 bp, Artificial sequence
  SiRNA target sequence
aaaataaatatattgaattgg

SEQ ID NO: 45996 - DNA, 21 bp, Artificial sequence
  SiRNA target sequence
aaataaatatattgaattggt

SEQ ID NO: 45997 - DNA, 21 bp, Artificial sequence
  SiRNA target sequence
aataaatatattgaattggtg

SEQ ID NO: 45998 - DNA, 21 bp, Artificial sequence
  SiRNA target sequence
ataaatatattgaattggtgt

SEQ ID NO: 45999 - DNA, 21 bp, Artificial sequence
  SiRNA target sequence
taaatatattgaattggtgtg

SEQ ID NO: 46000 - DNA, 21 bp, Artificial sequence
  SiRNA target sequence
aaatatattgaattggtgtgt

SEQ ID NO: 46001 - DNA, 21 bp, Artificial sequence
  SiRNA target sequence
aatatattgaattggtgtgtg

SEQ ID NO: 46002 - DNA, 21 bp, Artificial sequence
  SiRNA target sequence
atatattgaattggtgtgtgg

SEQ ID NO: 46003 - DNA, 21 bp, Artificial sequence
  SiRNA target sequence
tatattgaattggtgtgtggt

SEQ ID NO: 46004 - DNA, 21 bp, Artificial sequence
  SiRNA target sequence
atattgaattggtgtgtggtg

SEQ ID NO: 46005 - DNA, 21 bp, Artificial sequence
  SiRNA target sequence
tattgaattggtgtgtggtga

SEQ ID NO: 46006 - DNA, 21 bp, Artificial sequence
  SiRNA target sequence
attgaattggtgtgtggtgag

SEQ ID NO: 46007 - DNA, 21 bp, Artificial sequence
  SiRNA target sequence
ttgaattggtgtgtggtgaga

SEQ ID NO: 46008 - DNA, 21 bp, Artificial sequence
  SiRNA target sequence
tgaattggtgtgtggtgagat

SEQ ID NO: 46009 - DNA, 21 bp, Artificial sequence
  SiRNA target sequence
gaattggtgtgtggtgagatg

SEQ ID NO: 46010 - DNA, 21 bp, Artificial sequence
  SiRNA target sequence
aattggtgtgtggtgagatga

SEQ ID NO: 46011 - DNA, 21 bp, Artificial sequence
  SiRNA target sequence
attggtgtgtggtgagatgaa

SEQ ID NO: 46012 - DNA, 21 bp, Artificial sequence
  SiRNA target sequence
ttggtgtgtggtgagatgaat

SEQ ID NO: 46013 - DNA, 21 bp, Artificial sequence
  SiRNA target sequence
tggtgtgtggtgagatgaatc

SEQ ID NO: 46014 - DNA, 21 bp, Artificial sequence
  SiRNA target sequence
ggtgtgtggtgagatgaatcg

SEQ ID NO: 46015 - DNA, 21 bp, Artificial sequence
  SiRNA target sequence
gtgtgtggtgagatgaatcgt

SEQ ID NO: 46016 - DNA, 21 bp, Artificial sequence
  SiRNA target sequence
tgtgtggtgagatgaatcgtt

SEQ ID NO: 46017 - DNA, 21 bp, Artificial sequence
  SiRNA target sequence
gtgtggtgagatgaatcgttt

SEQ ID NO: 46018 - DNA, 21 bp, Artificial sequence
  SiRNA target sequence
tgtggtgagatgaatcgtttc

SEQ ID NO: 46019 - DNA, 21 bp, Artificial sequence
  SiRNA target sequence
gtggtgagatgaatcgtttct

SEQ ID NO: 46020 - DNA, 21 bp, Artificial sequence
  SiRNA target sequence
tggtgagatgaatcgtttctt

SEQ ID NO: 46021 - DNA, 21 bp, Artificial sequence
  SiRNA target sequence
ggtgagatgaatcgtttcttt

SEQ ID NO: 46022 - DNA, 21 bp, Artificial sequence
  SiRNA target sequence
gtgagatgaatcgtttctttg

SEQ ID NO: 46023 - DNA, 21 bp, Artificial sequence
  SiRNA target sequence
tgagatgaatcgtttctttga

SEQ ID NO: 46024 - DNA, 21 bp, Artificial sequence
  SiRNA target sequence
gagatgaatcgtttctttgaa

SEQ ID NO: 46025 - DNA, 21 bp, Artificial sequence
  SiRNA target sequence
agatgaatcgtttctttgaag

SEQ ID NO: 46026 - DNA, 21 bp, Artificial sequence
  SiRNA target sequence
gatgaatcgtttctttgaaga

SEQ ID NO: 46027 - DNA, 21 bp, Artificial sequence
  SiRNA target sequence
atgaatcgtttctttgaagaa

SEQ ID NO: 46028 - DNA, 21 bp, Artificial sequence
  SiRNA target sequence
tgaatcgtttctttgaagaag

SEQ ID NO: 46029 - DNA, 21 bp, Artificial sequence
  SiRNA target sequence
gaatcgtttctttgaagaaga

SEQ ID NO: 46030 - DNA, 21 bp, Artificial sequence
  SiRNA target sequence
aatcgtttctttgaagaagac

SEQ ID NO: 46031 - DNA, 21 bp, Artificial sequence
  SiRNA target sequence
atcgtttctttgaagaagacc

SEQ ID NO: 46032 - DNA, 21 bp, Artificial sequence
  SiRNA target sequence
tcgtttctttgaagaagaccc

SEQ ID NO: 46033 - DNA, 21 bp, Artificial sequence
  SiRNA target sequence
cgtttctttgaagaagacccg

SEQ ID NO: 46034 - DNA, 21 bp, Artificial sequence
  SiRNA target sequence
gtttctttgaagaagacccgg

SEQ ID NO: 46035 - DNA, 21 bp, Artificial sequence
  SiRNA target sequence
tttctttgaagaagacccgga

SEQ ID NO: 46036 - DNA, 21 bp, Artificial sequence
  SiRNA target sequence
ttctttgaagaagacccggaa

SEQ ID NO: 46037 - DNA, 21 bp, Artificial sequence
  SiRNA target sequence
tctttgaagaagacccggaat

SEQ ID NO: 46038 - DNA, 21 bp, Artificial sequence
  SiRNA target sequence
ctttgaagaagacccggaatc

SEQ ID NO: 46039 - DNA, 21 bp, Artificial sequence
  SiRNA target sequence
tttgaagaagacccggaatca

SEQ ID NO: 46040 - DNA, 21 bp, Artificial sequence
  SiRNA target sequence
ttgaagaagacccggaatcac

SEQ ID NO: 46041 - DNA, 21 bp, Artificial sequence
  SiRNA target sequence
tgaagaagacccggaatcact

SEQ ID NO: 46042 - DNA, 21 bp, Artificial sequence
  SiRNA target sequence
gaagaagacccggaatcactt

SEQ ID NO: 46043 - DNA, 21 bp, Artificial sequence
  SiRNA target sequence
aagaagacccggaatcacttg

SEQ ID NO: 46044 - DNA, 21 bp, Artificial sequence
  SiRNA target sequence
agaagacccggaatcacttgt

SEQ ID NO: 46045 - DNA, 21 bp, Artificial sequence
  SiRNA target sequence
gaagacccggaatcacttgta

SEQ ID NO: 46046 - DNA, 21 bp, Artificial sequence
  SiRNA target sequence
aagacccggaatcacttgtaa

SEQ ID NO: 46047 - DNA, 21 bp, Artificial sequence
  SiRNA target sequence
agacccggaatcacttgtaaa

SEQ ID NO: 46048 - DNA, 21 bp, Artificial sequence
  SiRNA target sequence
gacccggaatcacttgtaaat

SEQ ID NO: 46049 - DNA, 21 bp, Artificial sequence
  SiRNA target sequence
acccggaatcacttgtaaata

SEQ ID NO: 46050 - DNA, 21 bp, Artificial sequence
  SiRNA target sequence
cccggaatcacttgtaaatac

SEQ ID NO: 46051 - DNA, 21 bp, Artificial sequence
  SiRNA target sequence
ccggaatcacttgtaaataca

SEQ ID NO: 46052 - DNA, 21 bp, Artificial sequence
  SiRNA target sequence
cggaatcacttgtaaatacac

SEQ ID NO: 46053 - DNA, 21 bp, Artificial sequence
  SiRNA target sequence
ggaatcacttgtaaatacacc

SEQ ID NO: 46054 - DNA, 21 bp, Artificial sequence
  SiRNA target sequence
gaatcacttgtaaatacacca

SEQ ID NO: 46055 - DNA, 21 bp, Artificial sequence
  SiRNA target sequence
aatcacttgtaaatacaccaa

SEQ ID NO: 46056 - DNA, 21 bp, Artificial sequence
  SiRNA target sequence
atcacttgtaaatacaccaaa

SEQ ID NO: 46057 - DNA, 21 bp, Artificial sequence
  SiRNA target sequence
tcacttgtaaatacaccaaaa

SEQ ID NO: 46058 - DNA, 21 bp, Artificial sequence
  SiRNA target sequence
cacttgtaaatacaccaaaag

SEQ ID NO: 46059 - DNA, 21 bp, Artificial sequence
  SiRNA target sequence
acttgtaaatacaccaaaagt

SEQ ID NO: 46060 - DNA, 21 bp, Artificial sequence
  SiRNA target sequence
cttgtaaatacaccaaaagta

SEQ ID NO: 46061 - DNA, 21 bp, Artificial sequence
  SiRNA target sequence
ttgtaaatacaccaaaagtag

SEQ ID NO: 46062 - DNA, 21 bp, Artificial sequence
  SiRNA target sequence
tgtaaatacaccaaaagtaga

SEQ ID NO: 46063 - DNA, 21 bp, Artificial sequence
  SiRNA target sequence
gtaaatacaccaaaagtagaa

SEQ ID NO: 46064 - DNA, 21 bp, Artificial sequence
  SiRNA target sequence
taaatacaccaaaagtagaag

SEQ ID NO: 46065 - DNA, 21 bp, Artificial sequence
  SiRNA target sequence
aaatacaccaaaagtagaagc

SEQ ID NO: 46066 - DNA, 21 bp, Artificial sequence
  SiRNA target sequence
aatacaccaaaagtagaagct

SEQ ID NO: 46067 - DNA, 21 bp, Artificial sequence
  SiRNA target sequence
atacaccaaaagtagaagctt

SEQ ID NO: 46068 - DNA, 21 bp, Artificial sequence
  SiRNA target sequence
tacaccaaaagtagaagcttt

SEQ ID NO: 46069 - DNA, 21 bp, Artificial sequence
  SiRNA target sequence
acaccaaaagtagaagctttt

SEQ ID NO: 46070 - DNA, 21 bp, Artificial sequence
  SiRNA target sequence
caccaaaagtagaagcttttg

SEQ ID NO: 46071 - DNA, 21 bp, Artificial sequence
  SiRNA target sequence
accaaaagtagaagcttttgc

SEQ ID NO: 46072 - DNA, 21 bp, Artificial sequence
  SiRNA target sequence
ccaaaagtagaagcttttgct

SEQ ID NO: 46073 - DNA, 21 bp, Artificial sequence
  SiRNA target sequence
caaaagtagaagcttttgctt

SEQ ID NO: 46074 - DNA, 21 bp, Artificial sequence
  SiRNA target sequence
aaaagtagaagcttttgcttc

SEQ ID NO: 46075 - DNA, 21 bp, Artificial sequence
  SiRNA target sequence
aaagtagaagcttttgcttct

SEQ ID NO: 46076 - DNA, 21 bp, Artificial sequence
  SiRNA target sequence
aagtagaagcttttgcttctg

SEQ ID NO: 46077 - DNA, 21 bp, Artificial sequence
  SiRNA target sequence
agtagaagcttttgcttctgc

SEQ ID NO: 46078 - DNA, 21 bp, Artificial sequence
  SiRNA target sequence
gtagaagcttttgcttctgct

SEQ ID NO: 46079 - DNA, 21 bp, Artificial sequence
  SiRNA target sequence
tagaagcttttgcttctgctg

SEQ ID NO: 46080 - DNA, 21 bp, Artificial sequence
  SiRNA target sequence
agaagcttttgcttctgctga

SEQ ID NO: 46081 - DNA, 21 bp, Artificial sequence
  SiRNA target sequence
gaagcttttgcttctgctgat

SEQ ID NO: 46082 - DNA, 21 bp, Artificial sequence
  SiRNA target sequence
aagcttttgcttctgctgatt

SEQ ID NO: 46083 - DNA, 21 bp, Artificial sequence
  SiRNA target sequence
agcttttgcttctgctgattt

SEQ ID NO: 46084 - DNA, 21 bp, Artificial sequence
  SiRNA target sequence
gcttttgcttctgctgatttg

SEQ ID NO: 46085 - DNA, 21 bp, Artificial sequence
  SiRNA target sequence
cttttgcttctgctgatttgg

SEQ ID NO: 46086 - DNA, 21 bp, Artificial sequence
  SiRNA target sequence
ttttgcttctgctgatttggc

SEQ ID NO: 46087 - DNA, 21 bp, Artificial sequence
  SiRNA target sequence
tttgcttctgctgatttggct

SEQ ID NO: 46088 - DNA, 21 bp, Artificial sequence
  SiRNA target sequence
ttgcttctgctgatttggcta

SEQ ID NO: 46089 - DNA, 21 bp, Artificial sequence
  SiRNA target sequence
tgcttctgctgatttggctac

SEQ ID NO: 46090 - DNA, 21 bp, Artificial sequence
  SiRNA target sequence
gcttctgctgatttggctact

SEQ ID NO: 46091 - DNA, 21 bp, Artificial sequence
  SiRNA target sequence
cttctgctgatttggctactt

SEQ ID NO: 46092 - DNA, 21 bp, Artificial sequence
  SiRNA target sequence
ttctgctgatttggctactta

SEQ ID NO: 46093 - DNA, 21 bp, Artificial sequence
  SiRNA target sequence
tctgctgatttggctacttat

SEQ ID NO: 46094 - DNA, 21 bp, Artificial sequence
  SiRNA target sequence
ctgctgatttggctacttata

SEQ ID NO: 46095 - DNA, 21 bp, Artificial sequence
  SiRNA target sequence
tgctgatttggctacttataa

SEQ ID NO: 46096 - DNA, 21 bp, Artificial sequence
  SiRNA target sequence
gctgatttggctacttataaa

SEQ ID NO: 46097 - DNA, 21 bp, Artificial sequence
  SiRNA target sequence
ctgatttggctacttataaaa

SEQ ID NO: 46098 - DNA, 21 bp, Artificial sequence
  SiRNA target sequence
tgatttggctacttataaaaa

SEQ ID NO: 46099 - DNA, 21 bp, Artificial sequence
  SiRNA target sequence
gatttggctacttataaaaac

SEQ ID NO: 46100 - DNA, 21 bp, Artificial sequence
  SiRNA target sequence
atttggctacttataaaaaca

SEQ ID NO: 46101 - DNA, 21 bp, Artificial sequence
  SiRNA target sequence
tttggctacttataaaaacag

SEQ ID NO: 46102 - DNA, 21 bp, Artificial sequence
  SiRNA target sequence
ttggctacttataaaaacagg

SEQ ID NO: 46103 - DNA, 21 bp, Artificial sequence
  SiRNA target sequence
tggctacttataaaaacagga

SEQ ID NO: 46104 - DNA, 21 bp, Artificial sequence
  SiRNA target sequence
ggctacttataaaaacaggac

SEQ ID NO: 46105 - DNA, 21 bp, Artificial sequence
  SiRNA target sequence
gctacttataaaaacaggact

SEQ ID NO: 46106 - DNA, 21 bp, Artificial sequence
  SiRNA target sequence
ctacttataaaaacaggactc

SEQ ID NO: 46107 - DNA, 21 bp, Artificial sequence
  SiRNA target sequence
tacttataaaaacaggactcc

SEQ ID NO: 46108 - DNA, 21 bp, Artificial sequence
  SiRNA target sequence
acttataaaaacaggactccg

SEQ ID NO: 46109 - DNA, 21 bp, Artificial sequence
  SiRNA target sequence
cttataaaaacaggactccga

SEQ ID NO: 46110 - DNA, 21 bp, Artificial sequence
  SiRNA target sequence
ttataaaaacaggactccgat

SEQ ID NO: 46111 - DNA, 21 bp, Artificial sequence
  SiRNA target sequence
tataaaaacaggactccgata

SEQ ID NO: 46112 - DNA, 21 bp, Artificial sequence
  SiRNA target sequence
ataaaaacaggactccgatag

SEQ ID NO: 46113 - DNA, 21 bp, Artificial sequence
  SiRNA target sequence
taaaaacaggactccgatagt

SEQ ID NO: 46114 - DNA, 21 bp, Artificial sequence
  SiRNA target sequence
aaaaacaggactccgatagtt

SEQ ID NO: 46115 - DNA, 21 bp, Artificial sequence
  SiRNA target sequence
aaaacaggactccgatagtta

SEQ ID NO: 46116 - DNA, 21 bp, Artificial sequence
  SiRNA target sequence
aaacaggactccgatagttat

SEQ ID NO: 46117 - DNA, 21 bp, Artificial sequence
  SiRNA target sequence
aacaggactccgatagttatt

SEQ ID NO: 46118 - DNA, 21 bp, Artificial sequence
  SiRNA target sequence
acaggactccgatagttattg

SEQ ID NO: 46119 - DNA, 21 bp, Artificial sequence
  SiRNA target sequence
caggactccgatagttattga

SEQ ID NO: 46120 - DNA, 21 bp, Artificial sequence
  SiRNA target sequence
aggactccgatagttattgag

SEQ ID NO: 46121 - DNA, 21 bp, Artificial sequence
  SiRNA target sequence
ggactccgatagttattgagg

SEQ ID NO: 46122 - DNA, 21 bp, Artificial sequence
  SiRNA target sequence
gactccgatagttattgaggc

SEQ ID NO: 46123 - DNA, 21 bp, Artificial sequence
  SiRNA target sequence
actccgatagttattgaggca

SEQ ID NO: 46124 - DNA, 21 bp, Artificial sequence
  SiRNA target sequence
ctccgatagttattgaggcac

SEQ ID NO: 46125 - DNA, 21 bp, Artificial sequence
  SiRNA target sequence
tccgatagttattgaggcaca

SEQ ID NO: 46126 - DNA, 21 bp, Artificial sequence
  SiRNA target sequence
ccgatagttattgaggcacaa

SEQ ID NO: 46127 - DNA, 21 bp, Artificial sequence
  SiRNA target sequence
cgatagttattgaggcacaaa

SEQ ID NO: 46128 - DNA, 21 bp, Artificial sequence
  SiRNA target sequence
gatagttattgaggcacaaac

SEQ ID NO: 46129 - DNA, 21 bp, Artificial sequence
  SiRNA target sequence
atagttattgaggcacaaaca

SEQ ID NO: 46130 - DNA, 21 bp, Artificial sequence
  SiRNA target sequence
tagttattgaggcacaaacat

SEQ ID NO: 46131 - DNA, 21 bp, Artificial sequence
  SiRNA target sequence
agttattgaggcacaaacatc

SEQ ID NO: 46132 - DNA, 21 bp, Artificial sequence
  SiRNA target sequence
gttattgaggcacaaacatca

SEQ ID NO: 46133 - DNA, 21 bp, Artificial sequence
  SiRNA target sequence
ttattgaggcacaaacatcag

SEQ ID NO: 46134 - DNA, 21 bp, Artificial sequence
  SiRNA target sequence
tattgaggcacaaacatcagg

SEQ ID NO: 46135 - DNA, 21 bp, Artificial sequence
  SiRNA target sequence
attgaggcacaaacatcagga

SEQ ID NO: 46136 - DNA, 21 bp, Artificial sequence
  SiRNA target sequence
ttgaggcacaaacatcaggag

SEQ ID NO: 46137 - DNA, 21 bp, Artificial sequence
  SiRNA target sequence
tgaggcacaaacatcaggaga

SEQ ID NO: 46138 - DNA, 21 bp, Artificial sequence
  SiRNA target sequence
gaggcacaaacatcaggagat

SEQ ID NO: 46139 - DNA, 21 bp, Artificial sequence
  SiRNA target sequence
aggcacaaacatcaggagata

SEQ ID NO: 46140 - DNA, 21 bp, Artificial sequence
  SiRNA target sequence
ggcacaaacatcaggagataa

SEQ ID NO: 46141 - DNA, 21 bp, Artificial sequence
  SiRNA target sequence
gcacaaacatcaggagataat

SEQ ID NO: 46142 - DNA, 21 bp, Artificial sequence
  SiRNA target sequence
cacaaacatcaggagataata

SEQ ID NO: 46143 - DNA, 21 bp, Artificial sequence
  SiRNA target sequence
acaaacatcaggagataatat

SEQ ID NO: 46144 - DNA, 21 bp, Artificial sequence
  SiRNA target sequence
caaacatcaggagataatatg

SEQ ID NO: 46145 - DNA, 21 bp, Artificial sequence
  SiRNA target sequence
aaacatcaggagataatatga

SEQ ID NO: 46146 - DNA, 21 bp, Artificial sequence
  SiRNA target sequence
aacatcaggagataatatgac

SEQ ID NO: 46147 - DNA, 21 bp, Artificial sequence
  SiRNA target sequence
acatcaggagataatatgact

SEQ ID NO: 46148 - DNA, 21 bp, Artificial sequence
  SiRNA target sequence
catcaggagataatatgactc

SEQ ID NO: 46149 - DNA, 21 bp, Artificial sequence
  SiRNA target sequence
atcaggagataatatgactct

SEQ ID NO: 46150 - DNA, 21 bp, Artificial sequence
  SiRNA target sequence
tcaggagataatatgactctt

SEQ ID NO: 46151 - DNA, 21 bp, Artificial sequence
  SiRNA target sequence
caggagataatatgactctta

SEQ ID NO: 46152 - DNA, 21 bp, Artificial sequence
  SiRNA target sequence
aggagataatatgactcttaa

SEQ ID NO: 46153 - DNA, 21 bp, Artificial sequence
  SiRNA target sequence
ggagataatatgactcttaaa

SEQ ID NO: 46154 - DNA, 21 bp, Artificial sequence
  SiRNA target sequence
gagataatatgactcttaaac

SEQ ID NO: 46155 - DNA, 21 bp, Artificial sequence
  SiRNA target sequence
agataatatgactcttaaaca

SEQ ID NO: 46156 - DNA, 21 bp, Artificial sequence
  SiRNA target sequence
gataatatgactcttaaacaa

SEQ ID NO: 46157 - DNA, 21 bp, Artificial sequence
  SiRNA target sequence
ataatatgactcttaaacaac

SEQ ID NO: 46158 - DNA, 21 bp, Artificial sequence
  SiRNA target sequence
taatatgactcttaaacaacc

SEQ ID NO: 46159 - DNA, 21 bp, Artificial sequence
  SiRNA target sequence
aatatgactcttaaacaacca

SEQ ID NO: 46160 - DNA, 21 bp, Artificial sequence
  SiRNA target sequence
atatgactcttaaacaaccac

SEQ ID NO: 46161 - DNA, 21 bp, Artificial sequence
  SiRNA target sequence
tatgactcttaaacaaccacg

SEQ ID NO: 46162 - DNA, 21 bp, Artificial sequence
  SiRNA target sequence
atgactcttaaacaaccacga

SEQ ID NO: 46163 - DNA, 21 bp, Artificial sequence
  SiRNA target sequence
tgactcttaaacaaccacgac

SEQ ID NO: 46164 - DNA, 21 bp, Artificial sequence
  SiRNA target sequence
gactcttaaacaaccacgacc

SEQ ID NO: 46165 - DNA, 21 bp, Artificial sequence
  SiRNA target sequence
actcttaaacaaccacgacca

SEQ ID NO: 46166 - DNA, 21 bp, Artificial sequence
  SiRNA target sequence
ctcttaaacaaccacgaccag

SEQ ID NO: 46167 - DNA, 21 bp, Artificial sequence
  SiRNA target sequence
tcttaaacaaccacgaccagt

SEQ ID NO: 46168 - DNA, 21 bp, Artificial sequence
  SiRNA target sequence
cttaaacaaccacgaccagtt

SEQ ID NO: 46169 - DNA, 21 bp, Artificial sequence
  SiRNA target sequence
ttaaacaaccacgaccagttg

SEQ ID NO: 46170 - DNA, 21 bp, Artificial sequence
  SiRNA target sequence
taaacaaccacgaccagttgt

SEQ ID NO: 46171 - DNA, 21 bp, Artificial sequence
  SiRNA target sequence
aaacaaccacgaccagttgtt

SEQ ID NO: 46172 - DNA, 21 bp, Artificial sequence
  SiRNA target sequence
aacaaccacgaccagttgtta

SEQ ID NO: 46173 - DNA, 21 bp, Artificial sequence
  SiRNA target sequence
acaaccacgaccagttgttat

SEQ ID NO: 46174 - DNA, 21 bp, Artificial sequence
  SiRNA target sequence
caaccacgaccagttgttata

SEQ ID NO: 46175 - DNA, 21 bp, Artificial sequence
  SiRNA target sequence
aaccacgaccagttgttatag

SEQ ID NO: 46176 - DNA, 21 bp, Artificial sequence
  SiRNA target sequence
accacgaccagttgttataga

SEQ ID NO: 46177 - DNA, 21 bp, Artificial sequence
  SiRNA target sequence
ccacgaccagttgttatagaa

SEQ ID NO: 46178 - DNA, 21 bp, Artificial sequence
  SiRNA target sequence
cacgaccagttgttatagaag

SEQ ID NO: 46179 - DNA, 21 bp, Artificial sequence
  SiRNA target sequence
acgaccagttgttatagaagc

SEQ ID NO: 46180 - DNA, 21 bp, Artificial sequence
  SiRNA target sequence
cgaccagttgttatagaagct

SEQ ID NO: 46181 - DNA, 21 bp, Artificial sequence
  SiRNA target sequence
gaccagttgttatagaagctc

SEQ ID NO: 46182 - DNA, 21 bp, Artificial sequence
  SiRNA target sequence
accagttgttatagaagctca

SEQ ID NO: 46183 - DNA, 21 bp, Artificial sequence
  SiRNA target sequence
ccagttgttatagaagctcag

SEQ ID NO: 46184 - DNA, 21 bp, Artificial sequence
  SiRNA target sequence
cagttgttatagaagctcaga

SEQ ID NO: 46185 - DNA, 21 bp, Artificial sequence
  SiRNA target sequence
agttgttatagaagctcagac

SEQ ID NO: 46186 - DNA, 21 bp, Artificial sequence
  SiRNA target sequence
gttgttatagaagctcagaca

SEQ ID NO: 46187 - DNA, 21 bp, Artificial sequence
  SiRNA target sequence
ttgttatagaagctcagacat

SEQ ID NO: 46188 - DNA, 21 bp, Artificial sequence
  SiRNA target sequence
tgttatagaagctcagacatc

SEQ ID NO: 46189 - DNA, 21 bp, Artificial sequence
  SiRNA target sequence
gttatagaagctcagacatct

SEQ ID NO: 46190 - DNA, 21 bp, Artificial sequence
  SiRNA target sequence
ttatagaagctcagacatctg

SEQ ID NO: 46191 - DNA, 21 bp, Artificial sequence
  SiRNA target sequence
tatagaagctcagacatctgc

SEQ ID NO: 46192 - DNA, 21 bp, Artificial sequence
  SiRNA target sequence
atagaagctcagacatctgct

SEQ ID NO: 46193 - DNA, 21 bp, Artificial sequence
  SiRNA target sequence
tagaagctcagacatctgctg

SEQ ID NO: 46194 - DNA, 21 bp, Artificial sequence
  SiRNA target sequence
agaagctcagacatctgctga

SEQ ID NO: 46195 - DNA, 21 bp, Artificial sequence
  SiRNA target sequence
gaagctcagacatctgctgat

SEQ ID NO: 46196 - DNA, 21 bp, Artificial sequence
  SiRNA target sequence
aagctcagacatctgctgatt

SEQ ID NO: 46197 - DNA, 21 bp, Artificial sequence
  SiRNA target sequence
agctcagacatctgctgattg

SEQ ID NO: 46198 - DNA, 21 bp, Artificial sequence
  SiRNA target sequence
gctcagacatctgctgattgt

SEQ ID NO: 46199 - DNA, 21 bp, Artificial sequence
  SiRNA target sequence
ctcagacatctgctgattgtg

SEQ ID NO: 46200 - DNA, 21 bp, Artificial sequence
  SiRNA target sequence
tcagacatctgctgattgtgt

SEQ ID NO: 46201 - DNA, 21 bp, Artificial sequence
  SiRNA target sequence
cagacatctgctgattgtgtt

SEQ ID NO: 46202 - DNA, 21 bp, Artificial sequence
  SiRNA target sequence
agacatctgctgattgtgtta

SEQ ID NO: 46203 - DNA, 21 bp, Artificial sequence
  SiRNA target sequence
gacatctgctgattgtgttac

SEQ ID NO: 46204 - DNA, 21 bp, Artificial sequence
  SiRNA target sequence
acatctgctgattgtgttact

SEQ ID NO: 46205 - DNA, 21 bp, Artificial sequence
  SiRNA target sequence
catctgctgattgtgttactt

SEQ ID NO: 46206 - DNA, 21 bp, Artificial sequence
  SiRNA target sequence
atctgctgattgtgttacttt

SEQ ID NO: 46207 - DNA, 21 bp, Artificial sequence
  SiRNA target sequence
tctgctgattgtgttacttta

SEQ ID NO: 46208 - DNA, 21 bp, Artificial sequence
  SiRNA target sequence
ctgctgattgtgttactttag

SEQ ID NO: 46209 - DNA, 21 bp, Artificial sequence
  SiRNA target sequence
tgctgattgtgttactttagc

SEQ ID NO: 46210 - DNA, 21 bp, Artificial sequence
  SiRNA target sequence
gctgattgtgttactttagct

SEQ ID NO: 46211 - DNA, 21 bp, Artificial sequence
  SiRNA target sequence
ctgattgtgttactttagcta

SEQ ID NO: 46212 - DNA, 21 bp, Artificial sequence
  SiRNA target sequence
tgattgtgttactttagctaa

SEQ ID NO: 46213 - DNA, 21 bp, Artificial sequence
  SiRNA target sequence
gattgtgttactttagctaaa

SEQ ID NO: 46214 - DNA, 21 bp, Artificial sequence
  SiRNA target sequence
attgtgttactttagctaaaa

SEQ ID NO: 46215 - DNA, 21 bp, Artificial sequence
  SiRNA target sequence
ttgtgttactttagctaaaaa

SEQ ID NO: 46216 - DNA, 21 bp, Artificial sequence
  SiRNA target sequence
tgtgttactttagctaaaaac

SEQ ID NO: 46217 - DNA, 21 bp, Artificial sequence
  SiRNA target sequence
gtgttactttagctaaaaaca

SEQ ID NO: 46218 - DNA, 21 bp, Artificial sequence
  SiRNA target sequence
tgttactttagctaaaaacac

SEQ ID NO: 46219 - DNA, 21 bp, Artificial sequence
  SiRNA target sequence
gttactttagctaaaaacaca

SEQ ID NO: 46220 - DNA, 21 bp, Artificial sequence
  SiRNA target sequence
ttactttagctaaaaacacac

SEQ ID NO: 46221 - DNA, 21 bp, Artificial sequence
  SiRNA target sequence
tactttagctaaaaacacaca

SEQ ID NO: 46222 - DNA, 21 bp, Artificial sequence
  SiRNA target sequence
actttagctaaaaacacacaa

SEQ ID NO: 46223 - DNA, 21 bp, Artificial sequence
  SiRNA target sequence
ctttagctaaaaacacacaac

SEQ ID NO: 46224 - DNA, 21 bp, Artificial sequence
  SiRNA target sequence
tttagctaaaaacacacaacg

SEQ ID NO: 46225 - DNA, 21 bp, Artificial sequence
  SiRNA target sequence
ttagctaaaaacacacaacga

SEQ ID NO: 46226 - DNA, 21 bp, Artificial sequence
  SiRNA target sequence
tagctaaaaacacacaacgaa

SEQ ID NO: 46227 - DNA, 21 bp, Artificial sequence
  SiRNA target sequence
agctaaaaacacacaacgaat

SEQ ID NO: 46228 - DNA, 21 bp, Artificial sequence
  SiRNA target sequence
gctaaaaacacacaacgaatg

SEQ ID NO: 46229 - DNA, 21 bp, Artificial sequence
  SiRNA target sequence
ctaaaaacacacaacgaatga

SEQ ID NO: 46230 - DNA, 21 bp, Artificial sequence
  SiRNA target sequence
taaaaacacacaacgaatgat

SEQ ID NO: 46231 - DNA, 21 bp, Artificial sequence
  SiRNA target sequence
aaaaacacacaacgaatgatt

SEQ ID NO: 46232 - DNA, 21 bp, Artificial sequence
  SiRNA target sequence
aaaacacacaacgaatgattg

SEQ ID NO: 46233 - DNA, 21 bp, Artificial sequence
  SiRNA target sequence
aaacacacaacgaatgattga

SEQ ID NO: 46234 - DNA, 21 bp, Artificial sequence
  SiRNA target sequence
aacacacaacgaatgattgaa

SEQ ID NO: 46235 - DNA, 21 bp, Artificial sequence
  SiRNA target sequence
acacacaacgaatgattgaag

SEQ ID NO: 46236 - DNA, 21 bp, Artificial sequence
  SiRNA target sequence
cacacaacgaatgattgaagc

SEQ ID NO: 46237 - DNA, 21 bp, Artificial sequence
  SiRNA target sequence
acacaacgaatgattgaagca

SEQ ID NO: 46238 - DNA, 21 bp, Artificial sequence
  SiRNA target sequence
cacaacgaatgattgaagcat

SEQ ID NO: 46239 - DNA, 21 bp, Artificial sequence
  SiRNA target sequence
acaacgaatgattgaagcatt

SEQ ID NO: 46240 - DNA, 21 bp, Artificial sequence
  SiRNA target sequence
caacgaatgattgaagcattt

SEQ ID NO: 46241 - DNA, 21 bp, Artificial sequence
  SiRNA target sequence
aacgaatgattgaagcatttg

SEQ ID NO: 46242 - DNA, 21 bp, Artificial sequence
  SiRNA target sequence
acgaatgattgaagcatttgc

SEQ ID NO: 46243 - DNA, 21 bp, Artificial sequence
  SiRNA target sequence
cgaatgattgaagcatttgca

SEQ ID NO: 46244 - DNA, 21 bp, Artificial sequence
  SiRNA target sequence
gaatgattgaagcatttgcaa

SEQ ID NO: 46245 - DNA, 21 bp, Artificial sequence
  SiRNA target sequence
aatgattgaagcatttgcaag

SEQ ID NO: 46246 - DNA, 21 bp, Artificial sequence
  SiRNA target sequence
atgattgaagcatttgcaagt

SEQ ID NO: 46247 - DNA, 21 bp, Artificial sequence
  SiRNA target sequence
tgattgaagcatttgcaagtt

SEQ ID NO: 46248 - DNA, 21 bp, Artificial sequence
  SiRNA target sequence
gattgaagcatttgcaagttc

SEQ ID NO: 46249 - DNA, 21 bp, Artificial sequence
  SiRNA target sequence
attgaagcatttgcaagttct

SEQ ID NO: 46250 - DNA, 21 bp, Artificial sequence
  SiRNA target sequence
ttgaagcatttgcaagttctg

SEQ ID NO: 46251 - DNA, 21 bp, Artificial sequence
  SiRNA target sequence
tgaagcatttgcaagttctga

SEQ ID NO: 46252 - DNA, 21 bp, Artificial sequence
  SiRNA target sequence
gaagcatttgcaagttctgat

SEQ ID NO: 46253 - DNA, 21 bp, Artificial sequence
  SiRNA target sequence
aagcatttgcaagttctgata

SEQ ID NO: 46254 - DNA, 21 bp, Artificial sequence
  SiRNA target sequence
agcatttgcaagttctgatac

SEQ ID NO: 46255 - DNA, 21 bp, Artificial sequence
  SiRNA target sequence
gcatttgcaagttctgatact

SEQ ID NO: 46256 - DNA, 21 bp, Artificial sequence
  SiRNA target sequence
catttgcaagttctgatactg

SEQ ID NO: 46257 - DNA, 21 bp, Artificial sequence
  SiRNA target sequence
atttgcaagttctgatactgt

SEQ ID NO: 46258 - DNA, 21 bp, Artificial sequence
  SiRNA target sequence
tttgcaagttctgatactgta

SEQ ID NO: 46259 - DNA, 21 bp, Artificial sequence
  SiRNA target sequence
ttgcaagttctgatactgtaa

SEQ ID NO: 46260 - DNA, 21 bp, Artificial sequence
  SiRNA target sequence
tgcaagttctgatactgtaac

SEQ ID NO: 46261 - DNA, 21 bp, Artificial sequence
  SiRNA target sequence
gcaagttctgatactgtaaca

SEQ ID NO: 46262 - DNA, 21 bp, Artificial sequence
  SiRNA target sequence
caagttctgatactgtaacac

SEQ ID NO: 46263 - DNA, 21 bp, Artificial sequence
  SiRNA target sequence
aagttctgatactgtaacact

SEQ ID NO: 46264 - DNA, 21 bp, Artificial sequence
  SiRNA target sequence
agttctgatactgtaacactg

SEQ ID NO: 46265 - DNA, 21 bp, Artificial sequence
  SiRNA target sequence
gttctgatactgtaacactga

SEQ ID NO: 46266 - DNA, 21 bp, Artificial sequence
  SiRNA target sequence
ttctgatactgtaacactgaa

SEQ ID NO: 46267 - DNA, 21 bp, Artificial sequence
  SiRNA target sequence
tctgatactgtaacactgaaa

SEQ ID NO: 46268 - DNA, 21 bp, Artificial sequence
  SiRNA target sequence
ctgatactgtaacactgaaaa

SEQ ID NO: 46269 - DNA, 21 bp, Artificial sequence
  SiRNA target sequence
tgatactgtaacactgaaaag

SEQ ID NO: 46270 - DNA, 21 bp, Artificial sequence
  SiRNA target sequence
gatactgtaacactgaaaaga

SEQ ID NO: 46271 - DNA, 21 bp, Artificial sequence
  SiRNA target sequence
atactgtaacactgaaaagac

SEQ ID NO: 46272 - DNA, 21 bp, Artificial sequence
  SiRNA target sequence
tactgtaacactgaaaagacc

SEQ ID NO: 46273 - DNA, 21 bp, Artificial sequence
  SiRNA target sequence
actgtaacactgaaaagacca

SEQ ID NO: 46274 - DNA, 21 bp, Artificial sequence
  SiRNA target sequence
ctgtaacactgaaaagaccaa

SEQ ID NO: 46275 - DNA, 21 bp, Artificial sequence
  SiRNA target sequence
tgtaacactgaaaagaccaac

SEQ ID NO: 46276 - DNA, 21 bp, Artificial sequence
  SiRNA target sequence
gtaacactgaaaagaccaaca

SEQ ID NO: 46277 - DNA, 21 bp, Artificial sequence
  SiRNA target sequence
taacactgaaaagaccaacaa

SEQ ID NO: 46278 - DNA, 21 bp, Artificial sequence
  SiRNA target sequence
aacactgaaaagaccaacaac

SEQ ID NO: 46279 - DNA, 21 bp, Artificial sequence
  SiRNA target sequence
acactgaaaagaccaacaaca

SEQ ID NO: 46280 - DNA, 21 bp, Artificial sequence
  SiRNA target sequence
cactgaaaagaccaacaacaa

SEQ ID NO: 46281 - DNA, 21 bp, Artificial sequence
  SiRNA target sequence
actgaaaagaccaacaacaaa

SEQ ID NO: 46282 - DNA, 21 bp, Artificial sequence
  SiRNA target sequence
ctgaaaagaccaacaacaaaa

SEQ ID NO: 46283 - DNA, 21 bp, Artificial sequence
  SiRNA target sequence
tgaaaagaccaacaacaaaat

SEQ ID NO: 46284 - DNA, 21 bp, Artificial sequence
  SiRNA target sequence
gaaaagaccaacaacaaaata

SEQ ID NO: 46285 - DNA, 21 bp, Artificial sequence
  SiRNA target sequence
aaaagaccaacaacaaaatat

SEQ ID NO: 46286 - DNA, 21 bp, Artificial sequence
  SiRNA target sequence
aaagaccaacaacaaaatatg

SEQ ID NO: 46287 - DNA, 21 bp, Artificial sequence
  SiRNA target sequence
aagaccaacaacaaaatatgt

SEQ ID NO: 46288 - DNA, 21 bp, Artificial sequence
  SiRNA target sequence
agaccaacaacaaaatatgtt

SEQ ID NO: 46289 - DNA, 21 bp, Artificial sequence
  SiRNA target sequence
gaccaacaacaaaatatgttg

SEQ ID NO: 46290 - DNA, 21 bp, Artificial sequence
  SiRNA target sequence
accaacaacaaaatatgttga

SEQ ID NO: 46291 - DNA, 21 bp, Artificial sequence
  SiRNA target sequence
ccaacaacaaaatatgttgaa

SEQ ID NO: 46292 - DNA, 21 bp, Artificial sequence
  SiRNA target sequence
caacaacaaaatatgttgaag

SEQ ID NO: 46293 - DNA, 21 bp, Artificial sequence
  SiRNA target sequence
aacaacaaaatatgttgaagg

SEQ ID NO: 46294 - DNA, 21 bp, Artificial sequence
  SiRNA target sequence
acaacaaaatatgttgaagga

SEQ ID NO: 46295 - DNA, 21 bp, Artificial sequence
  SiRNA target sequence
caacaaaatatgttgaaggaa

SEQ ID NO: 46296 - DNA, 21 bp, Artificial sequence
  SiRNA target sequence
aacaaaatatgttgaaggaac

SEQ ID NO: 46297 - DNA, 21 bp, Artificial sequence
  SiRNA target sequence
acaaaatatgttgaaggaact

SEQ ID NO: 46298 - DNA, 21 bp, Artificial sequence
  SiRNA target sequence
caaaatatgttgaaggaactg

SEQ ID NO: 46299 - DNA, 21 bp, Artificial sequence
  SiRNA target sequence
aaaatatgttgaaggaactgg

SEQ ID NO: 46300 - DNA, 21 bp, Artificial sequence
  SiRNA target sequence
aaatatgttgaaggaactgga

SEQ ID NO: 46301 - DNA, 21 bp, Artificial sequence
  SiRNA target sequence
aatatgttgaaggaactggat

SEQ ID NO: 46302 - DNA, 21 bp, Artificial sequence
  SiRNA target sequence
atatgttgaaggaactggata

SEQ ID NO: 46303 - DNA, 21 bp, Artificial sequence
  SiRNA target sequence
tatgttgaaggaactggatat

SEQ ID NO: 46304 - DNA, 21 bp, Artificial sequence
  SiRNA target sequence
atgttgaaggaactggatatg

SEQ ID NO: 46305 - DNA, 21 bp, Artificial sequence
  SiRNA target sequence
tgttgaaggaactggatatga

SEQ ID NO: 46306 - DNA, 21 bp, Artificial sequence
  SiRNA target sequence
gttgaaggaactggatatgat

SEQ ID NO: 46307 - DNA, 21 bp, Artificial sequence
  SiRNA target sequence
ttgaaggaactggatatgata

SEQ ID NO: 46308 - DNA, 21 bp, Artificial sequence
  SiRNA target sequence
tgaaggaactggatatgatac

SEQ ID NO: 46309 - DNA, 21 bp, Artificial sequence
  SiRNA target sequence
gaaggaactggatatgataca

SEQ ID NO: 46310 - DNA, 21 bp, Artificial sequence
  SiRNA target sequence
aaggaactggatatgatacag

SEQ ID NO: 46311 - DNA, 21 bp, Artificial sequence
  SiRNA target sequence
aggaactggatatgatacagt

SEQ ID NO: 46312 - DNA, 21 bp, Artificial sequence
  SiRNA target sequence
ggaactggatatgatacagtt

SEQ ID NO: 46313 - DNA, 21 bp, Artificial sequence
  SiRNA target sequence
gaactggatatgatacagttg

SEQ ID NO: 46314 - DNA, 21 bp, Artificial sequence
  SiRNA target sequence
aactggatatgatacagttga

SEQ ID NO: 46315 - DNA, 21 bp, Artificial sequence
  SiRNA target sequence
actggatatgatacagttgat

SEQ ID NO: 46316 - DNA, 21 bp, Artificial sequence
  SiRNA target sequence
ctggatatgatacagttgatg

SEQ ID NO: 46317 - DNA, 21 bp, Artificial sequence
  SiRNA target sequence
tggatatgatacagttgatgt

SEQ ID NO: 46318 - DNA, 21 bp, Artificial sequence
  SiRNA target sequence
ggatatgatacagttgatgtc

SEQ ID NO: 46319 - DNA, 21 bp, Artificial sequence
  SiRNA target sequence
gatatgatacagttgatgtct

SEQ ID NO: 46320 - DNA, 21 bp, Artificial sequence
  SiRNA target sequence
atatgatacagttgatgtctc

SEQ ID NO: 46321 - DNA, 21 bp, Artificial sequence
  SiRNA target sequence
tatgatacagttgatgtctct

SEQ ID NO: 46322 - DNA, 21 bp, Artificial sequence
  SiRNA target sequence
atgatacagttgatgtctcta

SEQ ID NO: 46323 - DNA, 21 bp, Artificial sequence
  SiRNA target sequence
tgatacagttgatgtctctat

SEQ ID NO: 46324 - DNA, 21 bp, Artificial sequence
  SiRNA target sequence
gatacagttgatgtctctatg

SEQ ID NO: 46325 - DNA, 21 bp, Artificial sequence
  SiRNA target sequence
atacagttgatgtctctatgc

SEQ ID NO: 46326 - DNA, 21 bp, Artificial sequence
  SiRNA target sequence
tacagttgatgtctctatgca

SEQ ID NO: 46327 - DNA, 21 bp, Artificial sequence
  SiRNA target sequence
acagttgatgtctctatgcaa

SEQ ID NO: 46328 - DNA, 21 bp, Artificial sequence
  SiRNA target sequence
cagttgatgtctctatgcaaa

SEQ ID NO: 46329 - DNA, 21 bp, Artificial sequence
  SiRNA target sequence
agttgatgtctctatgcaaat

SEQ ID NO: 46330 - DNA, 21 bp, Artificial sequence
  SiRNA target sequence
gttgatgtctctatgcaaatg

SEQ ID NO: 46331 - DNA, 21 bp, Artificial sequence
  SiRNA target sequence
ttgatgtctctatgcaaatgt

SEQ ID NO: 46332 - DNA, 21 bp, Artificial sequence
  SiRNA target sequence
tgatgtctctatgcaaatgtg

SEQ ID NO: 46333 - DNA, 21 bp, Artificial sequence
  SiRNA target sequence
gatgtctctatgcaaatgtgg

SEQ ID NO: 46334 - DNA, 21 bp, Artificial sequence
  SiRNA target sequence
atgtctctatgcaaatgtgga

SEQ ID NO: 46335 - DNA, 21 bp, Artificial sequence
  SiRNA target sequence
tgtctctatgcaaatgtggag

SEQ ID NO: 46336 - DNA, 21 bp, Artificial sequence
  SiRNA target sequence
gtctctatgcaaatgtggaga

SEQ ID NO: 46337 - DNA, 21 bp, Artificial sequence
  SiRNA target sequence
tctctatgcaaatgtggagag

SEQ ID NO: 46338 - DNA, 21 bp, Artificial sequence
  SiRNA target sequence
ctctatgcaaatgtggagaga

SEQ ID NO: 46339 - DNA, 21 bp, Artificial sequence
  SiRNA target sequence
tctatgcaaatgtggagagat

SEQ ID NO: 46340 - DNA, 21 bp, Artificial sequence
  SiRNA target sequence
ctatgcaaatgtggagagatc

SEQ ID NO: 46341 - DNA, 21 bp, Artificial sequence
  SiRNA target sequence
tatgcaaatgtggagagatca

SEQ ID NO: 46342 - DNA, 21 bp, Artificial sequence
  SiRNA target sequence
atgcaaatgtggagagatcag

SEQ ID NO: 46343 - DNA, 21 bp, Artificial sequence
  SiRNA target sequence
tgcaaatgtggagagatcagg

SEQ ID NO: 46344 - DNA, 21 bp, Artificial sequence
  SiRNA target sequence
gcaaatgtggagagatcaggt

SEQ ID NO: 46345 - DNA, 21 bp, Artificial sequence
  SiRNA target sequence
caaatgtggagagatcaggtg

SEQ ID NO: 46346 - DNA, 21 bp, Artificial sequence
  SiRNA target sequence
aaatgtggagagatcaggtgg

SEQ ID NO: 46347 - DNA, 21 bp, Artificial sequence
  SiRNA target sequence
aatgtggagagatcaggtggc

SEQ ID NO: 46348 - DNA, 21 bp, Artificial sequence
  SiRNA target sequence
atgtggagagatcaggtggcg

SEQ ID NO: 46349 - DNA, 21 bp, Artificial sequence
  SiRNA target sequence
tgtggagagatcaggtggcgc

SEQ ID NO: 46350 - DNA, 21 bp, Artificial sequence
  SiRNA target sequence
gtggagagatcaggtggcgca

SEQ ID NO: 46351 - DNA, 21 bp, Artificial sequence
  SiRNA target sequence
tggagagatcaggtggcgcag

SEQ ID NO: 46352 - DNA, 21 bp, Artificial sequence
  SiRNA target sequence
ggagagatcaggtggcgcaga

SEQ ID NO: 46353 - DNA, 21 bp, Artificial sequence
  SiRNA target sequence
gagagatcaggtggcgcagaa

SEQ ID NO: 46354 - DNA, 21 bp, Artificial sequence
  SiRNA target sequence
agagatcaggtggcgcagaaa

SEQ ID NO: 46355 - DNA, 21 bp, Artificial sequence
  SiRNA target sequence
gagatcaggtggcgcagaaat

SEQ ID NO: 46356 - DNA, 21 bp, Artificial sequence
  SiRNA target sequence
agatcaggtggcgcagaaatt

SEQ ID NO: 46357 - DNA, 21 bp, Artificial sequence
  SiRNA target sequence
gatcaggtggcgcagaaattg

SEQ ID NO: 46358 - DNA, 21 bp, Artificial sequence
  SiRNA target sequence
atcaggtggcgcagaaattga

SEQ ID NO: 46359 - DNA, 21 bp, Artificial sequence
  SiRNA target sequence
tcaggtggcgcagaaattgat

SEQ ID NO: 46360 - DNA, 21 bp, Artificial sequence
  SiRNA target sequence
caggtggcgcagaaattgatc

SEQ ID NO: 46361 - DNA, 21 bp, Artificial sequence
  SiRNA target sequence
aggtggcgcagaaattgatca

SEQ ID NO: 46362 - DNA, 21 bp, Artificial sequence
  SiRNA target sequence
ggtggcgcagaaattgatcac

SEQ ID NO: 46363 - DNA, 21 bp, Artificial sequence
  SiRNA target sequence
gtggcgcagaaattgatcact

SEQ ID NO: 46364 - DNA, 21 bp, Artificial sequence
  SiRNA target sequence
tggcgcagaaattgatcacta

SEQ ID NO: 46365 - DNA, 21 bp, Artificial sequence
  SiRNA target sequence
ggcgcagaaattgatcactaa

SEQ ID NO: 46366 - DNA, 21 bp, Artificial sequence
  SiRNA target sequence
gcgcagaaattgatcactaac

SEQ ID NO: 46367 - DNA, 21 bp, Artificial sequence
  SiRNA target sequence
cgcagaaattgatcactaacc

SEQ ID NO: 46368 - DNA, 21 bp, Artificial sequence
  SiRNA target sequence
gcagaaattgatcactaaccg

SEQ ID NO: 46369 - DNA, 21 bp, Artificial sequence
  SiRNA target sequence
cagaaattgatcactaaccga

SEQ ID NO: 46370 - DNA, 21 bp, Artificial sequence
  SiRNA target sequence
agaaattgatcactaaccgaa

SEQ ID NO: 46371 - DNA, 21 bp, Artificial sequence
  SiRNA target sequence
gaaattgatcactaaccgaat

SEQ ID NO: 46372 - DNA, 21 bp, Artificial sequence
  SiRNA target sequence
aaattgatcactaaccgaatt

SEQ ID NO: 46373 - DNA, 21 bp, Artificial sequence
  SiRNA target sequence
aattgatcactaaccgaattt

SEQ ID NO: 46374 - DNA, 21 bp, Artificial sequence
  SiRNA target sequence
attgatcactaaccgaatttt

SEQ ID NO: 46375 - DNA, 21 bp, Artificial sequence
  SiRNA target sequence
ttgatcactaaccgaatttta

SEQ ID NO: 46376 - DNA, 21 bp, Artificial sequence
  SiRNA target sequence
tgatcactaaccgaattttaa

SEQ ID NO: 46377 - DNA, 21 bp, Artificial sequence
  SiRNA target sequence
gatcactaaccgaattttaac

SEQ ID NO: 46378 - DNA, 21 bp, Artificial sequence
  SiRNA target sequence
atcactaaccgaattttaaca

SEQ ID NO: 46379 - DNA, 21 bp, Artificial sequence
  SiRNA target sequence
tcactaaccgaattttaacaa

SEQ ID NO: 46380 - DNA, 21 bp, Artificial sequence
  SiRNA target sequence
cactaaccgaattttaacaaa

SEQ ID NO: 46381 - DNA, 21 bp, Artificial sequence
  SiRNA target sequence
actaaccgaattttaacaaat

SEQ ID NO: 46382 - DNA, 21 bp, Artificial sequence
  SiRNA target sequence
ctaaccgaattttaacaaatc

SEQ ID NO: 46383 - DNA, 21 bp, Artificial sequence
  SiRNA target sequence
taaccgaattttaacaaatct

SEQ ID NO: 46384 - DNA, 21 bp, Artificial sequence
  SiRNA target sequence
aaccgaattttaacaaatctg

SEQ ID NO: 46385 - DNA, 21 bp, Artificial sequence
  SiRNA target sequence
accgaattttaacaaatctgt

SEQ ID NO: 46386 - DNA, 21 bp, Artificial sequence
  SiRNA target sequence
ccgaattttaacaaatctgta

SEQ ID NO: 46387 - DNA, 21 bp, Artificial sequence
  SiRNA target sequence
cgaattttaacaaatctgtat

SEQ ID NO: 46388 - DNA, 21 bp, Artificial sequence
  SiRNA target sequence
gaattttaacaaatctgtata

SEQ ID NO: 46389 - DNA, 21 bp, Artificial sequence
  SiRNA target sequence
aattttaacaaatctgtataa

SEQ ID NO: 46390 - DNA, 21 bp, Artificial sequence
  SiRNA target sequence
attttaacaaatctgtataaa

SEQ ID NO: 46391 - DNA, 21 bp, Artificial sequence
  SiRNA target sequence
ttttaacaaatctgtataaaa

SEQ ID NO: 46392 - DNA, 21 bp, Artificial sequence
  SiRNA target sequence
tttaacaaatctgtataaaat

SEQ ID NO: 46393 - DNA, 21 bp, Artificial sequence
  SiRNA target sequence
ttaacaaatctgtataaaatt

SEQ ID NO: 46394 - DNA, 21 bp, Artificial sequence
  SiRNA target sequence
taacaaatctgtataaaattt

SEQ ID NO: 46395 - DNA, 21 bp, Artificial sequence
  SiRNA target sequence
aacaaatctgtataaaatttg

SEQ ID NO: 46396 - DNA, 21 bp, Artificial sequence
  SiRNA target sequence
acaaatctgtataaaatttgt

SEQ ID NO: 46397 - DNA, 21 bp, Artificial sequence
  SiRNA target sequence
caaatctgtataaaatttgtt

SEQ ID NO: 46398 - DNA, 21 bp, Artificial sequence
  SiRNA target sequence
aaatctgtataaaatttgttt

SEQ ID NO: 46399 - DNA, 21 bp, Artificial sequence
  SiRNA target sequence
aatctgtataaaatttgttta

SEQ ID NO: 46400 - DNA, 21 bp, Artificial sequence
  SiRNA target sequence
atctgtataaaatttgtttag

SEQ ID NO: 46401 - DNA, 21 bp, Artificial sequence
  SiRNA target sequence
tctgtataaaatttgtttagt

SEQ ID NO: 46402 - DNA, 21 bp, Artificial sequence
  SiRNA target sequence
ctgtataaaatttgtttagta

SEQ ID NO: 46403 - DNA, 21 bp, Artificial sequence
  SiRNA target sequence
tgtataaaatttgtttagtaa

SEQ ID NO: 46404 - DNA, 21 bp, Artificial sequence
  SiRNA target sequence
gtataaaatttgtttagtaaa

SEQ ID NO: 46405 - DNA, 21 bp, Artificial sequence
  SiRNA target sequence
tataaaatttgtttagtaaat

SEQ ID NO: 46406 - DNA, 21 bp, Artificial sequence
  SiRNA target sequence
ataaaatttgtttagtaaatg

SEQ ID NO: 46407 - DNA, 21 bp, Artificial sequence
  SiRNA target sequence
taaaatttgtttagtaaatga

SEQ ID NO: 46408 - DNA, 21 bp, Artificial sequence
  SiRNA target sequence
aaaatttgtttagtaaatgac

SEQ ID NO: 46409 - DNA, 21 bp, Artificial sequence
  SiRNA target sequence
aaatttgtttagtaaatgacg

SEQ ID NO: 46410 - DNA, 21 bp, Artificial sequence
  SiRNA target sequence
aatttgtttagtaaatgacga

SEQ ID NO: 46411 - DNA, 21 bp, Artificial sequence
  SiRNA target sequence
atttgtttagtaaatgacgac

SEQ ID NO: 46412 - DNA, 21 bp, Artificial sequence
  SiRNA target sequence
tttgtttagtaaatgacgacg

SEQ ID NO: 46413 - DNA, 21 bp, Artificial sequence
  SiRNA target sequence
ttgtttagtaaatgacgacga

SEQ ID NO: 46414 - DNA, 21 bp, Artificial sequence
  SiRNA target sequence
tgtttagtaaatgacgacgac

SEQ ID NO: 46415 - DNA, 21 bp, Artificial sequence
  SiRNA target sequence
gtttagtaaatgacgacgaca

SEQ ID NO: 46416 - DNA, 21 bp, Artificial sequence
  SiRNA target sequence
tttagtaaatgacgacgacac

SEQ ID NO: 46417 - DNA, 21 bp, Artificial sequence
  SiRNA target sequence
ttagtaaatgacgacgacaca

SEQ ID NO: 46418 - DNA, 21 bp, Artificial sequence
  SiRNA target sequence
tagtaaatgacgacgacacag

SEQ ID NO: 46419 - DNA, 21 bp, Artificial sequence
  SiRNA target sequence
agtaaatgacgacgacacagt

SEQ ID NO: 46420 - DNA, 21 bp, Artificial sequence
  SiRNA target sequence
gtaaatgacgacgacacagta

SEQ ID NO: 46421 - DNA, 21 bp, Artificial sequence
  SiRNA target sequence
taaatgacgacgacacagtaa

SEQ ID NO: 46422 - DNA, 21 bp, Artificial sequence
  SiRNA target sequence
aaatgacgacgacacagtaac

SEQ ID NO: 46423 - DNA, 21 bp, Artificial sequence
  SiRNA target sequence
aatgacgacgacacagtaaca

SEQ ID NO: 46424 - DNA, 21 bp, Artificial sequence
  SiRNA target sequence
atgacgacgacacagtaacac

SEQ ID NO: 46425 - DNA, 21 bp, Artificial sequence
  SiRNA target sequence
tgacgacgacacagtaacacc

SEQ ID NO: 46426 - DNA, 21 bp, Artificial sequence
  SiRNA target sequence
gacgacgacacagtaacacca

SEQ ID NO: 46427 - DNA, 21 bp, Artificial sequence
  SiRNA target sequence
acgacgacacagtaacaccac

SEQ ID NO: 46428 - DNA, 21 bp, Artificial sequence
  SiRNA target sequence
cgacgacacagtaacaccact

SEQ ID NO: 46429 - DNA, 21 bp, Artificial sequence
  SiRNA target sequence
gacgacacagtaacaccactt

SEQ ID NO: 46430 - DNA, 21 bp, Artificial sequence
  SiRNA target sequence
acgacacagtaacaccacttt

SEQ ID NO: 46431 - DNA, 21 bp, Artificial sequence
  SiRNA target sequence
cgacacagtaacaccactttt

SEQ ID NO: 46432 - DNA, 21 bp, Artificial sequence
  SiRNA target sequence
gacacagtaacaccacttttg

SEQ ID NO: 46433 - DNA, 21 bp, Artificial sequence
  SiRNA target sequence
acacagtaacaccacttttga

SEQ ID NO: 46434 - DNA, 21 bp, Artificial sequence
  SiRNA target sequence
cacagtaacaccacttttgaa

SEQ ID NO: 46435 - DNA, 21 bp, Artificial sequence
  SiRNA target sequence
acagtaacaccacttttgaac

SEQ ID NO: 46436 - DNA, 21 bp, Artificial sequence
  SiRNA target sequence
cagtaacaccacttttgaacg

SEQ ID NO: 46437 - DNA, 21 bp, Artificial sequence
  SiRNA target sequence
agtaacaccacttttgaacgg

SEQ ID NO: 46438 - DNA, 21 bp, Artificial sequence
  SiRNA target sequence
gtaacaccacttttgaacgga

SEQ ID NO: 46439 - DNA, 21 bp, Artificial sequence
  SiRNA target sequence
taacaccacttttgaacggat

SEQ ID NO: 46440 - DNA, 21 bp, Artificial sequence
  SiRNA target sequence
aacaccacttttgaacggatt

SEQ ID NO: 46441 - DNA, 21 bp, Artificial sequence
  SiRNA target sequence
acaccacttttgaacggatta

SEQ ID NO: 46442 - DNA, 21 bp, Artificial sequence
  SiRNA target sequence
caccacttttgaacggattat

SEQ ID NO: 46443 - DNA, 21 bp, Artificial sequence
  SiRNA target sequence
accacttttgaacggattatt

SEQ ID NO: 46444 - DNA, 21 bp, Artificial sequence
  SiRNA target sequence
ccacttttgaacggattattt

SEQ ID NO: 46445 - DNA, 21 bp, Artificial sequence
  SiRNA target sequence
cacttttgaacggattattta

SEQ ID NO: 46446 - DNA, 21 bp, Artificial sequence
  SiRNA target sequence
acttttgaacggattatttat

SEQ ID NO: 46447 - DNA, 21 bp, Artificial sequence
  SiRNA target sequence
cttttgaacggattatttatt

SEQ ID NO: 46448 - DNA, 21 bp, Artificial sequence
  SiRNA target sequence
ttttgaacggattatttattc

SEQ ID NO: 46449 - DNA, 21 bp, Artificial sequence
  SiRNA target sequence
tttgaacggattatttattcg

SEQ ID NO: 46450 - DNA, 21 bp, Artificial sequence
  SiRNA target sequence
ttgaacggattatttattcgt

SEQ ID NO: 46451 - DNA, 21 bp, Artificial sequence
  SiRNA target sequence
tgaacggattatttattcgtt

SEQ ID NO: 46452 - DNA, 21 bp, Artificial sequence
  SiRNA target sequence
gaacggattatttattcgttc

SEQ ID NO: 46453 - DNA, 21 bp, Artificial sequence
  SiRNA target sequence
aacggattatttattcgttca

SEQ ID NO: 46454 - DNA, 21 bp, Artificial sequence
  SiRNA target sequence
acggattatttattcgttcaa

SEQ ID NO: 46455 - DNA, 21 bp, Artificial sequence
  SiRNA target sequence
cggattatttattcgttcaaa

SEQ ID NO: 46456 - DNA, 21 bp, Artificial sequence
  SiRNA target sequence
ggattatttattcgttcaaat

SEQ ID NO: 46457 - DNA, 21 bp, Artificial sequence
  SiRNA target sequence
gattatttattcgttcaaatg

SEQ ID NO: 46458 - DNA, 21 bp, Artificial sequence
  SiRNA target sequence
attatttattcgttcaaatgt

SEQ ID NO: 46459 - DNA, 21 bp, Artificial sequence
  SiRNA target sequence
ttatttattcgttcaaatgtg

SEQ ID NO: 46460 - DNA, 21 bp, Artificial sequence
  SiRNA target sequence
tatttattcgttcaaatgtga

SEQ ID NO: 46461 - DNA, 21 bp, Artificial sequence
  SiRNA target sequence
atttattcgttcaaatgtgat

SEQ ID NO: 46462 - DNA, 21 bp, Artificial sequence
  SiRNA target sequence
tttattcgttcaaatgtgatg

SEQ ID NO: 46463 - DNA, 21 bp, Artificial sequence
  SiRNA target sequence
ttattcgttcaaatgtgatgt

SEQ ID NO: 46464 - DNA, 21 bp, Artificial sequence
  SiRNA target sequence
tattcgttcaaatgtgatgtt

SEQ ID NO: 46465 - DNA, 21 bp, Artificial sequence
  SiRNA target sequence
attcgttcaaatgtgatgtta

SEQ ID NO: 46466 - DNA, 21 bp, Artificial sequence
  SiRNA target sequence
ttcgttcaaatgtgatgttag

SEQ ID NO: 46467 - DNA, 21 bp, Artificial sequence
  SiRNA target sequence
tcgttcaaatgtgatgttagt

SEQ ID NO: 46468 - DNA, 21 bp, Artificial sequence
  SiRNA target sequence
cgttcaaatgtgatgttagta

SEQ ID NO: 46469 - DNA, 21 bp, Artificial sequence
  SiRNA target sequence
gttcaaatgtgatgttagtac

SEQ ID NO: 46470 - DNA, 21 bp, Artificial sequence
  SiRNA target sequence
ttcaaatgtgatgttagtacc

SEQ ID NO: 46471 - DNA, 21 bp, Artificial sequence
  SiRNA target sequence
tcaaatgtgatgttagtaccc

SEQ ID NO: 46472 - DNA, 21 bp, Artificial sequence
  SiRNA target sequence
caaatgtgatgttagtacccg

SEQ ID NO: 46473 - DNA, 21 bp, Artificial sequence
  SiRNA target sequence
aaatgtgatgttagtacccgg

SEQ ID NO: 46474 - DNA, 21 bp, Artificial sequence
  SiRNA target sequence
aatgtgatgttagtacccgga

SEQ ID NO: 46475 - DNA, 21 bp, Artificial sequence
  SiRNA target sequence
atgtgatgttagtacccggac

SEQ ID NO: 46476 - DNA, 21 bp, Artificial sequence
  SiRNA target sequence
tgtgatgttagtacccggaca

SEQ ID NO: 46477 - DNA, 21 bp, Artificial sequence
  SiRNA target sequence
gtgatgttagtacccggacat

SEQ ID NO: 46478 - DNA, 21 bp, Artificial sequence
  SiRNA target sequence
tgatgttagtacccggacatt

SEQ ID NO: 46479 - DNA, 21 bp, Artificial sequence
  SiRNA target sequence
gatgttagtacccggacattt

SEQ ID NO: 46480 - DNA, 21 bp, Artificial sequence
  SiRNA target sequence
atgttagtacccggacatttg

SEQ ID NO: 46481 - DNA, 21 bp, Artificial sequence
  SiRNA target sequence
tgttagtacccggacatttga

SEQ ID NO: 46482 - DNA, 21 bp, Artificial sequence
  SiRNA target sequence
gttagtacccggacatttgac

SEQ ID NO: 46483 - DNA, 21 bp, Artificial sequence
  SiRNA target sequence
ttagtacccggacatttgact

SEQ ID NO: 46484 - DNA, 21 bp, Artificial sequence
  SiRNA target sequence
tagtacccggacatttgactg

SEQ ID NO: 46485 - DNA, 21 bp, Artificial sequence
  SiRNA target sequence
agtacccggacatttgactgg

SEQ ID NO: 46486 - DNA, 21 bp, Artificial sequence
  SiRNA target sequence
gtacccggacatttgactgga

SEQ ID NO: 46487 - DNA, 21 bp, Artificial sequence
  SiRNA target sequence
tacccggacatttgactggat

SEQ ID NO: 46488 - DNA, 21 bp, Artificial sequence
  SiRNA target sequence
acccggacatttgactggatt

SEQ ID NO: 46489 - DNA, 21 bp, Artificial sequence
  SiRNA target sequence
cccggacatttgactggattc

SEQ ID NO: 46490 - DNA, 21 bp, Artificial sequence
  SiRNA target sequence
ccggacatttgactggattca

SEQ ID NO: 46491 - DNA, 21 bp, Artificial sequence
  SiRNA target sequence
cggacatttgactggattcat

SEQ ID NO: 46492 - DNA, 21 bp, Artificial sequence
  SiRNA target sequence
ggacatttgactggattcatt

SEQ ID NO: 46493 - DNA, 21 bp, Artificial sequence
  SiRNA target sequence
gacatttgactggattcattg

SEQ ID NO: 46494 - DNA, 21 bp, Artificial sequence
  SiRNA target sequence
acatttgactggattcattgc

SEQ ID NO: 46495 - DNA, 21 bp, Artificial sequence
  SiRNA target sequence
catttgactggattcattgca

SEQ ID NO: 46496 - DNA, 21 bp, Artificial sequence
  SiRNA target sequence
atttgactggattcattgcag

SEQ ID NO: 46497 - DNA, 21 bp, Artificial sequence
  SiRNA target sequence
tttgactggattcattgcaga

SEQ ID NO: 46498 - DNA, 21 bp, Artificial sequence
  SiRNA target sequence
ttgactggattcattgcagag

SEQ ID NO: 46499 - DNA, 21 bp, Artificial sequence
  SiRNA target sequence
tgactggattcattgcagagc

SEQ ID NO: 46500 - DNA, 21 bp, Artificial sequence
  SiRNA target sequence
gactggattcattgcagagca

SEQ ID NO: 46501 - DNA, 21 bp, Artificial sequence
  SiRNA target sequence
actggattcattgcagagcat

SEQ ID NO: 46502 - DNA, 21 bp, Artificial sequence
  SiRNA target sequence
ctggattcattgcagagcatg

SEQ ID NO: 46503 - DNA, 21 bp, Artificial sequence
  SiRNA target sequence
tggattcattgcagagcatga

SEQ ID NO: 46504 - DNA, 21 bp, Artificial sequence
  SiRNA target sequence
ggattcattgcagagcatgat

SEQ ID NO: 46505 - DNA, 21 bp, Artificial sequence
  SiRNA target sequence
gattcattgcagagcatgata

SEQ ID NO: 46506 - DNA, 21 bp, Artificial sequence
  SiRNA target sequence
attcattgcagagcatgatac

SEQ ID NO: 46507 - DNA, 21 bp, Artificial sequence
  SiRNA target sequence
ttcattgcagagcatgataca

SEQ ID NO: 46508 - DNA, 21 bp, Artificial sequence
  SiRNA target sequence
tcattgcagagcatgatacaa

SEQ ID NO: 46509 - DNA, 21 bp, Artificial sequence
  SiRNA target sequence
cattgcagagcatgatacaat

SEQ ID NO: 46510 - DNA, 21 bp, Artificial sequence
  SiRNA target sequence
attgcagagcatgatacaatt

SEQ ID NO: 46511 - DNA, 21 bp, Artificial sequence
  SiRNA target sequence
ttgcagagcatgatacaattg

SEQ ID NO: 46512 - DNA, 21 bp, Artificial sequence
  SiRNA target sequence
tgcagagcatgatacaattga

SEQ ID NO: 46513 - DNA, 21 bp, Artificial sequence
  SiRNA target sequence
gcagagcatgatacaattgaa

SEQ ID NO: 46514 - DNA, 21 bp, Artificial sequence
  SiRNA target sequence
cagagcatgatacaattgaaa

SEQ ID NO: 46515 - DNA, 21 bp, Artificial sequence
  SiRNA target sequence
agagcatgatacaattgaaat

SEQ ID NO: 46516 - DNA, 21 bp, Artificial sequence
  SiRNA target sequence
gagcatgatacaattgaaatc

SEQ ID NO: 46517 - DNA, 21 bp, Artificial sequence
  SiRNA target sequence
agcatgatacaattgaaatca

SEQ ID NO: 46518 - DNA, 21 bp, Artificial sequence
  SiRNA target sequence
gcatgatacaattgaaatcag

SEQ ID NO: 46519 - DNA, 21 bp, Artificial sequence
  SiRNA target sequence
catgatacaattgaaatcaga

SEQ ID NO: 46520 - DNA, 21 bp, Artificial sequence
  SiRNA target sequence
atgatacaattgaaatcagaa

SEQ ID NO: 46521 - DNA, 21 bp, Artificial sequence
  SiRNA target sequence
tgatacaattgaaatcagaaa

SEQ ID NO: 46522 - DNA, 21 bp, Artificial sequence
  SiRNA target sequence
gatacaattgaaatcagaaat

SEQ ID NO: 46523 - DNA, 21 bp, Artificial sequence
  SiRNA target sequence
atacaattgaaatcagaaatc

SEQ ID NO: 46524 - DNA, 21 bp, Artificial sequence
  SiRNA target sequence
tacaattgaaatcagaaatct

SEQ ID NO: 46525 - DNA, 21 bp, Artificial sequence
  SiRNA target sequence
acaattgaaatcagaaatctt

SEQ ID NO: 46526 - DNA, 21 bp, Artificial sequence
  SiRNA target sequence
caattgaaatcagaaatcttt

SEQ ID NO: 46527 - DNA, 21 bp, Artificial sequence
  SiRNA target sequence
aattgaaatcagaaatctttt

SEQ ID NO: 46528 - DNA, 21 bp, Artificial sequence
  SiRNA target sequence
attgaaatcagaaatcttttt

SEQ ID NO: 46529 - DNA, 21 bp, Artificial sequence
  SiRNA target sequence
ttgaaatcagaaatctttttg

SEQ ID NO: 46530 - DNA, 21 bp, Artificial sequence
  SiRNA target sequence
tgaaatcagaaatctttttga

SEQ ID NO: 46531 - DNA, 21 bp, Artificial sequence
  SiRNA target sequence
gaaatcagaaatctttttgat

SEQ ID NO: 46532 - DNA, 21 bp, Artificial sequence
  SiRNA target sequence
aaatcagaaatctttttgatg

SEQ ID NO: 46533 - DNA, 21 bp, Artificial sequence
  SiRNA target sequence
aatcagaaatctttttgatgt

SEQ ID NO: 46534 - DNA, 21 bp, Artificial sequence
  SiRNA target sequence
atcagaaatctttttgatgtg

SEQ ID NO: 46535 - DNA, 21 bp, Artificial sequence
  SiRNA target sequence
tcagaaatctttttgatgtgg

SEQ ID NO: 46536 - DNA, 21 bp, Artificial sequence
  SiRNA target sequence
cagaaatctttttgatgtggt

SEQ ID NO: 46537 - DNA, 21 bp, Artificial sequence
  SiRNA target sequence
agaaatctttttgatgtggta

SEQ ID NO: 46538 - DNA, 21 bp, Artificial sequence
  SiRNA target sequence
gaaatctttttgatgtggtat

SEQ ID NO: 46539 - DNA, 21 bp, Artificial sequence
  SiRNA target sequence
aaatctttttgatgtggtatt

SEQ ID NO: 46540 - DNA, 21 bp, Artificial sequence
  SiRNA target sequence
aatctttttgatgtggtattt

SEQ ID NO: 46541 - DNA, 21 bp, Artificial sequence
  SiRNA target sequence
atctttttgatgtggtattta

SEQ ID NO: 46542 - DNA, 21 bp, Artificial sequence
  SiRNA target sequence
tctttttgatgtggtatttag

SEQ ID NO: 46543 - DNA, 21 bp, Artificial sequence
  SiRNA target sequence
ctttttgatgtggtatttaga

SEQ ID NO: 46544 - DNA, 21 bp, Artificial sequence
  SiRNA target sequence
tttttgatgtggtatttagag

SEQ ID NO: 46545 - DNA, 21 bp, Artificial sequence
  SiRNA target sequence
ttttgatgtggtatttagagt

SEQ ID NO: 46546 - DNA, 21 bp, Artificial sequence
  SiRNA target sequence
tttgatgtggtatttagagta

SEQ ID NO: 46547 - DNA, 21 bp, Artificial sequence
  SiRNA target sequence
ttgatgtggtatttagagtac

SEQ ID NO: 46548 - DNA, 21 bp, Artificial sequence
  SiRNA target sequence
tgatgtggtatttagagtacc

SEQ ID NO: 46549 - DNA, 21 bp, Artificial sequence
  SiRNA target sequence
gatgtggtatttagagtacca

SEQ ID NO: 46550 - DNA, 21 bp, Artificial sequence
  SiRNA target sequence
atgtggtatttagagtaccat

SEQ ID NO: 46551 - DNA, 21 bp, Artificial sequence
  SiRNA target sequence
tgtggtatttagagtaccatg

SEQ ID NO: 46552 - DNA, 21 bp, Artificial sequence
  SiRNA target sequence
gtggtatttagagtaccatgg

SEQ ID NO: 46553 - DNA, 21 bp, Artificial sequence
  SiRNA target sequence
tggtatttagagtaccatgga

SEQ ID NO: 46554 - DNA, 21 bp, Artificial sequence
  SiRNA target sequence
ggtatttagagtaccatggaa

SEQ ID NO: 46555 - DNA, 21 bp, Artificial sequence
  SiRNA target sequence
gtatttagagtaccatggaaa

SEQ ID NO: 46556 - DNA, 21 bp, Artificial sequence
  SiRNA target sequence
tatttagagtaccatggaaag

SEQ ID NO: 46557 - DNA, 21 bp, Artificial sequence
  SiRNA target sequence
atttagagtaccatggaaaga

SEQ ID NO: 46558 - DNA, 21 bp, Artificial sequence
  SiRNA target sequence
tttagagtaccatggaaagaa

SEQ ID NO: 46559 - DNA, 21 bp, Artificial sequence
  SiRNA target sequence
ttagagtaccatggaaagaag

SEQ ID NO: 46560 - DNA, 21 bp, Artificial sequence
  SiRNA target sequence
tagagtaccatggaaagaagt

SEQ ID NO: 46561 - DNA, 21 bp, Artificial sequence
  SiRNA target sequence
agagtaccatggaaagaagtt

SEQ ID NO: 46562 - DNA, 21 bp, Artificial sequence
  SiRNA target sequence
gagtaccatggaaagaagtta

SEQ ID NO: 46563 - DNA, 21 bp, Artificial sequence
  SiRNA target sequence
agtaccatggaaagaagttaa

SEQ ID NO: 46564 - DNA, 21 bp, Artificial sequence
  SiRNA target sequence
gtaccatggaaagaagttaag

SEQ ID NO: 46565 - DNA, 21 bp, Artificial sequence
  SiRNA target sequence
taccatggaaagaagttaaga

SEQ ID NO: 46566 - DNA, 21 bp, Artificial sequence
  SiRNA target sequence
accatggaaagaagttaagaa

SEQ ID NO: 46567 - DNA, 21 bp, Artificial sequence
  SiRNA target sequence
ccatggaaagaagttaagaag

SEQ ID NO: 46568 - DNA, 21 bp, Artificial sequence
  SiRNA target sequence
catggaaagaagttaagaaga

SEQ ID NO: 46569 - DNA, 21 bp, Artificial sequence
  SiRNA target sequence
atggaaagaagttaagaagat

SEQ ID NO: 46570 - DNA, 21 bp, Artificial sequence
  SiRNA target sequence
tggaaagaagttaagaagata

SEQ ID NO: 46571 - DNA, 21 bp, Artificial sequence
  SiRNA target sequence
ggaaagaagttaagaagataa

SEQ ID NO: 46572 - DNA, 21 bp, Artificial sequence
  SiRNA target sequence
gaaagaagttaagaagataac

SEQ ID NO: 46573 - DNA, 21 bp, Artificial sequence
  SiRNA target sequence
aaagaagttaagaagataaca

SEQ ID NO: 46574 - DNA, 21 bp, Artificial sequence
  SiRNA target sequence
aagaagttaagaagataacag

SEQ ID NO: 46575 - DNA, 21 bp, Artificial sequence
  SiRNA target sequence
agaagttaagaagataacagt

SEQ ID NO: 46576 - DNA, 21 bp, Artificial sequence
  SiRNA target sequence
gaagttaagaagataacagtt

SEQ ID NO: 46577 - DNA, 21 bp, Artificial sequence
  SiRNA target sequence
aagttaagaagataacagttg

SEQ ID NO: 46578 - DNA, 21 bp, Artificial sequence
  SiRNA target sequence
agttaagaagataacagttga

SEQ ID NO: 46579 - DNA, 21 bp, Artificial sequence
  SiRNA target sequence
gttaagaagataacagttgag

SEQ ID NO: 46580 - DNA, 21 bp, Artificial sequence
  SiRNA target sequence
ttaagaagataacagttgaga

SEQ ID NO: 46581 - DNA, 21 bp, Artificial sequence
  SiRNA target sequence
taagaagataacagttgagaa

SEQ ID NO: 46582 - DNA, 21 bp, Artificial sequence
  SiRNA target sequence
aagaagataacagttgagaat

SEQ ID NO: 46583 - DNA, 21 bp, Artificial sequence
  SiRNA target sequence
agaagataacagttgagaatg

SEQ ID NO: 46584 - DNA, 21 bp, Artificial sequence
  SiRNA target sequence
gaagataacagttgagaatgc

SEQ ID NO: 46585 - DNA, 21 bp, Artificial sequence
  SiRNA target sequence
aagataacagttgagaatgct

SEQ ID NO: 46586 - DNA, 21 bp, Artificial sequence
  SiRNA target sequence
agataacagttgagaatgctc

SEQ ID NO: 46587 - DNA, 21 bp, Artificial sequence
  SiRNA target sequence
gataacagttgagaatgctct

SEQ ID NO: 46588 - DNA, 21 bp, Artificial sequence
  SiRNA target sequence
ataacagttgagaatgctctt

SEQ ID NO: 46589 - DNA, 21 bp, Artificial sequence
  SiRNA target sequence
taacagttgagaatgctcttg

SEQ ID NO: 46590 - DNA, 21 bp, Artificial sequence
  SiRNA target sequence
aacagttgagaatgctcttgg

SEQ ID NO: 46591 - DNA, 21 bp, Artificial sequence
  SiRNA target sequence
acagttgagaatgctcttggt

SEQ ID NO: 46592 - DNA, 21 bp, Artificial sequence
  SiRNA target sequence
cagttgagaatgctcttggtg

SEQ ID NO: 46593 - DNA, 21 bp, Artificial sequence
  SiRNA target sequence
agttgagaatgctcttggtga

SEQ ID NO: 46594 - DNA, 21 bp, Artificial sequence
  SiRNA target sequence
gttgagaatgctcttggtgaa

SEQ ID NO: 46595 - DNA, 21 bp, Artificial sequence
  SiRNA target sequence
ttgagaatgctcttggtgaat

SEQ ID NO: 46596 - DNA, 21 bp, Artificial sequence
  SiRNA target sequence
tgagaatgctcttggtgaatc

SEQ ID NO: 46597 - DNA, 21 bp, Artificial sequence
  SiRNA target sequence
gagaatgctcttggtgaatcc

SEQ ID NO: 46598 - DNA, 21 bp, Artificial sequence
  SiRNA target sequence
agaatgctcttggtgaatcca

SEQ ID NO: 46599 - DNA, 21 bp, Artificial sequence
  SiRNA target sequence
gaatgctcttggtgaatccaa

SEQ ID NO: 46600 - DNA, 21 bp, Artificial sequence
  SiRNA target sequence
aatgctcttggtgaatccaag

SEQ ID NO: 46601 - DNA, 21 bp, Artificial sequence
  SiRNA target sequence
atgctcttggtgaatccaagg

SEQ ID NO: 46602 - DNA, 21 bp, Artificial sequence
  SiRNA target sequence
tgctcttggtgaatccaagga

SEQ ID NO: 46603 - DNA, 21 bp, Artificial sequence
  SiRNA target sequence
gctcttggtgaatccaaggaa

SEQ ID NO: 46604 - DNA, 21 bp, Artificial sequence
  SiRNA target sequence
ctcttggtgaatccaaggaag

SEQ ID NO: 46605 - DNA, 21 bp, Artificial sequence
  SiRNA target sequence
tcttggtgaatccaaggaagc

SEQ ID NO: 46606 - DNA, 21 bp, Artificial sequence
  SiRNA target sequence
cttggtgaatccaaggaagca

SEQ ID NO: 46607 - DNA, 21 bp, Artificial sequence
  SiRNA target sequence
ttggtgaatccaaggaagcag

SEQ ID NO: 46608 - DNA, 21 bp, Artificial sequence
  SiRNA target sequence
tggtgaatccaaggaagcagc

SEQ ID NO: 46609 - DNA, 21 bp, Artificial sequence
  SiRNA target sequence
ggtgaatccaaggaagcagcg

SEQ ID NO: 46610 - DNA, 21 bp, Artificial sequence
  SiRNA target sequence
gtgaatccaaggaagcagcgt

SEQ ID NO: 46611 - DNA, 21 bp, Artificial sequence
  SiRNA target sequence
tgaatccaaggaagcagcgtt

SEQ ID NO: 46612 - DNA, 21 bp, Artificial sequence
  SiRNA target sequence
gaatccaaggaagcagcgtta

SEQ ID NO: 46613 - DNA, 21 bp, Artificial sequence
  SiRNA target sequence
aatccaaggaagcagcgttat

SEQ ID NO: 46614 - DNA, 21 bp, Artificial sequence
  SiRNA target sequence
atccaaggaagcagcgttatt

SEQ ID NO: 46615 - DNA, 21 bp, Artificial sequence
  SiRNA target sequence
tccaaggaagcagcgttatta

SEQ ID NO: 46616 - DNA, 21 bp, Artificial sequence
  SiRNA target sequence
ccaaggaagcagcgttattag

SEQ ID NO: 46617 - DNA, 21 bp, Artificial sequence
  SiRNA target sequence
caaggaagcagcgttattagc

SEQ ID NO: 46618 - DNA, 21 bp, Artificial sequence
  SiRNA target sequence
aaggaagcagcgttattagcg

SEQ ID NO: 46619 - DNA, 21 bp, Artificial sequence
  SiRNA target sequence
aggaagcagcgttattagcgt

SEQ ID NO: 46620 - DNA, 21 bp, Artificial sequence
  SiRNA target sequence
ggaagcagcgttattagcgtt

SEQ ID NO: 46621 - DNA, 21 bp, Artificial sequence
  SiRNA target sequence
gaagcagcgttattagcgttc

SEQ ID NO: 46622 - DNA, 21 bp, Artificial sequence
  SiRNA target sequence
aagcagcgttattagcgttcc

SEQ ID NO: 46623 - DNA, 21 bp, Artificial sequence
  SiRNA target sequence
agcagcgttattagcgttccc

SEQ ID NO: 46624 - DNA, 21 bp, Artificial sequence
  SiRNA target sequence
gcagcgttattagcgttccct

SEQ ID NO: 46625 - DNA, 21 bp, Artificial sequence
  SiRNA target sequence
cagcgttattagcgttcccta

SEQ ID NO: 46626 - DNA, 21 bp, Artificial sequence
  SiRNA target sequence
agcgttattagcgttccctaa

SEQ ID NO: 46627 - DNA, 21 bp, Artificial sequence
  SiRNA target sequence
gcgttattagcgttccctaag

SEQ ID NO: 46628 - DNA, 21 bp, Artificial sequence
  SiRNA target sequence
cgttattagcgttccctaagt

SEQ ID NO: 46629 - DNA, 21 bp, Artificial sequence
  SiRNA target sequence
gttattagcgttccctaagtt

SEQ ID NO: 46630 - DNA, 21 bp, Artificial sequence
  SiRNA target sequence
ttattagcgttccctaagttc

SEQ ID NO: 46631 - DNA, 21 bp, Artificial sequence
  SiRNA target sequence
tattagcgttccctaagttcg

SEQ ID NO: 46632 - DNA, 21 bp, Artificial sequence
  SiRNA target sequence
attagcgttccctaagttcgt

SEQ ID NO: 46633 - DNA, 21 bp, Artificial sequence
  SiRNA target sequence
ttagcgttccctaagttcgta

SEQ ID NO: 46634 - DNA, 21 bp, Artificial sequence
  SiRNA target sequence
tagcgttccctaagttcgtat

SEQ ID NO: 46635 - DNA, 21 bp, Artificial sequence
  SiRNA target sequence
agcgttccctaagttcgtatg

SEQ ID NO: 46636 - DNA, 21 bp, Artificial sequence
  SiRNA target sequence
gcgttccctaagttcgtatgt

SEQ ID NO: 46637 - DNA, 21 bp, Artificial sequence
  SiRNA target sequence
cgttccctaagttcgtatgtc

SEQ ID NO: 46638 - DNA, 21 bp, Artificial sequence
  SiRNA target sequence
gttccctaagttcgtatgtca

SEQ ID NO: 46639 - DNA, 21 bp, Artificial sequence
  SiRNA target sequence
ttccctaagttcgtatgtcaa

SEQ ID NO: 46640 - DNA, 21 bp, Artificial sequence
  SiRNA target sequence
tccctaagttcgtatgtcaac

SEQ ID NO: 46641 - DNA, 21 bp, Artificial sequence
  SiRNA target sequence
ccctaagttcgtatgtcaaca

SEQ ID NO: 46642 - DNA, 21 bp, Artificial sequence
  SiRNA target sequence
cctaagttcgtatgtcaacac

SEQ ID NO: 46643 - DNA, 21 bp, Artificial sequence
  SiRNA target sequence
ctaagttcgtatgtcaacact

SEQ ID NO: 46644 - DNA, 21 bp, Artificial sequence
  SiRNA target sequence
taagttcgtatgtcaacactc

SEQ ID NO: 46645 - DNA, 21 bp, Artificial sequence
  SiRNA target sequence
aagttcgtatgtcaacactct

SEQ ID NO: 46646 - DNA, 21 bp, Artificial sequence
  SiRNA target sequence
agttcgtatgtcaacactctg

SEQ ID NO: 46647 - DNA, 21 bp, Artificial sequence
  SiRNA target sequence
gttcgtatgtcaacactctga

SEQ ID NO: 46648 - DNA, 21 bp, Artificial sequence
  SiRNA target sequence
ttcgtatgtcaacactctgac

SEQ ID NO: 46649 - DNA, 21 bp, Artificial sequence
  SiRNA target sequence
tcgtatgtcaacactctgaca

SEQ ID NO: 46650 - DNA, 21 bp, Artificial sequence
  SiRNA target sequence
cgtatgtcaacactctgacat

SEQ ID NO: 46651 - DNA, 21 bp, Artificial sequence
  SiRNA target sequence
gtatgtcaacactctgacatt

SEQ ID NO: 46652 - DNA, 21 bp, Artificial sequence
  SiRNA target sequence
tatgtcaacactctgacattg

SEQ ID NO: 46653 - DNA, 21 bp, Artificial sequence
  SiRNA target sequence
atgtcaacactctgacattgt

SEQ ID NO: 46654 - DNA, 21 bp, Artificial sequence
  SiRNA target sequence
tgtcaacactctgacattgta

SEQ ID NO: 46655 - DNA, 21 bp, Artificial sequence
  SiRNA target sequence
gtcaacactctgacattgtaa

SEQ ID NO: 46656 - DNA, 21 bp, Artificial sequence
  SiRNA target sequence
tcaacactctgacattgtaaa

SEQ ID NO: 46657 - DNA, 21 bp, Artificial sequence
  SiRNA target sequence
caacactctgacattgtaaag

SEQ ID NO: 46658 - DNA, 21 bp, Artificial sequence
  SiRNA target sequence
aacactctgacattgtaaagc

SEQ ID NO: 46659 - DNA, 21 bp, Artificial sequence
  SiRNA target sequence
acactctgacattgtaaagca

SEQ ID NO: 46660 - DNA, 21 bp, Artificial sequence
  SiRNA target sequence
cactctgacattgtaaagcac

SEQ ID NO: 46661 - DNA, 21 bp, Artificial sequence
  SiRNA target sequence
actctgacattgtaaagcact

SEQ ID NO: 46662 - DNA, 21 bp, Artificial sequence
  SiRNA target sequence
ctctgacattgtaaagcactt

SEQ ID NO: 46663 - DNA, 21 bp, Artificial sequence
  SiRNA target sequence
tctgacattgtaaagcacttt

SEQ ID NO: 46664 - DNA, 21 bp, Artificial sequence
  SiRNA target sequence
ctgacattgtaaagcactttc

SEQ ID NO: 46665 - DNA, 21 bp, Artificial sequence
  SiRNA target sequence
tgacattgtaaagcactttca

SEQ ID NO: 46666 - DNA, 21 bp, Artificial sequence
  SiRNA target sequence
gacattgtaaagcactttcaa

SEQ ID NO: 46667 - DNA, 21 bp, Artificial sequence
  SiRNA target sequence
acattgtaaagcactttcaaa

SEQ ID NO: 46668 - DNA, 21 bp, Artificial sequence
  SiRNA target sequence
cattgtaaagcactttcaaac

SEQ ID NO: 46669 - DNA, 21 bp, Artificial sequence
  SiRNA target sequence
attgtaaagcactttcaaact

SEQ ID NO: 46670 - DNA, 21 bp, Artificial sequence
  SiRNA target sequence
ttgtaaagcactttcaaactg

SEQ ID NO: 46671 - DNA, 21 bp, Artificial sequence
  SiRNA target sequence
tgtaaagcactttcaaactgc

SEQ ID NO: 46672 - DNA, 21 bp, Artificial sequence
  SiRNA target sequence
gtaaagcactttcaaactgct

SEQ ID NO: 46673 - DNA, 21 bp, Artificial sequence
  SiRNA target sequence
taaagcactttcaaactgctg

SEQ ID NO: 46674 - DNA, 21 bp, Artificial sequence
  SiRNA target sequence
aaagcactttcaaactgctga

SEQ ID NO: 46675 - DNA, 21 bp, Artificial sequence
  SiRNA target sequence
aagcactttcaaactgctgaa

SEQ ID NO: 46676 - DNA, 21 bp, Artificial sequence
  SiRNA target sequence
agcactttcaaactgctgaat

SEQ ID NO: 46677 - DNA, 21 bp, Artificial sequence
  SiRNA target sequence
gcactttcaaactgctgaatc

SEQ ID NO: 46678 - DNA, 21 bp, Artificial sequence
  SiRNA target sequence
cactttcaaactgctgaatca

SEQ ID NO: 46679 - DNA, 21 bp, Artificial sequence
  SiRNA target sequence
actttcaaactgctgaatcaa

SEQ ID NO: 46680 - DNA, 21 bp, Artificial sequence
  SiRNA target sequence
ctttcaaactgctgaatcaat

SEQ ID NO: 46681 - DNA, 21 bp, Artificial sequence
  SiRNA target sequence
tttcaaactgctgaatcaatg

SEQ ID NO: 46682 - DNA, 21 bp, Artificial sequence
  SiRNA target sequence
ttcaaactgctgaatcaatgt

SEQ ID NO: 46683 - DNA, 21 bp, Artificial sequence
  SiRNA target sequence
tcaaactgctgaatcaatgtc

SEQ ID NO: 46684 - DNA, 21 bp, Artificial sequence
  SiRNA target sequence
caaactgctgaatcaatgtca

SEQ ID NO: 46685 - DNA, 21 bp, Artificial sequence
  SiRNA target sequence
aaactgctgaatcaatgtcaa

SEQ ID NO: 46686 - DNA, 21 bp, Artificial sequence
  SiRNA target sequence
aactgctgaatcaatgtcaaa

SEQ ID NO: 46687 - DNA, 21 bp, Artificial sequence
  SiRNA target sequence
actgctgaatcaatgtcaaag

SEQ ID NO: 46688 - DNA, 21 bp, Artificial sequence
  SiRNA target sequence
ctgctgaatcaatgtcaaagt

SEQ ID NO: 46689 - DNA, 21 bp, Artificial sequence
  SiRNA target sequence
tgctgaatcaatgtcaaagtt

SEQ ID NO: 46690 - DNA, 21 bp, Artificial sequence
  SiRNA target sequence
gctgaatcaatgtcaaagttt

SEQ ID NO: 46691 - DNA, 21 bp, Artificial sequence
  SiRNA target sequence
ctgaatcaatgtcaaagttta

SEQ ID NO: 46692 - DNA, 21 bp, Artificial sequence
  SiRNA target sequence
tgaatcaatgtcaaagtttaa

SEQ ID NO: 46693 - DNA, 21 bp, Artificial sequence
  SiRNA target sequence
gaatcaatgtcaaagtttaag

SEQ ID NO: 46694 - DNA, 21 bp, Artificial sequence
  SiRNA target sequence
aatcaatgtcaaagtttaagc

SEQ ID NO: 46695 - DNA, 21 bp, Artificial sequence
  SiRNA target sequence
atcaatgtcaaagtttaagcg

SEQ ID NO: 46696 - DNA, 21 bp, Artificial sequence
  SiRNA target sequence
tcaatgtcaaagtttaagcga

SEQ ID NO: 46697 - DNA, 21 bp, Artificial sequence
  SiRNA target sequence
caatgtcaaagtttaagcgat

SEQ ID NO: 46698 - DNA, 21 bp, Artificial sequence
  SiRNA target sequence
aatgtcaaagtttaagcgatg

SEQ ID NO: 46699 - DNA, 21 bp, Artificial sequence
  SiRNA target sequence
atgtcaaagtttaagcgatgt

SEQ ID NO: 46700 - DNA, 21 bp, Artificial sequence
  SiRNA target sequence
tgtcaaagtttaagcgatgtg

SEQ ID NO: 46701 - DNA, 21 bp, Artificial sequence
  SiRNA target sequence
gtcaaagtttaagcgatgtga

SEQ ID NO: 46702 - DNA, 21 bp, Artificial sequence
  SiRNA target sequence
tcaaagtttaagcgatgtgag

SEQ ID NO: 46703 - DNA, 21 bp, Artificial sequence
  SiRNA target sequence
caaagtttaagcgatgtgagg

SEQ ID NO: 46704 - DNA, 21 bp, Artificial sequence
  SiRNA target sequence
aaagtttaagcgatgtgaggt

SEQ ID NO: 46705 - DNA, 21 bp, Artificial sequence
  SiRNA target sequence
aagtttaagcgatgtgaggtc

SEQ ID NO: 46706 - DNA, 21 bp, Artificial sequence
  SiRNA target sequence
agtttaagcgatgtgaggtca

SEQ ID NO: 46707 - DNA, 21 bp, Artificial sequence
  SiRNA target sequence
gtttaagcgatgtgaggtcac

SEQ ID NO: 46708 - DNA, 21 bp, Artificial sequence
  SiRNA target sequence
tttaagcgatgtgaggtcaca

SEQ ID NO: 46709 - DNA, 21 bp, Artificial sequence
  SiRNA target sequence
ttaagcgatgtgaggtcacat

SEQ ID NO: 46710 - DNA, 21 bp, Artificial sequence
  SiRNA target sequence
taagcgatgtgaggtcacatt

SEQ ID NO: 46711 - DNA, 21 bp, Artificial sequence
  SiRNA target sequence
aagcgatgtgaggtcacatta

SEQ ID NO: 46712 - DNA, 21 bp, Artificial sequence
  SiRNA target sequence
agcgatgtgaggtcacattac

SEQ ID NO: 46713 - DNA, 21 bp, Artificial sequence
  SiRNA target sequence
gcgatgtgaggtcacattacc

SEQ ID NO: 46714 - DNA, 21 bp, Artificial sequence
  SiRNA target sequence
cgatgtgaggtcacattacct

SEQ ID NO: 46715 - DNA, 21 bp, Artificial sequence
  SiRNA target sequence
gatgtgaggtcacattacctg

SEQ ID NO: 46716 - DNA, 21 bp, Artificial sequence
  SiRNA target sequence
atgtgaggtcacattacctgt

SEQ ID NO: 46717 - DNA, 21 bp, Artificial sequence
  SiRNA target sequence
tgtgaggtcacattacctgta

SEQ ID NO: 46718 - DNA, 21 bp, Artificial sequence
  SiRNA target sequence
gtgaggtcacattacctgtat

SEQ ID NO: 46719 - DNA, 21 bp, Artificial sequence
  SiRNA target sequence
tgaggtcacattacctgtatt

SEQ ID NO: 46720 - DNA, 21 bp, Artificial sequence
  SiRNA target sequence
gaggtcacattacctgtattg

SEQ ID NO: 46721 - DNA, 21 bp, Artificial sequence
  SiRNA target sequence
aggtcacattacctgtattgc

SEQ ID NO: 46722 - DNA, 21 bp, Artificial sequence
  SiRNA target sequence
ggtcacattacctgtattgcg

SEQ ID NO: 46723 - DNA, 21 bp, Artificial sequence
  SiRNA target sequence
gtcacattacctgtattgcgt

SEQ ID NO: 46724 - DNA, 21 bp, Artificial sequence
  SiRNA target sequence
tcacattacctgtattgcgtt

SEQ ID NO: 46725 - DNA, 21 bp, Artificial sequence
  SiRNA target sequence
cacattacctgtattgcgtta

SEQ ID NO: 46726 - DNA, 21 bp, Artificial sequence
  SiRNA target sequence
acattacctgtattgcgttac

SEQ ID NO: 46727 - DNA, 21 bp, Artificial sequence
  SiRNA target sequence
cattacctgtattgcgttact

SEQ ID NO: 46728 - DNA, 21 bp, Artificial sequence
  SiRNA target sequence
attacctgtattgcgttactc

SEQ ID NO: 46729 - DNA, 21 bp, Artificial sequence
  SiRNA target sequence
ttacctgtattgcgttactct

SEQ ID NO: 46730 - DNA, 21 bp, Artificial sequence
  SiRNA target sequence
tacctgtattgcgttactctc

SEQ ID NO: 46731 - DNA, 21 bp, Artificial sequence
  SiRNA target sequence
acctgtattgcgttactctca

SEQ ID NO: 46732 - DNA, 21 bp, Artificial sequence
  SiRNA target sequence
cctgtattgcgttactctcaa

SEQ ID NO: 46733 - DNA, 21 bp, Artificial sequence
  SiRNA target sequence
ctgtattgcgttactctcaaa

SEQ ID NO: 46734 - DNA, 21 bp, Artificial sequence
  SiRNA target sequence
tgtattgcgttactctcaaaa

SEQ ID NO: 46735 - DNA, 21 bp, Artificial sequence
  SiRNA target sequence
gtattgcgttactctcaaaaa

SEQ ID NO: 46736 - DNA, 21 bp, Artificial sequence
  SiRNA target sequence
tattgcgttactctcaaaaat

SEQ ID NO: 46737 - DNA, 21 bp, Artificial sequence
  SiRNA target sequence
attgcgttactctcaaaaatt

SEQ ID NO: 46738 - DNA, 21 bp, Artificial sequence
  SiRNA target sequence
ttgcgttactctcaaaaattg

SEQ ID NO: 46739 - DNA, 21 bp, Artificial sequence
  SiRNA target sequence
tgcgttactctcaaaaattgg

SEQ ID NO: 46740 - DNA, 21 bp, Artificial sequence
  SiRNA target sequence
gcgttactctcaaaaattgga

SEQ ID NO: 46741 - DNA, 21 bp, Artificial sequence
  SiRNA target sequence
cgttactctcaaaaattggaa

SEQ ID NO: 46742 - DNA, 21 bp, Artificial sequence
  SiRNA target sequence
gttactctcaaaaattggaaa

SEQ ID NO: 46743 - DNA, 21 bp, Artificial sequence
  SiRNA target sequence
ttactctcaaaaattggaaag

SEQ ID NO: 46744 - DNA, 21 bp, Artificial sequence
  SiRNA target sequence
tactctcaaaaattggaaaga

SEQ ID NO: 46745 - DNA, 21 bp, Artificial sequence
  SiRNA target sequence
actctcaaaaattggaaagat

SEQ ID NO: 46746 - DNA, 21 bp, Artificial sequence
  SiRNA target sequence
ctctcaaaaattggaaagatt

SEQ ID NO: 46747 - DNA, 21 bp, Artificial sequence
  SiRNA target sequence
tctcaaaaattggaaagattt

SEQ ID NO: 46748 - DNA, 21 bp, Artificial sequence
  SiRNA target sequence
ctcaaaaattggaaagattta

SEQ ID NO: 46749 - DNA, 21 bp, Artificial sequence
  SiRNA target sequence
tcaaaaattggaaagatttat

SEQ ID NO: 46750 - DNA, 21 bp, Artificial sequence
  SiRNA target sequence
caaaaattggaaagatttatg

SEQ ID NO: 46751 - DNA, 21 bp, Artificial sequence
  SiRNA target sequence
aaaaattggaaagatttatgt

SEQ ID NO: 46752 - DNA, 21 bp, Artificial sequence
  SiRNA target sequence
aaaattggaaagatttatgtc

SEQ ID NO: 46753 - DNA, 21 bp, Artificial sequence
  SiRNA target sequence
aaattggaaagatttatgtct

SEQ ID NO: 46754 - DNA, 21 bp, Artificial sequence
  SiRNA target sequence
aattggaaagatttatgtctt

SEQ ID NO: 46755 - DNA, 21 bp, Artificial sequence
  SiRNA target sequence
attggaaagatttatgtcttc

SEQ ID NO: 46756 - DNA, 21 bp, Artificial sequence
  SiRNA target sequence
ttggaaagatttatgtcttcc

SEQ ID NO: 46757 - DNA, 21 bp, Artificial sequence
  SiRNA target sequence
tggaaagatttatgtcttccc

SEQ ID NO: 46758 - DNA, 21 bp, Artificial sequence
  SiRNA target sequence
ggaaagatttatgtcttccct

SEQ ID NO: 46759 - DNA, 21 bp, Artificial sequence
  SiRNA target sequence
gaaagatttatgtcttccctt

SEQ ID NO: 46760 - DNA, 21 bp, Artificial sequence
  SiRNA target sequence
aaagatttatgtcttccctta

SEQ ID NO: 46761 - DNA, 21 bp, Artificial sequence
  SiRNA target sequence
aagatttatgtcttcccttat

SEQ ID NO: 46762 - DNA, 21 bp, Artificial sequence
  SiRNA target sequence
agatttatgtcttcccttatt

SEQ ID NO: 46763 - DNA, 21 bp, Artificial sequence
  SiRNA target sequence
gatttatgtcttcccttattg

SEQ ID NO: 46764 - DNA, 21 bp, Artificial sequence
  SiRNA target sequence
atttatgtcttcccttattga

SEQ ID NO: 46765 - DNA, 21 bp, Artificial sequence
  SiRNA target sequence
tttatgtcttcccttattgaa

SEQ ID NO: 46766 - DNA, 21 bp, Artificial sequence
  SiRNA target sequence
ttatgtcttcccttattgaat

SEQ ID NO: 46767 - DNA, 21 bp, Artificial sequence
  SiRNA target sequence
tatgtcttcccttattgaatg

SEQ ID NO: 46768 - DNA, 21 bp, Artificial sequence
  SiRNA target sequence
atgtcttcccttattgaatgt

SEQ ID NO: 46769 - DNA, 21 bp, Artificial sequence
  SiRNA target sequence
tgtcttcccttattgaatgtg

SEQ ID NO: 46770 - DNA, 21 bp, Artificial sequence
  SiRNA target sequence
gtcttcccttattgaatgtga

SEQ ID NO: 46771 - DNA, 21 bp, Artificial sequence
  SiRNA target sequence
tcttcccttattgaatgtgat

SEQ ID NO: 46772 - DNA, 21 bp, Artificial sequence
  SiRNA target sequence
cttcccttattgaatgtgata

SEQ ID NO: 46773 - DNA, 21 bp, Artificial sequence
  SiRNA target sequence
ttcccttattgaatgtgataa

SEQ ID NO: 46774 - DNA, 21 bp, Artificial sequence
  SiRNA target sequence
tcccttattgaatgtgataaa

SEQ ID NO: 46775 - DNA, 21 bp, Artificial sequence
  SiRNA target sequence
cccttattgaatgtgataaag

SEQ ID NO: 46776 - DNA, 21 bp, Artificial sequence
  SiRNA target sequence
ccttattgaatgtgataaagt

SEQ ID NO: 46777 - DNA, 21 bp, Artificial sequence
  SiRNA target sequence
cttattgaatgtgataaagta

SEQ ID NO: 46778 - DNA, 21 bp, Artificial sequence
  SiRNA target sequence
ttattgaatgtgataaagtag

SEQ ID NO: 46779 - DNA, 21 bp, Artificial sequence
  SiRNA target sequence
tattgaatgtgataaagtaga

SEQ ID NO: 46780 - DNA, 21 bp, Artificial sequence
  SiRNA target sequence
attgaatgtgataaagtagag

SEQ ID NO: 46781 - DNA, 21 bp, Artificial sequence
  SiRNA target sequence
ttgaatgtgataaagtagagg

SEQ ID NO: 46782 - DNA, 21 bp, Artificial sequence
  SiRNA target sequence
tgaatgtgataaagtagaggc

SEQ ID NO: 46783 - DNA, 21 bp, Artificial sequence
  SiRNA target sequence
gaatgtgataaagtagaggca

SEQ ID NO: 46784 - DNA, 21 bp, Artificial sequence
  SiRNA target sequence
aatgtgataaagtagaggcat

SEQ ID NO: 46785 - DNA, 21 bp, Artificial sequence
  SiRNA target sequence
atgtgataaagtagaggcatg

SEQ ID NO: 46786 - DNA, 21 bp, Artificial sequence
  SiRNA target sequence
tgtgataaagtagaggcatgt

SEQ ID NO: 46787 - DNA, 21 bp, Artificial sequence
  SiRNA target sequence
gtgataaagtagaggcatgtg

SEQ ID NO: 46788 - DNA, 21 bp, Artificial sequence
  SiRNA target sequence
tgataaagtagaggcatgtga

SEQ ID NO: 46789 - DNA, 21 bp, Artificial sequence
  SiRNA target sequence
gataaagtagaggcatgtgat

SEQ ID NO: 46790 - DNA, 21 bp, Artificial sequence
  SiRNA target sequence
ataaagtagaggcatgtgata

SEQ ID NO: 46791 - DNA, 21 bp, Artificial sequence
  SiRNA target sequence
taaagtagaggcatgtgataa

SEQ ID NO: 46792 - DNA, 21 bp, Artificial sequence
  SiRNA target sequence
aaagtagaggcatgtgataaa

SEQ ID NO: 46793 - DNA, 21 bp, Artificial sequence
  SiRNA target sequence
aagtagaggcatgtgataaaa

SEQ ID NO: 46794 - DNA, 21 bp, Artificial sequence
  SiRNA target sequence
agtagaggcatgtgataaaac

SEQ ID NO: 46795 - DNA, 21 bp, Artificial sequence
  SiRNA target sequence
gtagaggcatgtgataaaact

SEQ ID NO: 46796 - DNA, 21 bp, Artificial sequence
  SiRNA target sequence
tagaggcatgtgataaaactt

SEQ ID NO: 46797 - DNA, 21 bp, Artificial sequence
  SiRNA target sequence
agaggcatgtgataaaactta

SEQ ID NO: 46798 - DNA, 21 bp, Artificial sequence
  SiRNA target sequence
gaggcatgtgataaaacttat

SEQ ID NO: 46799 - DNA, 21 bp, Artificial sequence
  SiRNA target sequence
aggcatgtgataaaacttata

SEQ ID NO: 46800 - DNA, 21 bp, Artificial sequence
  SiRNA target sequence
ggcatgtgataaaacttatac

SEQ ID NO: 46801 - DNA, 21 bp, Artificial sequence
  SiRNA target sequence
gcatgtgataaaacttatacg

SEQ ID NO: 46802 - DNA, 21 bp, Artificial sequence
  SiRNA target sequence
catgtgataaaacttatacgc

SEQ ID NO: 46803 - DNA, 21 bp, Artificial sequence
  SiRNA target sequence
atgtgataaaacttatacgct

SEQ ID NO: 46804 - DNA, 21 bp, Artificial sequence
  SiRNA target sequence
tgtgataaaacttatacgcta

SEQ ID NO: 46805 - DNA, 21 bp, Artificial sequence
  SiRNA target sequence
gtgataaaacttatacgctaa

SEQ ID NO: 46806 - DNA, 21 bp, Artificial sequence
  SiRNA target sequence
tgataaaacttatacgctaaa

SEQ ID NO: 46807 - DNA, 21 bp, Artificial sequence
  SiRNA target sequence
gataaaacttatacgctaaat

SEQ ID NO: 46808 - DNA, 21 bp, Artificial sequence
  SiRNA target sequence
ataaaacttatacgctaaatg

SEQ ID NO: 46809 - DNA, 21 bp, Artificial sequence
  SiRNA target sequence
taaaacttatacgctaaatga

SEQ ID NO: 46810 - DNA, 21 bp, Artificial sequence
  SiRNA target sequence
aaaacttatacgctaaatgat

SEQ ID NO: 46811 - DNA, 21 bp, Artificial sequence
  SiRNA target sequence
aaacttatacgctaaatgatg

SEQ ID NO: 46812 - DNA, 21 bp, Artificial sequence
  SiRNA target sequence
aacttatacgctaaatgatgt

SEQ ID NO: 46813 - DNA, 21 bp, Artificial sequence
  SiRNA target sequence
acttatacgctaaatgatgtt

SEQ ID NO: 46814 - DNA, 21 bp, Artificial sequence
  SiRNA target sequence
cttatacgctaaatgatgtta

SEQ ID NO: 46815 - DNA, 21 bp, Artificial sequence
  SiRNA target sequence
ttatacgctaaatgatgttaa

SEQ ID NO: 46816 - DNA, 21 bp, Artificial sequence
  SiRNA target sequence
tatacgctaaatgatgttaag

SEQ ID NO: 46817 - DNA, 21 bp, Artificial sequence
  SiRNA target sequence
atacgctaaatgatgttaaga

SEQ ID NO: 46818 - DNA, 21 bp, Artificial sequence
  SiRNA target sequence
tacgctaaatgatgttaagaa

SEQ ID NO: 46819 - DNA, 21 bp, Artificial sequence
  SiRNA target sequence
acgctaaatgatgttaagaaa

SEQ ID NO: 46820 - DNA, 21 bp, Artificial sequence
  SiRNA target sequence
cgctaaatgatgttaagaaag

SEQ ID NO: 46821 - DNA, 21 bp, Artificial sequence
  SiRNA target sequence
gctaaatgatgttaagaaagg

SEQ ID NO: 46822 - DNA, 21 bp, Artificial sequence
  SiRNA target sequence
ctaaatgatgttaagaaagga

SEQ ID NO: 46823 - DNA, 21 bp, Artificial sequence
  SiRNA target sequence
taaatgatgttaagaaaggac

SEQ ID NO: 46824 - DNA, 21 bp, Artificial sequence
  SiRNA target sequence
aaatgatgttaagaaaggaca

SEQ ID NO: 46825 - DNA, 21 bp, Artificial sequence
  SiRNA target sequence
aatgatgttaagaaaggacaa

SEQ ID NO: 46826 - DNA, 21 bp, Artificial sequence
  SiRNA target sequence
atgatgttaagaaaggacaat

SEQ ID NO: 46827 - DNA, 21 bp, Artificial sequence
  SiRNA target sequence
tgatgttaagaaaggacaata

SEQ ID NO: 46828 - DNA, 21 bp, Artificial sequence
  SiRNA target sequence
gatgttaagaaaggacaatat

SEQ ID NO: 46829 - DNA, 21 bp, Artificial sequence
  SiRNA target sequence
atgttaagaaaggacaatata

SEQ ID NO: 46830 - DNA, 21 bp, Artificial sequence
  SiRNA target sequence
tgttaagaaaggacaatatat

SEQ ID NO: 46831 - DNA, 21 bp, Artificial sequence
  SiRNA target sequence
gttaagaaaggacaatatata

SEQ ID NO: 46832 - DNA, 21 bp, Artificial sequence
  SiRNA target sequence
ttaagaaaggacaatatatat

SEQ ID NO: 46833 - DNA, 21 bp, Artificial sequence
  SiRNA target sequence
taagaaaggacaatatatatt

SEQ ID NO: 46834 - DNA, 21 bp, Artificial sequence
  SiRNA target sequence
aagaaaggacaatatatattg

SEQ ID NO: 46835 - DNA, 21 bp, Artificial sequence
  SiRNA target sequence
agaaaggacaatatatattgc

SEQ ID NO: 46836 - DNA, 21 bp, Artificial sequence
  SiRNA target sequence
gaaaggacaatatatattgcg

SEQ ID NO: 46837 - DNA, 21 bp, Artificial sequence
  SiRNA target sequence
aaaggacaatatatattgcga

SEQ ID NO: 46838 - DNA, 21 bp, Artificial sequence
  SiRNA target sequence
aaggacaatatatattgcgac

SEQ ID NO: 46839 - DNA, 21 bp, Artificial sequence
  SiRNA target sequence
aggacaatatatattgcgaca

SEQ ID NO: 46840 - DNA, 21 bp, Artificial sequence
  SiRNA target sequence
ggacaatatatattgcgacaa

SEQ ID NO: 46841 - DNA, 21 bp, Artificial sequence
  SiRNA target sequence
gacaatatatattgcgacaag

SEQ ID NO: 46842 - DNA, 21 bp, Artificial sequence
  SiRNA target sequence
acaatatatattgcgacaagg

SEQ ID NO: 46843 - DNA, 21 bp, Artificial sequence
  SiRNA target sequence
caatatatattgcgacaagga

SEQ ID NO: 46844 - DNA, 21 bp, Artificial sequence
  SiRNA target sequence
aatatatattgcgacaaggat

SEQ ID NO: 46845 - DNA, 21 bp, Artificial sequence
  SiRNA target sequence
atatatattgcgacaaggatt

SEQ ID NO: 46846 - DNA, 21 bp, Artificial sequence
  SiRNA target sequence
tatatattgcgacaaggatta

SEQ ID NO: 46847 - DNA, 21 bp, Artificial sequence
  SiRNA target sequence
atatattgcgacaaggattag

SEQ ID NO: 46848 - DNA, 21 bp, Artificial sequence
  SiRNA target sequence
tatattgcgacaaggattaga

SEQ ID NO: 46849 - DNA, 21 bp, Artificial sequence
  SiRNA target sequence
atattgcgacaaggattagaa

SEQ ID NO: 46850 - DNA, 21 bp, Artificial sequence
  SiRNA target sequence
tattgcgacaaggattagaat

SEQ ID NO: 46851 - DNA, 21 bp, Artificial sequence
  SiRNA target sequence
attgcgacaaggattagaata

SEQ ID NO: 46852 - DNA, 21 bp, Artificial sequence
  SiRNA target sequence
ttgcgacaaggattagaatat

SEQ ID NO: 46853 - DNA, 21 bp, Artificial sequence
  SiRNA target sequence
tgcgacaaggattagaatata

SEQ ID NO: 46854 - DNA, 21 bp, Artificial sequence
  SiRNA target sequence
gcgacaaggattagaatatac

SEQ ID NO: 46855 - DNA, 21 bp, Artificial sequence
  SiRNA target sequence
cgacaaggattagaatatacg

SEQ ID NO: 46856 - DNA, 21 bp, Artificial sequence
  SiRNA target sequence
gacaaggattagaatatacga

SEQ ID NO: 46857 - DNA, 21 bp, Artificial sequence
  SiRNA target sequence
acaaggattagaatatacgat

SEQ ID NO: 46858 - DNA, 21 bp, Artificial sequence
  SiRNA target sequence
caaggattagaatatacgatg

SEQ ID NO: 46859 - DNA, 21 bp, Artificial sequence
  SiRNA target sequence
aaggattagaatatacgatgc

SEQ ID NO: 46860 - DNA, 21 bp, Artificial sequence
  SiRNA target sequence
aggattagaatatacgatgcc

SEQ ID NO: 46861 - DNA, 21 bp, Artificial sequence
  SiRNA target sequence
ggattagaatatacgatgccg

SEQ ID NO: 46862 - DNA, 21 bp, Artificial sequence
  SiRNA target sequence
gattagaatatacgatgccga

SEQ ID NO: 46863 - DNA, 21 bp, Artificial sequence
  SiRNA target sequence
attagaatatacgatgccgac

SEQ ID NO: 46864 - DNA, 21 bp, Artificial sequence
  SiRNA target sequence
ttagaatatacgatgccgaca

SEQ ID NO: 46865 - DNA, 21 bp, Artificial sequence
  SiRNA target sequence
tagaatatacgatgccgacaa

SEQ ID NO: 46866 - DNA, 21 bp, Artificial sequence
  SiRNA target sequence
agaatatacgatgccgacaat

SEQ ID NO: 46867 - DNA, 21 bp, Artificial sequence
  SiRNA target sequence
gaatatacgatgccgacaatt

SEQ ID NO: 46868 - DNA, 21 bp, Artificial sequence
  SiRNA target sequence
aatatacgatgccgacaattg

SEQ ID NO: 46869 - DNA, 21 bp, Artificial sequence
  SiRNA target sequence
atatacgatgccgacaattga

SEQ ID NO: 46870 - DNA, 21 bp, Artificial sequence
  SiRNA target sequence
tatacgatgccgacaattgat

SEQ ID NO: 46871 - DNA, 21 bp, Artificial sequence
  SiRNA target sequence
atacgatgccgacaattgatg

SEQ ID NO: 46872 - DNA, 21 bp, Artificial sequence
  SiRNA target sequence
tacgatgccgacaattgatgg

SEQ ID NO: 46873 - DNA, 21 bp, Artificial sequence
  SiRNA target sequence
acgatgccgacaattgatggt

SEQ ID NO: 46874 - DNA, 21 bp, Artificial sequence
  SiRNA target sequence
cgatgccgacaattgatggtg

SEQ ID NO: 46875 - DNA, 21 bp, Artificial sequence
  SiRNA target sequence
gatgccgacaattgatggtga

SEQ ID NO: 46876 - DNA, 21 bp, Artificial sequence
  SiRNA target sequence
atgccgacaattgatggtgat

SEQ ID NO: 46877 - DNA, 21 bp, Artificial sequence
  SiRNA target sequence
tgccgacaattgatggtgatt

SEQ ID NO: 46878 - DNA, 21 bp, Artificial sequence
  SiRNA target sequence
gccgacaattgatggtgattg

SEQ ID NO: 46879 - DNA, 21 bp, Artificial sequence
  SiRNA target sequence
ccgacaattgatggtgattgt

SEQ ID NO: 46880 - DNA, 21 bp, Artificial sequence
  SiRNA target sequence
cgacaattgatggtgattgtg

SEQ ID NO: 46881 - DNA, 21 bp, Artificial sequence
  SiRNA target sequence
gacaattgatggtgattgtgg

SEQ ID NO: 46882 - DNA, 21 bp, Artificial sequence
  SiRNA target sequence
acaattgatggtgattgtgga

SEQ ID NO: 46883 - DNA, 21 bp, Artificial sequence
  SiRNA target sequence
caattgatggtgattgtggag

SEQ ID NO: 46884 - DNA, 21 bp, Artificial sequence
  SiRNA target sequence
aattgatggtgattgtggagc

SEQ ID NO: 46885 - DNA, 21 bp, Artificial sequence
  SiRNA target sequence
attgatggtgattgtggagcc

SEQ ID NO: 46886 - DNA, 21 bp, Artificial sequence
  SiRNA target sequence
ttgatggtgattgtggagccc

SEQ ID NO: 46887 - DNA, 21 bp, Artificial sequence
  SiRNA target sequence
tgatggtgattgtggagcccc

SEQ ID NO: 46888 - DNA, 21 bp, Artificial sequence
  SiRNA target sequence
gatggtgattgtggagcccca

SEQ ID NO: 46889 - DNA, 21 bp, Artificial sequence
  SiRNA target sequence
atggtgattgtggagccccac

SEQ ID NO: 46890 - DNA, 21 bp, Artificial sequence
  SiRNA target sequence
tggtgattgtggagccccact

SEQ ID NO: 46891 - DNA, 21 bp, Artificial sequence
  SiRNA target sequence
ggtgattgtggagccccacta

SEQ ID NO: 46892 - DNA, 21 bp, Artificial sequence
  SiRNA target sequence
gtgattgtggagccccactaa

SEQ ID NO: 46893 - DNA, 21 bp, Artificial sequence
  SiRNA target sequence
tgattgtggagccccactaat

SEQ ID NO: 46894 - DNA, 21 bp, Artificial sequence
  SiRNA target sequence
gattgtggagccccactaatc

SEQ ID NO: 46895 - DNA, 21 bp, Artificial sequence
  SiRNA target sequence
attgtggagccccactaatca

SEQ ID NO: 46896 - DNA, 21 bp, Artificial sequence
  SiRNA target sequence
ttgtggagccccactaatcat

SEQ ID NO: 46897 - DNA, 21 bp, Artificial sequence
  SiRNA target sequence
tgtggagccccactaatcatc

SEQ ID NO: 46898 - DNA, 21 bp, Artificial sequence
  SiRNA target sequence
gtggagccccactaatcatca

SEQ ID NO: 46899 - DNA, 21 bp, Artificial sequence
  SiRNA target sequence
tggagccccactaatcatcaa

SEQ ID NO: 46900 - DNA, 21 bp, Artificial sequence
  SiRNA target sequence
ggagccccactaatcatcaat

SEQ ID NO: 46901 - DNA, 21 bp, Artificial sequence
  SiRNA target sequence
gagccccactaatcatcaatg

SEQ ID NO: 46902 - DNA, 21 bp, Artificial sequence
  SiRNA target sequence
agccccactaatcatcaatga

SEQ ID NO: 46903 - DNA, 21 bp, Artificial sequence
  SiRNA target sequence
gccccactaatcatcaatgaa

SEQ ID NO: 46904 - DNA, 21 bp, Artificial sequence
  SiRNA target sequence
ccccactaatcatcaatgaaa

SEQ ID NO: 46905 - DNA, 21 bp, Artificial sequence
  SiRNA target sequence
cccactaatcatcaatgaaac

SEQ ID NO: 46906 - DNA, 21 bp, Artificial sequence
  SiRNA target sequence
ccactaatcatcaatgaaaca

SEQ ID NO: 46907 - DNA, 21 bp, Artificial sequence
  SiRNA target sequence
cactaatcatcaatgaaacac

SEQ ID NO: 46908 - DNA, 21 bp, Artificial sequence
  SiRNA target sequence
actaatcatcaatgaaacaca

SEQ ID NO: 46909 - DNA, 21 bp, Artificial sequence
  SiRNA target sequence
ctaatcatcaatgaaacacag

SEQ ID NO: 46910 - DNA, 21 bp, Artificial sequence
  SiRNA target sequence
taatcatcaatgaaacacagg

SEQ ID NO: 46911 - DNA, 21 bp, Artificial sequence
  SiRNA target sequence
aatcatcaatgaaacacaggt

SEQ ID NO: 46912 - DNA, 21 bp, Artificial sequence
  SiRNA target sequence
atcatcaatgaaacacaggtt

SEQ ID NO: 46913 - DNA, 21 bp, Artificial sequence
  SiRNA target sequence
tcatcaatgaaacacaggtta

SEQ ID NO: 46914 - DNA, 21 bp, Artificial sequence
  SiRNA target sequence
catcaatgaaacacaggttac

SEQ ID NO: 46915 - DNA, 21 bp, Artificial sequence
  SiRNA target sequence
atcaatgaaacacaggttact

SEQ ID NO: 46916 - DNA, 21 bp, Artificial sequence
  SiRNA target sequence
tcaatgaaacacaggttacta

SEQ ID NO: 46917 - DNA, 21 bp, Artificial sequence
  SiRNA target sequence
caatgaaacacaggttactag

SEQ ID NO: 46918 - DNA, 21 bp, Artificial sequence
  SiRNA target sequence
aatgaaacacaggttactaga

SEQ ID NO: 46919 - DNA, 21 bp, Artificial sequence
  SiRNA target sequence
atgaaacacaggttactagaa

SEQ ID NO: 46920 - DNA, 21 bp, Artificial sequence
  SiRNA target sequence
tgaaacacaggttactagaaa

SEQ ID NO: 46921 - DNA, 21 bp, Artificial sequence
  SiRNA target sequence
gaaacacaggttactagaaag

SEQ ID NO: 46922 - DNA, 21 bp, Artificial sequence
  SiRNA target sequence
aaacacaggttactagaaaga

SEQ ID NO: 46923 - DNA, 21 bp, Artificial sequence
  SiRNA target sequence
aacacaggttactagaaagat

SEQ ID NO: 46924 - DNA, 21 bp, Artificial sequence
  SiRNA target sequence
acacaggttactagaaagata

SEQ ID NO: 46925 - DNA, 21 bp, Artificial sequence
  SiRNA target sequence
cacaggttactagaaagatag

SEQ ID NO: 46926 - DNA, 21 bp, Artificial sequence
  SiRNA target sequence
acaggttactagaaagatagc

SEQ ID NO: 46927 - DNA, 21 bp, Artificial sequence
  SiRNA target sequence
caggttactagaaagatagct

SEQ ID NO: 46928 - DNA, 21 bp, Artificial sequence
  SiRNA target sequence
aggttactagaaagatagctg

SEQ ID NO: 46929 - DNA, 21 bp, Artificial sequence
  SiRNA target sequence
ggttactagaaagatagctgg

SEQ ID NO: 46930 - DNA, 21 bp, Artificial sequence
  SiRNA target sequence
gttactagaaagatagctggt

SEQ ID NO: 46931 - DNA, 21 bp, Artificial sequence
  SiRNA target sequence
ttactagaaagatagctggta

SEQ ID NO: 46932 - DNA, 21 bp, Artificial sequence
  SiRNA target sequence
tactagaaagatagctggtat

SEQ ID NO: 46933 - DNA, 21 bp, Artificial sequence
  SiRNA target sequence
actagaaagatagctggtata

SEQ ID NO: 46934 - DNA, 21 bp, Artificial sequence
  SiRNA target sequence
ctagaaagatagctggtatac

SEQ ID NO: 46935 - DNA, 21 bp, Artificial sequence
  SiRNA target sequence
tagaaagatagctggtataca

SEQ ID NO: 46936 - DNA, 21 bp, Artificial sequence
  SiRNA target sequence
agaaagatagctggtatacat

SEQ ID NO: 46937 - DNA, 21 bp, Artificial sequence
  SiRNA target sequence
gaaagatagctggtatacatg

SEQ ID NO: 46938 - DNA, 21 bp, Artificial sequence
  SiRNA target sequence
aaagatagctggtatacatgt

SEQ ID NO: 46939 - DNA, 21 bp, Artificial sequence
  SiRNA target sequence
aagatagctggtatacatgtt

SEQ ID NO: 46940 - DNA, 21 bp, Artificial sequence
  SiRNA target sequence
agatagctggtatacatgttg

SEQ ID NO: 46941 - DNA, 21 bp, Artificial sequence
  SiRNA target sequence
gatagctggtatacatgttgc

SEQ ID NO: 46942 - DNA, 21 bp, Artificial sequence
  SiRNA target sequence
atagctggtatacatgttgct

SEQ ID NO: 46943 - DNA, 21 bp, Artificial sequence
  SiRNA target sequence
tagctggtatacatgttgctg

SEQ ID NO: 46944 - DNA, 21 bp, Artificial sequence
  SiRNA target sequence
agctggtatacatgttgctgg

SEQ ID NO: 46945 - DNA, 21 bp, Artificial sequence
  SiRNA target sequence
gctggtatacatgttgctggt

SEQ ID NO: 46946 - DNA, 21 bp, Artificial sequence
  SiRNA target sequence
ctggtatacatgttgctggtg

SEQ ID NO: 46947 - DNA, 21 bp, Artificial sequence
  SiRNA target sequence
tggtatacatgttgctggtgc

SEQ ID NO: 46948 - DNA, 21 bp, Artificial sequence
  SiRNA target sequence
ggtatacatgttgctggtgca

SEQ ID NO: 46949 - DNA, 21 bp, Artificial sequence
  SiRNA target sequence
gtatacatgttgctggtgcag

SEQ ID NO: 46950 - DNA, 21 bp, Artificial sequence
  SiRNA target sequence
tatacatgttgctggtgcagc

SEQ ID NO: 46951 - DNA, 21 bp, Artificial sequence
  SiRNA target sequence
atacatgttgctggtgcagca

SEQ ID NO: 46952 - DNA, 21 bp, Artificial sequence
  SiRNA target sequence
tacatgttgctggtgcagcat

SEQ ID NO: 46953 - DNA, 21 bp, Artificial sequence
  SiRNA target sequence
acatgttgctggtgcagcatg

SEQ ID NO: 46954 - DNA, 21 bp, Artificial sequence
  SiRNA target sequence
catgttgctggtgcagcatgt

SEQ ID NO: 46955 - DNA, 21 bp, Artificial sequence
  SiRNA target sequence
atgttgctggtgcagcatgtg

SEQ ID NO: 46956 - DNA, 21 bp, Artificial sequence
  SiRNA target sequence
tgttgctggtgcagcatgtgg

SEQ ID NO: 46957 - DNA, 21 bp, Artificial sequence
  SiRNA target sequence
gttgctggtgcagcatgtggt

SEQ ID NO: 46958 - DNA, 21 bp, Artificial sequence
  SiRNA target sequence
ttgctggtgcagcatgtggtc

SEQ ID NO: 46959 - DNA, 21 bp, Artificial sequence
  SiRNA target sequence
tgctggtgcagcatgtggtcg

SEQ ID NO: 46960 - DNA, 21 bp, Artificial sequence
  SiRNA target sequence
gctggtgcagcatgtggtcga

SEQ ID NO: 46961 - DNA, 21 bp, Artificial sequence
  SiRNA target sequence
ctggtgcagcatgtggtcgag

SEQ ID NO: 46962 - DNA, 21 bp, Artificial sequence
  SiRNA target sequence
tggtgcagcatgtggtcgagc

SEQ ID NO: 46963 - DNA, 21 bp, Artificial sequence
  SiRNA target sequence
ggtgcagcatgtggtcgagct

SEQ ID NO: 46964 - DNA, 21 bp, Artificial sequence
  SiRNA target sequence
gtgcagcatgtggtcgagctt

SEQ ID NO: 46965 - DNA, 21 bp, Artificial sequence
  SiRNA target sequence
tgcagcatgtggtcgagctta

SEQ ID NO: 46966 - DNA, 21 bp, Artificial sequence
  SiRNA target sequence
gcagcatgtggtcgagcttat

SEQ ID NO: 46967 - DNA, 21 bp, Artificial sequence
  SiRNA target sequence
cagcatgtggtcgagcttatg

SEQ ID NO: 46968 - DNA, 21 bp, Artificial sequence
  SiRNA target sequence
agcatgtggtcgagcttatgc

SEQ ID NO: 46969 - DNA, 21 bp, Artificial sequence
  SiRNA target sequence
gcatgtggtcgagcttatgca

SEQ ID NO: 46970 - DNA, 21 bp, Artificial sequence
  SiRNA target sequence
catgtggtcgagcttatgcag

SEQ ID NO: 46971 - DNA, 21 bp, Artificial sequence
  SiRNA target sequence
atgtggtcgagcttatgcaga

SEQ ID NO: 46972 - DNA, 21 bp, Artificial sequence
  SiRNA target sequence
tgtggtcgagcttatgcagaa

SEQ ID NO: 46973 - DNA, 21 bp, Artificial sequence
  SiRNA target sequence
gtggtcgagcttatgcagaat

SEQ ID NO: 46974 - DNA, 21 bp, Artificial sequence
  SiRNA target sequence
tggtcgagcttatgcagaatc

SEQ ID NO: 46975 - DNA, 21 bp, Artificial sequence
  SiRNA target sequence
ggtcgagcttatgcagaatct

SEQ ID NO: 46976 - DNA, 21 bp, Artificial sequence
  SiRNA target sequence
gtcgagcttatgcagaatcta

SEQ ID NO: 46977 - DNA, 21 bp, Artificial sequence
  SiRNA target sequence
tcgagcttatgcagaatctat

SEQ ID NO: 46978 - DNA, 21 bp, Artificial sequence
  SiRNA target sequence
cgagcttatgcagaatctata

SEQ ID NO: 46979 - DNA, 21 bp, Artificial sequence
  SiRNA target sequence
gagcttatgcagaatctataa

SEQ ID NO: 46980 - DNA, 21 bp, Artificial sequence
  SiRNA target sequence
agcttatgcagaatctataac

SEQ ID NO: 46981 - DNA, 21 bp, Artificial sequence
  SiRNA target sequence
gcttatgcagaatctataacc

SEQ ID NO: 46982 - DNA, 21 bp, Artificial sequence
  SiRNA target sequence
cttatgcagaatctataaccc

SEQ ID NO: 46983 - DNA, 21 bp, Artificial sequence
  SiRNA target sequence
ttatgcagaatctataaccca

SEQ ID NO: 46984 - DNA, 21 bp, Artificial sequence
  SiRNA target sequence
tatgcagaatctataacccaa

SEQ ID NO: 46985 - DNA, 21 bp, Artificial sequence
  SiRNA target sequence
atgcagaatctataacccaaa

SEQ ID NO: 46986 - DNA, 21 bp, Artificial sequence
  SiRNA target sequence
tgcagaatctataacccaaaa

SEQ ID NO: 46987 - DNA, 21 bp, Artificial sequence
  SiRNA target sequence
gcagaatctataacccaaaaa

SEQ ID NO: 46988 - DNA, 21 bp, Artificial sequence
  SiRNA target sequence
cagaatctataacccaaaaag

SEQ ID NO: 46989 - DNA, 21 bp, Artificial sequence
  SiRNA target sequence
agaatctataacccaaaaaga

SEQ ID NO: 46990 - DNA, 21 bp, Artificial sequence
  SiRNA target sequence
gaatctataacccaaaaagat

SEQ ID NO: 46991 - DNA, 21 bp, Artificial sequence
  SiRNA target sequence
aatctataacccaaaaagatt

SEQ ID NO: 46992 - DNA, 21 bp, Artificial sequence
  SiRNA target sequence
atctataacccaaaaagattt

SEQ ID NO: 46993 - DNA, 21 bp, Artificial sequence
  SiRNA target sequence
tctataacccaaaaagatttg

SEQ ID NO: 46994 - DNA, 21 bp, Artificial sequence
  SiRNA target sequence
ctataacccaaaaagatttgg

SEQ ID NO: 46995 - DNA, 21 bp, Artificial sequence
  SiRNA target sequence
tataacccaaaaagatttgga

SEQ ID NO: 46996 - DNA, 21 bp, Artificial sequence
  SiRNA target sequence
ataacccaaaaagatttggag

SEQ ID NO: 46997 - DNA, 21 bp, Artificial sequence
  SiRNA target sequence
taacccaaaaagatttggagc

SEQ ID NO: 46998 - DNA, 21 bp, Artificial sequence
  SiRNA target sequence
aacccaaaaagatttggagcg

SEQ ID NO: 46999 - DNA, 21 bp, Artificial sequence
  SiRNA target sequence
acccaaaaagatttggagcgt

SEQ ID NO: 47000 - DNA, 21 bp, Artificial sequence
  SiRNA target sequence
cccaaaaagatttggagcgta

SEQ ID NO: 47001 - DNA, 21 bp, Artificial sequence
  SiRNA target sequence
ccaaaaagatttggagcgtac

SEQ ID NO: 47002 - DNA, 21 bp, Artificial sequence
  SiRNA target sequence
caaaaagatttggagcgtaca

SEQ ID NO: 47003 - DNA, 21 bp, Artificial sequence
  SiRNA target sequence
aaaaagatttggagcgtacat

SEQ ID NO: 47004 - DNA, 21 bp, Artificial sequence
  SiRNA target sequence
aaaagatttggagcgtacatt

SEQ ID NO: 47005 - DNA, 21 bp, Artificial sequence
  SiRNA target sequence
aaagatttggagcgtacattt

SEQ ID NO: 47006 - DNA, 21 bp, Artificial sequence
  SiRNA target sequence
aagatttggagcgtacattta

SEQ ID NO: 47007 - DNA, 21 bp, Artificial sequence
  SiRNA target sequence
agatttggagcgtacatttag

SEQ ID NO: 47008 - DNA, 21 bp, Artificial sequence
  SiRNA target sequence
gatttggagcgtacatttagt

SEQ ID NO: 47009 - DNA, 21 bp, Artificial sequence
  SiRNA target sequence
atttggagcgtacatttagta

SEQ ID NO: 47010 - DNA, 21 bp, Artificial sequence
  SiRNA target sequence
tttggagcgtacatttagtaa

SEQ ID NO: 47011 - DNA, 21 bp, Artificial sequence
  SiRNA target sequence
ttggagcgtacatttagtaaa

SEQ ID NO: 47012 - DNA, 21 bp, Artificial sequence
  SiRNA target sequence
tggagcgtacatttagtaaaa

SEQ ID NO: 47013 - DNA, 21 bp, Artificial sequence
  SiRNA target sequence
ggagcgtacatttagtaaaat

SEQ ID NO: 47014 - DNA, 21 bp, Artificial sequence
  SiRNA target sequence
gagcgtacatttagtaaaata

SEQ ID NO: 47015 - DNA, 21 bp, Artificial sequence
  SiRNA target sequence
agcgtacatttagtaaaatag

SEQ ID NO: 47016 - DNA, 21 bp, Artificial sequence
  SiRNA target sequence
gcgtacatttagtaaaataga

SEQ ID NO: 47017 - DNA, 21 bp, Artificial sequence
  SiRNA target sequence
cgtacatttagtaaaatagat

SEQ ID NO: 47018 - DNA, 21 bp, Artificial sequence
  SiRNA target sequence
gtacatttagtaaaatagatg

SEQ ID NO: 47019 - DNA, 21 bp, Artificial sequence
  SiRNA target sequence
tacatttagtaaaatagatgt

SEQ ID NO: 47020 - DNA, 21 bp, Artificial sequence
  SiRNA target sequence
acatttagtaaaatagatgtt

SEQ ID NO: 47021 - DNA, 21 bp, Artificial sequence
  SiRNA target sequence
catttagtaaaatagatgtta

SEQ ID NO: 47022 - DNA, 21 bp, Artificial sequence
  SiRNA target sequence
atttagtaaaatagatgttac

SEQ ID NO: 47023 - DNA, 21 bp, Artificial sequence
  SiRNA target sequence
tttagtaaaatagatgttacg

SEQ ID NO: 47024 - DNA, 21 bp, Artificial sequence
  SiRNA target sequence
ttagtaaaatagatgttacga

SEQ ID NO: 47025 - DNA, 21 bp, Artificial sequence
  SiRNA target sequence
tagtaaaatagatgttacgat

SEQ ID NO: 47026 - DNA, 21 bp, Artificial sequence
  SiRNA target sequence
agtaaaatagatgttacgatg

SEQ ID NO: 47027 - DNA, 21 bp, Artificial sequence
  SiRNA target sequence
gtaaaatagatgttacgatgc

SEQ ID NO: 47028 - DNA, 21 bp, Artificial sequence
  SiRNA target sequence
taaaatagatgttacgatgca

SEQ ID NO: 47029 - DNA, 21 bp, Artificial sequence
  SiRNA target sequence
aaaatagatgttacgatgcaa

SEQ ID NO: 47030 - DNA, 21 bp, Artificial sequence
  SiRNA target sequence
aaatagatgttacgatgcaaa

SEQ ID NO: 47031 - DNA, 21 bp, Artificial sequence
  SiRNA target sequence
aatagatgttacgatgcaaat

SEQ ID NO: 47032 - DNA, 21 bp, Artificial sequence
  SiRNA target sequence
atagatgttacgatgcaaatc

SEQ ID NO: 47033 - DNA, 21 bp, Artificial sequence
  SiRNA target sequence
tagatgttacgatgcaaatcc

SEQ ID NO: 47034 - DNA, 21 bp, Artificial sequence
  SiRNA target sequence
agatgttacgatgcaaatcca

SEQ ID NO: 47035 - DNA, 21 bp, Artificial sequence
  SiRNA target sequence
gatgttacgatgcaaatccaa

SEQ ID NO: 47036 - DNA, 21 bp, Artificial sequence
  SiRNA target sequence
atgttacgatgcaaatccaat

SEQ ID NO: 47037 - DNA, 21 bp, Artificial sequence
  SiRNA target sequence
tgttacgatgcaaatccaatt

SEQ ID NO: 47038 - DNA, 21 bp, Artificial sequence
  SiRNA target sequence
gttacgatgcaaatccaattg

SEQ ID NO: 47039 - DNA, 21 bp, Artificial sequence
  SiRNA target sequence
ttacgatgcaaatccaattgg

SEQ ID NO: 47040 - DNA, 21 bp, Artificial sequence
  SiRNA target sequence
tacgatgcaaatccaattgga

SEQ ID NO: 47041 - DNA, 21 bp, Artificial sequence
  SiRNA target sequence
acgatgcaaatccaattggat

SEQ ID NO: 47042 - DNA, 21 bp, Artificial sequence
  SiRNA target sequence
cgatgcaaatccaattggatt

SEQ ID NO: 47043 - DNA, 21 bp, Artificial sequence
  SiRNA target sequence
gatgcaaatccaattggattt

SEQ ID NO: 47044 - DNA, 21 bp, Artificial sequence
  SiRNA target sequence
atgcaaatccaattggattta

SEQ ID NO: 47045 - DNA, 21 bp, Artificial sequence
  SiRNA target sequence
tgcaaatccaattggatttag

SEQ ID NO: 47046 - DNA, 21 bp, Artificial sequence
  SiRNA target sequence
gcaaatccaattggatttaga

SEQ ID NO: 47047 - DNA, 21 bp, Artificial sequence
  SiRNA target sequence
caaatccaattggatttagat

SEQ ID NO: 47048 - DNA, 21 bp, Artificial sequence
  SiRNA target sequence
aaatccaattggatttagatt

SEQ ID NO: 47049 - DNA, 21 bp, Artificial sequence
  SiRNA target sequence
aatccaattggatttagattc

SEQ ID NO: 47050 - DNA, 21 bp, Artificial sequence
  SiRNA target sequence
atccaattggatttagattct

SEQ ID NO: 47051 - DNA, 21 bp, Artificial sequence
  SiRNA target sequence
tccaattggatttagattctt

SEQ ID NO: 47052 - DNA, 21 bp, Artificial sequence
  SiRNA target sequence
ccaattggatttagattcttc

SEQ ID NO: 47053 - DNA, 21 bp, Artificial sequence
  SiRNA target sequence
caattggatttagattcttca

SEQ ID NO: 47054 - DNA, 21 bp, Artificial sequence
  SiRNA target sequence
aattggatttagattcttcat

SEQ ID NO: 47055 - DNA, 21 bp, Artificial sequence
  SiRNA target sequence
attggatttagattcttcatt

SEQ ID NO: 47056 - DNA, 21 bp, Artificial sequence
  SiRNA target sequence
ttggatttagattcttcatta

SEQ ID NO: 47057 - DNA, 21 bp, Artificial sequence
  SiRNA target sequence
tggatttagattcttcattag

SEQ ID NO: 47058 - DNA, 21 bp, Artificial sequence
  SiRNA target sequence
ggatttagattcttcattaga

SEQ ID NO: 47059 - DNA, 21 bp, Artificial sequence
  SiRNA target sequence
gatttagattcttcattagat

SEQ ID NO: 47060 - DNA, 21 bp, Artificial sequence
  SiRNA target sequence
atttagattcttcattagatt

SEQ ID NO: 47061 - DNA, 21 bp, Artificial sequence
  SiRNA target sequence
tttagattcttcattagattt

SEQ ID NO: 47062 - DNA, 21 bp, Artificial sequence
  SiRNA target sequence
ttagattcttcattagatttt

SEQ ID NO: 47063 - DNA, 21 bp, Artificial sequence
  SiRNA target sequence
tagattcttcattagattttt

SEQ ID NO: 47064 - DNA, 21 bp, Artificial sequence
  SiRNA target sequence
agattcttcattagatttttc

SEQ ID NO: 47065 - DNA, 21 bp, Artificial sequence
  SiRNA target sequence
gattcttcattagatttttct

SEQ ID NO: 47066 - DNA, 21 bp, Artificial sequence
  SiRNA target sequence
attcttcattagatttttcta

SEQ ID NO: 47067 - DNA, 21 bp, Artificial sequence
  SiRNA target sequence
ttcttcattagatttttctag

SEQ ID NO: 47068 - DNA, 21 bp, Artificial sequence
  SiRNA target sequence
tcttcattagatttttctaga

SEQ ID NO: 47069 - DNA, 21 bp, Artificial sequence
  SiRNA target sequence
cttcattagatttttctagaa

SEQ ID NO: 47070 - DNA, 21 bp, Artificial sequence
  SiRNA target sequence
ttcattagatttttctagaac

SEQ ID NO: 47071 - DNA, 21 bp, Artificial sequence
  SiRNA target sequence
tcattagatttttctagaacc

SEQ ID NO: 47072 - DNA, 21 bp, Artificial sequence
  SiRNA target sequence
cattagatttttctagaaccg

SEQ ID NO: 47073 - DNA, 21 bp, Artificial sequence
  SiRNA target sequence
attagatttttctagaaccga

SEQ ID NO: 47074 - DNA, 21 bp, Artificial sequence
  SiRNA target sequence
ttagatttttctagaaccgaa

SEQ ID NO: 47075 - DNA, 21 bp, Artificial sequence
  SiRNA target sequence
tagatttttctagaaccgaac

SEQ ID NO: 47076 - DNA, 21 bp, Artificial sequence
  SiRNA target sequence
agatttttctagaaccgaacc

SEQ ID NO: 47077 - DNA, 21 bp, Artificial sequence
  SiRNA target sequence
gatttttctagaaccgaaccc

SEQ ID NO: 47078 - DNA, 21 bp, Artificial sequence
  SiRNA target sequence
atttttctagaaccgaaccca

SEQ ID NO: 47079 - DNA, 21 bp, Artificial sequence
  SiRNA target sequence
tttttctagaaccgaacccaa

SEQ ID NO: 47080 - DNA, 21 bp, Artificial sequence
  SiRNA target sequence
ttttctagaaccgaacccaaa

SEQ ID NO: 47081 - DNA, 21 bp, Artificial sequence
  SiRNA target sequence
tttctagaaccgaacccaaaa

SEQ ID NO: 47082 - DNA, 21 bp, Artificial sequence
  SiRNA target sequence
ttctagaaccgaacccaaaat

SEQ ID NO: 47083 - DNA, 21 bp, Artificial sequence
  SiRNA target sequence
tctagaaccgaacccaaaatt

SEQ ID NO: 47084 - DNA, 21 bp, Artificial sequence
  SiRNA target sequence
ctagaaccgaacccaaaattc

SEQ ID NO: 47085 - DNA, 21 bp, Artificial sequence
  SiRNA target sequence
tagaaccgaacccaaaattcc

SEQ ID NO: 47086 - DNA, 21 bp, Artificial sequence
  SiRNA target sequence
agaaccgaacccaaaattcct

SEQ ID NO: 47087 - DNA, 21 bp, Artificial sequence
  SiRNA target sequence
gaaccgaacccaaaattcctg

SEQ ID NO: 47088 - DNA, 21 bp, Artificial sequence
  SiRNA target sequence
aaccgaacccaaaattcctgc

SEQ ID NO: 47089 - DNA, 21 bp, Artificial sequence
  SiRNA target sequence
accgaacccaaaattcctgct

SEQ ID NO: 47090 - DNA, 21 bp, Artificial sequence
  SiRNA target sequence
ccgaacccaaaattcctgctg

SEQ ID NO: 47091 - DNA, 21 bp, Artificial sequence
  SiRNA target sequence
cgaacccaaaattcctgctgg

SEQ ID NO: 47092 - DNA, 21 bp, Artificial sequence
  SiRNA target sequence
gaacccaaaattcctgctgga

SEQ ID NO: 47093 - DNA, 21 bp, Artificial sequence
  SiRNA target sequence
aacccaaaattcctgctggag

SEQ ID NO: 47094 - DNA, 21 bp, Artificial sequence
  SiRNA target sequence
acccaaaattcctgctggagt

SEQ ID NO: 47095 - DNA, 21 bp, Artificial sequence
  SiRNA target sequence
cccaaaattcctgctggagtc

SEQ ID NO: 47096 - DNA, 21 bp, Artificial sequence
  SiRNA target sequence
ccaaaattcctgctggagtcg

SEQ ID NO: 47097 - DNA, 21 bp, Artificial sequence
  SiRNA target sequence
caaaattcctgctggagtcga

SEQ ID NO: 47098 - DNA, 21 bp, Artificial sequence
  SiRNA target sequence
aaaattcctgctggagtcgaa

SEQ ID NO: 47099 - DNA, 21 bp, Artificial sequence
  SiRNA target sequence
aaattcctgctggagtcgaat

SEQ ID NO: 47100 - DNA, 21 bp, Artificial sequence
  SiRNA target sequence
aattcctgctggagtcgaatt

SEQ ID NO: 47101 - DNA, 21 bp, Artificial sequence
  SiRNA target sequence
attcctgctggagtcgaattt

SEQ ID NO: 47102 - DNA, 21 bp, Artificial sequence
  SiRNA target sequence
ttcctgctggagtcgaatttg

SEQ ID NO: 47103 - DNA, 21 bp, Artificial sequence
  SiRNA target sequence
tcctgctggagtcgaatttgg

SEQ ID NO: 47104 - DNA, 21 bp, Artificial sequence
  SiRNA target sequence
cctgctggagtcgaatttgga

SEQ ID NO: 47105 - DNA, 21 bp, Artificial sequence
  SiRNA target sequence
ctgctggagtcgaatttggac

SEQ ID NO: 47106 - DNA, 21 bp, Artificial sequence
  SiRNA target sequence
tgctggagtcgaatttggacc

SEQ ID NO: 47107 - DNA, 21 bp, Artificial sequence
  SiRNA target sequence
gctggagtcgaatttggaccg

SEQ ID NO: 47108 - DNA, 21 bp, Artificial sequence
  SiRNA target sequence
ctggagtcgaatttggaccgg

SEQ ID NO: 47109 - DNA, 21 bp, Artificial sequence
  SiRNA target sequence
tggagtcgaatttggaccgga

SEQ ID NO: 47110 - DNA, 21 bp, Artificial sequence
  SiRNA target sequence
ggagtcgaatttggaccggaa

SEQ ID NO: 47111 - DNA, 21 bp, Artificial sequence
  SiRNA target sequence
gagtcgaatttggaccggaag

SEQ ID NO: 47112 - DNA, 21 bp, Artificial sequence
  SiRNA target sequence
agtcgaatttggaccggaagc

SEQ ID NO: 47113 - DNA, 21 bp, Artificial sequence
  SiRNA target sequence
gtcgaatttggaccggaagct

SEQ ID NO: 47114 - DNA, 21 bp, Artificial sequence
  SiRNA target sequence
tcgaatttggaccggaagctc

SEQ ID NO: 47115 - DNA, 21 bp, Artificial sequence
  SiRNA target sequence
cgaatttggaccggaagctct

SEQ ID NO: 47116 - DNA, 21 bp, Artificial sequence
  SiRNA target sequence
gaatttggaccggaagctctc

SEQ ID NO: 47117 - DNA, 21 bp, Artificial sequence
  SiRNA target sequence
aatttggaccggaagctctca

SEQ ID NO: 47118 - DNA, 21 bp, Artificial sequence
  SiRNA target sequence
atttggaccggaagctctcac

SEQ ID NO: 47119 - DNA, 21 bp, Artificial sequence
  SiRNA target sequence
tttggaccggaagctctcact

SEQ ID NO: 47120 - DNA, 21 bp, Artificial sequence
  SiRNA target sequence
ttggaccggaagctctcactt

SEQ ID NO: 47121 - DNA, 21 bp, Artificial sequence
  SiRNA target sequence
tggaccggaagctctcacttt

SEQ ID NO: 47122 - DNA, 21 bp, Artificial sequence
  SiRNA target sequence
ggaccggaagctctcactttt

SEQ ID NO: 47123 - DNA, 21 bp, Artificial sequence
  SiRNA target sequence
gaccggaagctctcacttttt

SEQ ID NO: 47124 - DNA, 21 bp, Artificial sequence
  SiRNA target sequence
accggaagctctcactttttg

SEQ ID NO: 47125 - DNA, 21 bp, Artificial sequence
  SiRNA target sequence
ccggaagctctcactttttgt

SEQ ID NO: 47126 - DNA, 21 bp, Artificial sequence
  SiRNA target sequence
cggaagctctcactttttgtg

SEQ ID NO: 47127 - DNA, 21 bp, Artificial sequence
  SiRNA target sequence
ggaagctctcactttttgtga

SEQ ID NO: 47128 - DNA, 21 bp, Artificial sequence
  SiRNA target sequence
gaagctctcactttttgtgat

SEQ ID NO: 47129 - DNA, 21 bp, Artificial sequence
  SiRNA target sequence
aagctctcactttttgtgatc

SEQ ID NO: 47130 - DNA, 21 bp, Artificial sequence
  SiRNA target sequence
agctctcactttttgtgatct

SEQ ID NO: 47131 - DNA, 21 bp, Artificial sequence
  SiRNA target sequence
gctctcactttttgtgatctt

SEQ ID NO: 47132 - DNA, 21 bp, Artificial sequence
  SiRNA target sequence
ctctcactttttgtgatcttc

SEQ ID NO: 47133 - DNA, 21 bp, Artificial sequence
  SiRNA target sequence
tctcactttttgtgatcttcc

SEQ ID NO: 47134 - DNA, 21 bp, Artificial sequence
  SiRNA target sequence
ctcactttttgtgatcttcca

SEQ ID NO: 47135 - DNA, 21 bp, Artificial sequence
  SiRNA target sequence
tcactttttgtgatcttccag

SEQ ID NO: 47136 - DNA, 21 bp, Artificial sequence
  SiRNA target sequence
cactttttgtgatcttccagc

SEQ ID NO: 47137 - DNA, 21 bp, Artificial sequence
  SiRNA target sequence
actttttgtgatcttccagcc

SEQ ID NO: 47138 - DNA, 21 bp, Artificial sequence
  SiRNA target sequence
ctttttgtgatcttccagccc

SEQ ID NO: 47139 - DNA, 21 bp, Artificial sequence
  SiRNA target sequence
tttttgtgatcttccagccct

SEQ ID NO: 47140 - DNA, 21 bp, Artificial sequence
  SiRNA target sequence
ttttgtgatcttccagccctt

SEQ ID NO: 47141 - DNA, 21 bp, Artificial sequence
  SiRNA target sequence
tttgtgatcttccagccctta

SEQ ID NO: 47142 - DNA, 21 bp, Artificial sequence
  SiRNA target sequence
ttgtgatcttccagcccttaa

SEQ ID NO: 47143 - DNA, 21 bp, Artificial sequence
  SiRNA target sequence
tgtgatcttccagcccttaag

SEQ ID NO: 47144 - DNA, 21 bp, Artificial sequence
  SiRNA target sequence
gtgatcttccagcccttaaga

SEQ ID NO: 47145 - DNA, 21 bp, Artificial sequence
  SiRNA target sequence
tgatcttccagcccttaagat

SEQ ID NO: 47146 - DNA, 21 bp, Artificial sequence
  SiRNA target sequence
gatcttccagcccttaagatg

SEQ ID NO: 47147 - DNA, 21 bp, Artificial sequence
  SiRNA target sequence
atcttccagcccttaagatga

SEQ ID NO: 47148 - DNA, 21 bp, Artificial sequence
  SiRNA target sequence
tcttccagcccttaagatgat

SEQ ID NO: 47149 - DNA, 21 bp, Artificial sequence
  SiRNA target sequence
cttccagcccttaagatgata

SEQ ID NO: 47150 - DNA, 21 bp, Artificial sequence
  SiRNA target sequence
ttccagcccttaagatgatac

SEQ ID NO: 47151 - DNA, 21 bp, Artificial sequence
  SiRNA target sequence
tccagcccttaagatgatacc

SEQ ID NO: 47152 - DNA, 21 bp, Artificial sequence
  SiRNA target sequence
ccagcccttaagatgatacca

SEQ ID NO: 47153 - DNA, 21 bp, Artificial sequence
  SiRNA target sequence
cagcccttaagatgataccag

SEQ ID NO: 47154 - DNA, 21 bp, Artificial sequence
  SiRNA target sequence
agcccttaagatgataccagt

SEQ ID NO: 47155 - DNA, 21 bp, Artificial sequence
  SiRNA target sequence
gcccttaagatgataccagta

SEQ ID NO: 47156 - DNA, 21 bp, Artificial sequence
  SiRNA target sequence
cccttaagatgataccagtag

SEQ ID NO: 47157 - DNA, 21 bp, Artificial sequence
  SiRNA target sequence
ccttaagatgataccagtagg

SEQ ID NO: 47158 - DNA, 21 bp, Artificial sequence
  SiRNA target sequence
cttaagatgataccagtagga

SEQ ID NO: 47159 - DNA, 21 bp, Artificial sequence
  SiRNA target sequence
ttaagatgataccagtaggac

SEQ ID NO: 47160 - DNA, 21 bp, Artificial sequence
  SiRNA target sequence
taagatgataccagtaggacg

SEQ ID NO: 47161 - DNA, 21 bp, Artificial sequence
  SiRNA target sequence
aagatgataccagtaggacga

SEQ ID NO: 47162 - DNA, 21 bp, Artificial sequence
  SiRNA target sequence
agatgataccagtaggacgac

SEQ ID NO: 47163 - DNA, 21 bp, Artificial sequence
  SiRNA target sequence
gatgataccagtaggacgact

SEQ ID NO: 47164 - DNA, 21 bp, Artificial sequence
  SiRNA target sequence
atgataccagtaggacgactt

SEQ ID NO: 47165 - DNA, 21 bp, Artificial sequence
  SiRNA target sequence
tgataccagtaggacgacttc

SEQ ID NO: 47166 - DNA, 21 bp, Artificial sequence
  SiRNA target sequence
gataccagtaggacgacttcc

SEQ ID NO: 47167 - DNA, 21 bp, Artificial sequence
  SiRNA target sequence
ataccagtaggacgacttccc

SEQ ID NO: 47168 - DNA, 21 bp, Artificial sequence
  SiRNA target sequence
taccagtaggacgacttcccg

SEQ ID NO: 47169 - DNA, 21 bp, Artificial sequence
  SiRNA target sequence
accagtaggacgacttcccga

SEQ ID NO: 47170 - DNA, 21 bp, Artificial sequence
  SiRNA target sequence
ccagtaggacgacttcccgaa

SEQ ID NO: 47171 - DNA, 21 bp, Artificial sequence
  SiRNA target sequence
cagtaggacgacttcccgaac

SEQ ID NO: 47172 - DNA, 21 bp, Artificial sequence
  SiRNA target sequence
agtaggacgacttcccgaacc

SEQ ID NO: 47173 - DNA, 21 bp, Artificial sequence
  SiRNA target sequence
gtaggacgacttcccgaaccc

SEQ ID NO: 47174 - DNA, 21 bp, Artificial sequence
  SiRNA target sequence
taggacgacttcccgaacccc

SEQ ID NO: 47175 - DNA, 21 bp, Artificial sequence
  SiRNA target sequence
aggacgacttcccgaacccct

SEQ ID NO: 47176 - DNA, 21 bp, Artificial sequence
  SiRNA target sequence
ggacgacttcccgaaccccta

SEQ ID NO: 47177 - DNA, 21 bp, Artificial sequence
  SiRNA target sequence
gacgacttcccgaacccctat

SEQ ID NO: 47178 - DNA, 21 bp, Artificial sequence
  SiRNA target sequence
acgacttcccgaacccctatt

SEQ ID NO: 47179 - DNA, 21 bp, Artificial sequence
  SiRNA target sequence
cgacttcccgaacccctattt

SEQ ID NO: 47180 - DNA, 21 bp, Artificial sequence
  SiRNA target sequence
gacttcccgaacccctatttg

SEQ ID NO: 47181 - DNA, 21 bp, Artificial sequence
  SiRNA target sequence
acttcccgaacccctatttga

SEQ ID NO: 47182 - DNA, 21 bp, Artificial sequence
  SiRNA target sequence
cttcccgaacccctatttgaa

SEQ ID NO: 47183 - DNA, 21 bp, Artificial sequence
  SiRNA target sequence
ttcccgaacccctatttgaac

SEQ ID NO: 47184 - DNA, 21 bp, Artificial sequence
  SiRNA target sequence
tcccgaacccctatttgaacc

SEQ ID NO: 47185 - DNA, 21 bp, Artificial sequence
  SiRNA target sequence
cccgaacccctatttgaacca

SEQ ID NO: 47186 - DNA, 21 bp, Artificial sequence
  SiRNA target sequence
ccgaacccctatttgaaccag

SEQ ID NO: 47187 - DNA, 21 bp, Artificial sequence
  SiRNA target sequence
cgaacccctatttgaaccagg

SEQ ID NO: 47188 - DNA, 21 bp, Artificial sequence
  SiRNA target sequence
gaacccctatttgaaccaggc

SEQ ID NO: 47189 - DNA, 21 bp, Artificial sequence
  SiRNA target sequence
aacccctatttgaaccaggca

SEQ ID NO: 47190 - DNA, 21 bp, Artificial sequence
  SiRNA target sequence
acccctatttgaaccaggcaa

SEQ ID NO: 47191 - DNA, 21 bp, Artificial sequence
  SiRNA target sequence
cccctatttgaaccaggcaaa

SEQ ID NO: 47192 - DNA, 21 bp, Artificial sequence
  SiRNA target sequence
ccctatttgaaccaggcaaaa

SEQ ID NO: 47193 - DNA, 21 bp, Artificial sequence
  SiRNA target sequence
cctatttgaaccaggcaaaac

SEQ ID NO: 47194 - DNA, 21 bp, Artificial sequence
  SiRNA target sequence
ctatttgaaccaggcaaaaca

SEQ ID NO: 47195 - DNA, 21 bp, Artificial sequence
  SiRNA target sequence
tatttgaaccaggcaaaacag

SEQ ID NO: 47196 - DNA, 21 bp, Artificial sequence
  SiRNA target sequence
atttgaaccaggcaaaacaga

SEQ ID NO: 47197 - DNA, 21 bp, Artificial sequence
  SiRNA target sequence
tttgaaccaggcaaaacagat

SEQ ID NO: 47198 - DNA, 21 bp, Artificial sequence
  SiRNA target sequence
ttgaaccaggcaaaacagata

SEQ ID NO: 47199 - DNA, 21 bp, Artificial sequence
  SiRNA target sequence
tgaaccaggcaaaacagatat

SEQ ID NO: 47200 - DNA, 21 bp, Artificial sequence
  SiRNA target sequence
gaaccaggcaaaacagatatt

SEQ ID NO: 47201 - DNA, 21 bp, Artificial sequence
  SiRNA target sequence
aaccaggcaaaacagatatta

SEQ ID NO: 47202 - DNA, 21 bp, Artificial sequence
  SiRNA target sequence
accaggcaaaacagatattag

SEQ ID NO: 47203 - DNA, 21 bp, Artificial sequence
  SiRNA target sequence
ccaggcaaaacagatattagg

SEQ ID NO: 47204 - DNA, 21 bp, Artificial sequence
  SiRNA target sequence
caggcaaaacagatattaggc

SEQ ID NO: 47205 - DNA, 21 bp, Artificial sequence
  SiRNA target sequence
aggcaaaacagatattaggcc

SEQ ID NO: 47206 - DNA, 21 bp, Artificial sequence
  SiRNA target sequence
ggcaaaacagatattaggcct

SEQ ID NO: 47207 - DNA, 21 bp, Artificial sequence
  SiRNA target sequence
gcaaaacagatattaggcctt

SEQ ID NO: 47208 - DNA, 21 bp, Artificial sequence
  SiRNA target sequence
caaaacagatattaggccttc

SEQ ID NO: 47209 - DNA, 21 bp, Artificial sequence
  SiRNA target sequence
aaaacagatattaggccttcc

SEQ ID NO: 47210 - DNA, 21 bp, Artificial sequence
  SiRNA target sequence
aaacagatattaggccttcct

SEQ ID NO: 47211 - DNA, 21 bp, Artificial sequence
  SiRNA target sequence
aacagatattaggccttcctt

SEQ ID NO: 47212 - DNA, 21 bp, Artificial sequence
  SiRNA target sequence
acagatattaggccttcctta

SEQ ID NO: 47213 - DNA, 21 bp, Artificial sequence
  SiRNA target sequence
cagatattaggccttccttag

SEQ ID NO: 47214 - DNA, 21 bp, Artificial sequence
  SiRNA target sequence
agatattaggccttccttagt

SEQ ID NO: 47215 - DNA, 21 bp, Artificial sequence
  SiRNA target sequence
gatattaggccttccttagta

SEQ ID NO: 47216 - DNA, 21 bp, Artificial sequence
  SiRNA target sequence
atattaggccttccttagtac

SEQ ID NO: 47217 - DNA, 21 bp, Artificial sequence
  SiRNA target sequence
tattaggccttccttagtaca

SEQ ID NO: 47218 - DNA, 21 bp, Artificial sequence
  SiRNA target sequence
attaggccttccttagtacat

SEQ ID NO: 47219 - DNA, 21 bp, Artificial sequence
  SiRNA target sequence
ttaggccttccttagtacatg

SEQ ID NO: 47220 - DNA, 21 bp, Artificial sequence
  SiRNA target sequence
taggccttccttagtacatgg

SEQ ID NO: 47221 - DNA, 21 bp, Artificial sequence
  SiRNA target sequence
aggccttccttagtacatgga

SEQ ID NO: 47222 - DNA, 21 bp, Artificial sequence
  SiRNA target sequence
ggccttccttagtacatggaa

SEQ ID NO: 47223 - DNA, 21 bp, Artificial sequence
  SiRNA target sequence
gccttccttagtacatggaat

SEQ ID NO: 47224 - DNA, 21 bp, Artificial sequence
  SiRNA target sequence
ccttccttagtacatggaatg

SEQ ID NO: 47225 - DNA, 21 bp, Artificial sequence
  SiRNA target sequence
cttccttagtacatggaatga

SEQ ID NO: 47226 - DNA, 21 bp, Artificial sequence
  SiRNA target sequence
ttccttagtacatggaatgat

SEQ ID NO: 47227 - DNA, 21 bp, Artificial sequence
  SiRNA target sequence
tccttagtacatggaatgatt

SEQ ID NO: 47228 - DNA, 21 bp, Artificial sequence
  SiRNA target sequence
ccttagtacatggaatgattt

SEQ ID NO: 47229 - DNA, 21 bp, Artificial sequence
  SiRNA target sequence
cttagtacatggaatgatttc

SEQ ID NO: 47230 - DNA, 21 bp, Artificial sequence
  SiRNA target sequence
ttagtacatggaatgatttct

SEQ ID NO: 47231 - DNA, 21 bp, Artificial sequence
  SiRNA target sequence
tagtacatggaatgatttctg

SEQ ID NO: 47232 - DNA, 21 bp, Artificial sequence
  SiRNA target sequence
agtacatggaatgatttctga

SEQ ID NO: 47233 - DNA, 21 bp, Artificial sequence
  SiRNA target sequence
gtacatggaatgatttctgat

SEQ ID NO: 47234 - DNA, 21 bp, Artificial sequence
  SiRNA target sequence
tacatggaatgatttctgata

SEQ ID NO: 47235 - DNA, 21 bp, Artificial sequence
  SiRNA target sequence
acatggaatgatttctgatat

SEQ ID NO: 47236 - DNA, 21 bp, Artificial sequence
  SiRNA target sequence
catggaatgatttctgatatt

SEQ ID NO: 47237 - DNA, 21 bp, Artificial sequence
  SiRNA target sequence
atggaatgatttctgatatta

SEQ ID NO: 47238 - DNA, 21 bp, Artificial sequence
  SiRNA target sequence
tggaatgatttctgatattaa

SEQ ID NO: 47239 - DNA, 21 bp, Artificial sequence
  SiRNA target sequence
ggaatgatttctgatattaag

SEQ ID NO: 47240 - DNA, 21 bp, Artificial sequence
  SiRNA target sequence
gaatgatttctgatattaaga

SEQ ID NO: 47241 - DNA, 21 bp, Artificial sequence
  SiRNA target sequence
aatgatttctgatattaagac

SEQ ID NO: 47242 - DNA, 21 bp, Artificial sequence
  SiRNA target sequence
atgatttctgatattaagact

SEQ ID NO: 47243 - DNA, 21 bp, Artificial sequence
  SiRNA target sequence
tgatttctgatattaagacta

SEQ ID NO: 47244 - DNA, 21 bp, Artificial sequence
  SiRNA target sequence
gatttctgatattaagactaa

SEQ ID NO: 47245 - DNA, 21 bp, Artificial sequence
  SiRNA target sequence
atttctgatattaagactaaa

SEQ ID NO: 47246 - DNA, 21 bp, Artificial sequence
  SiRNA target sequence
tttctgatattaagactaaac

SEQ ID NO: 47247 - DNA, 21 bp, Artificial sequence
  SiRNA target sequence
ttctgatattaagactaaacc

SEQ ID NO: 47248 - DNA, 21 bp, Artificial sequence
  SiRNA target sequence
tctgatattaagactaaacca

SEQ ID NO: 47249 - DNA, 21 bp, Artificial sequence
  SiRNA target sequence
ctgatattaagactaaaccag

SEQ ID NO: 47250 - DNA, 21 bp, Artificial sequence
  SiRNA target sequence
tgatattaagactaaaccagc

SEQ ID NO: 47251 - DNA, 21 bp, Artificial sequence
  SiRNA target sequence
gatattaagactaaaccagct

SEQ ID NO: 47252 - DNA, 21 bp, Artificial sequence
  SiRNA target sequence
atattaagactaaaccagctt

SEQ ID NO: 47253 - DNA, 21 bp, Artificial sequence
  SiRNA target sequence
tattaagactaaaccagctta

SEQ ID NO: 47254 - DNA, 21 bp, Artificial sequence
  SiRNA target sequence
attaagactaaaccagcttac

SEQ ID NO: 47255 - DNA, 21 bp, Artificial sequence
  SiRNA target sequence
ttaagactaaaccagcttact

SEQ ID NO: 47256 - DNA, 21 bp, Artificial sequence
  SiRNA target sequence
taagactaaaccagcttactt

SEQ ID NO: 47257 - DNA, 21 bp, Artificial sequence
  SiRNA target sequence
aagactaaaccagcttactta

SEQ ID NO: 47258 - DNA, 21 bp, Artificial sequence
  SiRNA target sequence
agactaaaccagcttacttac

SEQ ID NO: 47259 - DNA, 21 bp, Artificial sequence
  SiRNA target sequence
gactaaaccagcttacttacg

SEQ ID NO: 47260 - DNA, 21 bp, Artificial sequence
  SiRNA target sequence
actaaaccagcttacttacgt

SEQ ID NO: 47261 - DNA, 21 bp, Artificial sequence
  SiRNA target sequence
ctaaaccagcttacttacgta

SEQ ID NO: 47262 - DNA, 21 bp, Artificial sequence
  SiRNA target sequence
taaaccagcttacttacgtaa

SEQ ID NO: 47263 - DNA, 21 bp, Artificial sequence
  SiRNA target sequence
aaaccagcttacttacgtaat

SEQ ID NO: 47264 - DNA, 21 bp, Artificial sequence
  SiRNA target sequence
aaccagcttacttacgtaatg

SEQ ID NO: 47265 - DNA, 21 bp, Artificial sequence
  SiRNA target sequence
accagcttacttacgtaatgt

SEQ ID NO: 47266 - DNA, 21 bp, Artificial sequence
  SiRNA target sequence
ccagcttacttacgtaatgta

SEQ ID NO: 47267 - DNA, 21 bp, Artificial sequence
  SiRNA target sequence
cagcttacttacgtaatgtaa

SEQ ID NO: 47268 - DNA, 21 bp, Artificial sequence
  SiRNA target sequence
agcttacttacgtaatgtaag

SEQ ID NO: 47269 - DNA, 21 bp, Artificial sequence
  SiRNA target sequence
gcttacttacgtaatgtaaga

SEQ ID NO: 47270 - DNA, 21 bp, Artificial sequence
  SiRNA target sequence
cttacttacgtaatgtaagag

SEQ ID NO: 47271 - DNA, 21 bp, Artificial sequence
  SiRNA target sequence
ttacttacgtaatgtaagagt

SEQ ID NO: 47272 - DNA, 21 bp, Artificial sequence
  SiRNA target sequence
tacttacgtaatgtaagagta

SEQ ID NO: 47273 - DNA, 21 bp, Artificial sequence
  SiRNA target sequence
acttacgtaatgtaagagtag

SEQ ID NO: 47274 - DNA, 21 bp, Artificial sequence
  SiRNA target sequence
cttacgtaatgtaagagtaga

SEQ ID NO: 47275 - DNA, 21 bp, Artificial sequence
  SiRNA target sequence
ttacgtaatgtaagagtagat

SEQ ID NO: 47276 - DNA, 21 bp, Artificial sequence
  SiRNA target sequence
tacgtaatgtaagagtagatg

SEQ ID NO: 47277 - DNA, 21 bp, Artificial sequence
  SiRNA target sequence
acgtaatgtaagagtagatgg

SEQ ID NO: 47278 - DNA, 21 bp, Artificial sequence
  SiRNA target sequence
cgtaatgtaagagtagatggt

SEQ ID NO: 47279 - DNA, 21 bp, Artificial sequence
  SiRNA target sequence
gtaatgtaagagtagatggtg

SEQ ID NO: 47280 - DNA, 21 bp, Artificial sequence
  SiRNA target sequence
taatgtaagagtagatggtga

SEQ ID NO: 47281 - DNA, 21 bp, Artificial sequence
  SiRNA target sequence
aatgtaagagtagatggtgaa

SEQ ID NO: 47282 - DNA, 21 bp, Artificial sequence
  SiRNA target sequence
atgtaagagtagatggtgaag

SEQ ID NO: 47283 - DNA, 21 bp, Artificial sequence
  SiRNA target sequence
tgtaagagtagatggtgaagt

SEQ ID NO: 47284 - DNA, 21 bp, Artificial sequence
  SiRNA target sequence
gtaagagtagatggtgaagtt

SEQ ID NO: 47285 - DNA, 21 bp, Artificial sequence
  SiRNA target sequence
taagagtagatggtgaagtta

SEQ ID NO: 47286 - DNA, 21 bp, Artificial sequence
  SiRNA target sequence
aagagtagatggtgaagttat

SEQ ID NO: 47287 - DNA, 21 bp, Artificial sequence
  SiRNA target sequence
agagtagatggtgaagttata

SEQ ID NO: 47288 - DNA, 21 bp, Artificial sequence
  SiRNA target sequence
gagtagatggtgaagttataa

SEQ ID NO: 47289 - DNA, 21 bp, Artificial sequence
  SiRNA target sequence
agtagatggtgaagttataaa

SEQ ID NO: 47290 - DNA, 21 bp, Artificial sequence
  SiRNA target sequence
gtagatggtgaagttataaat

SEQ ID NO: 47291 - DNA, 21 bp, Artificial sequence
  SiRNA target sequence
tagatggtgaagttataaata

SEQ ID NO: 47292 - DNA, 21 bp, Artificial sequence
  SiRNA target sequence
agatggtgaagttataaatat

SEQ ID NO: 47293 - DNA, 21 bp, Artificial sequence
  SiRNA target sequence
gatggtgaagttataaatatg

SEQ ID NO: 47294 - DNA, 21 bp, Artificial sequence
  SiRNA target sequence
atggtgaagttataaatatga

SEQ ID NO: 47295 - DNA, 21 bp, Artificial sequence
  SiRNA target sequence
tggtgaagttataaatatgaa

SEQ ID NO: 47296 - DNA, 21 bp, Artificial sequence
  SiRNA target sequence
ggtgaagttataaatatgaaa

SEQ ID NO: 47297 - DNA, 21 bp, Artificial sequence
  SiRNA target sequence
gtgaagttataaatatgaaac

SEQ ID NO: 47298 - DNA, 21 bp, Artificial sequence
  SiRNA target sequence
tgaagttataaatatgaaaca

SEQ ID NO: 47299 - DNA, 21 bp, Artificial sequence
  SiRNA target sequence
gaagttataaatatgaaacac

SEQ ID NO: 47300 - DNA, 21 bp, Artificial sequence
  SiRNA target sequence
aagttataaatatgaaacaca

SEQ ID NO: 47301 - DNA, 21 bp, Artificial sequence
  SiRNA target sequence
agttataaatatgaaacacag

SEQ ID NO: 47302 - DNA, 21 bp, Artificial sequence
  SiRNA target sequence
gttataaatatgaaacacaga

SEQ ID NO: 47303 - DNA, 21 bp, Artificial sequence
  SiRNA target sequence
ttataaatatgaaacacagaa

SEQ ID NO: 47304 - DNA, 21 bp, Artificial sequence
  SiRNA target sequence
tataaatatgaaacacagaaa

SEQ ID NO: 47305 - DNA, 21 bp, Artificial sequence
  SiRNA target sequence
ataaatatgaaacacagaaat

SEQ ID NO: 47306 - DNA, 21 bp, Artificial sequence
  SiRNA target sequence
taaatatgaaacacagaaatt

SEQ ID NO: 47307 - DNA, 21 bp, Artificial sequence
  SiRNA target sequence
aaatatgaaacacagaaattt

SEQ ID NO: 47308 - DNA, 21 bp, Artificial sequence
  SiRNA target sequence
aatatgaaacacagaaattta

SEQ ID NO: 47309 - DNA, 21 bp, Artificial sequence
  SiRNA target sequence
atatgaaacacagaaatttaa

SEQ ID NO: 47310 - DNA, 21 bp, Artificial sequence
  SiRNA target sequence
tatgaaacacagaaatttaat

SEQ ID NO: 47311 - DNA, 21 bp, Artificial sequence
  SiRNA target sequence
atgaaacacagaaatttaatg

SEQ ID NO: 47312 - DNA, 21 bp, Artificial sequence
  SiRNA target sequence
tgaaacacagaaatttaatga

SEQ ID NO: 47313 - DNA, 21 bp, Artificial sequence
  SiRNA target sequence
gaaacacagaaatttaatgaa

SEQ ID NO: 47314 - DNA, 21 bp, Artificial sequence
  SiRNA target sequence
aaacacagaaatttaatgaaa

SEQ ID NO: 47315 - DNA, 21 bp, Artificial sequence
  SiRNA target sequence
aacacagaaatttaatgaaat

SEQ ID NO: 47316 - DNA, 21 bp, Artificial sequence
  SiRNA target sequence
acacagaaatttaatgaaatg

SEQ ID NO: 47317 - DNA, 21 bp, Artificial sequence
  SiRNA target sequence
cacagaaatttaatgaaatgt

SEQ ID NO: 47318 - DNA, 21 bp, Artificial sequence
  SiRNA target sequence
acagaaatttaatgaaatgtg

SEQ ID NO: 47319 - DNA, 21 bp, Artificial sequence
  SiRNA target sequence
cagaaatttaatgaaatgtgc

SEQ ID NO: 47320 - DNA, 21 bp, Artificial sequence
  SiRNA target sequence
agaaatttaatgaaatgtgct

SEQ ID NO: 47321 - DNA, 21 bp, Artificial sequence
  SiRNA target sequence
gaaatttaatgaaatgtgcta

SEQ ID NO: 47322 - DNA, 21 bp, Artificial sequence
  SiRNA target sequence
aaatttaatgaaatgtgctat

SEQ ID NO: 47323 - DNA, 21 bp, Artificial sequence
  SiRNA target sequence
aatttaatgaaatgtgctatg

SEQ ID NO: 47324 - DNA, 21 bp, Artificial sequence
  SiRNA target sequence
atttaatgaaatgtgctatgg

SEQ ID NO: 47325 - DNA, 21 bp, Artificial sequence
  SiRNA target sequence
tttaatgaaatgtgctatgga

SEQ ID NO: 47326 - DNA, 21 bp, Artificial sequence
  SiRNA target sequence
ttaatgaaatgtgctatggat

SEQ ID NO: 47327 - DNA, 21 bp, Artificial sequence
  SiRNA target sequence
taatgaaatgtgctatggata

SEQ ID NO: 47328 - DNA, 21 bp, Artificial sequence
  SiRNA target sequence
aatgaaatgtgctatggatac

SEQ ID NO: 47329 - DNA, 21 bp, Artificial sequence
  SiRNA target sequence
atgaaatgtgctatggataca

SEQ ID NO: 47330 - DNA, 21 bp, Artificial sequence
  SiRNA target sequence
tgaaatgtgctatggatacac

SEQ ID NO: 47331 - DNA, 21 bp, Artificial sequence
  SiRNA target sequence
gaaatgtgctatggatacacc

SEQ ID NO: 47332 - DNA, 21 bp, Artificial sequence
  SiRNA target sequence
aaatgtgctatggatacacct

SEQ ID NO: 47333 - DNA, 21 bp, Artificial sequence
  SiRNA target sequence
aatgtgctatggatacacctt

SEQ ID NO: 47334 - DNA, 21 bp, Artificial sequence
  SiRNA target sequence
atgtgctatggatacacctta

SEQ ID NO: 47335 - DNA, 21 bp, Artificial sequence
  SiRNA target sequence
tgtgctatggatacaccttat

SEQ ID NO: 47336 - DNA, 21 bp, Artificial sequence
  SiRNA target sequence
gtgctatggatacaccttata

SEQ ID NO: 47337 - DNA, 21 bp, Artificial sequence
  SiRNA target sequence
tgctatggatacaccttatat

SEQ ID NO: 47338 - DNA, 21 bp, Artificial sequence
  SiRNA target sequence
gctatggatacaccttatatc

SEQ ID NO: 47339 - DNA, 21 bp, Artificial sequence
  SiRNA target sequence
ctatggatacaccttatatcg

SEQ ID NO: 47340 - DNA, 21 bp, Artificial sequence
  SiRNA target sequence
tatggatacaccttatatcga

SEQ ID NO: 47341 - DNA, 21 bp, Artificial sequence
  SiRNA target sequence
atggatacaccttatatcgac

SEQ ID NO: 47342 - DNA, 21 bp, Artificial sequence
  SiRNA target sequence
tggatacaccttatatcgaca

SEQ ID NO: 47343 - DNA, 21 bp, Artificial sequence
  SiRNA target sequence
ggatacaccttatatcgacaa

SEQ ID NO: 47344 - DNA, 21 bp, Artificial sequence
  SiRNA target sequence
gatacaccttatatcgacaag

SEQ ID NO: 47345 - DNA, 21 bp, Artificial sequence
  SiRNA target sequence
atacaccttatatcgacaagg

SEQ ID NO: 47346 - DNA, 21 bp, Artificial sequence
  SiRNA target sequence
tacaccttatatcgacaagga

SEQ ID NO: 47347 - DNA, 21 bp, Artificial sequence
  SiRNA target sequence
acaccttatatcgacaaggac

SEQ ID NO: 47348 - DNA, 21 bp, Artificial sequence
  SiRNA target sequence
caccttatatcgacaaggaca

SEQ ID NO: 47349 - DNA, 21 bp, Artificial sequence
  SiRNA target sequence
accttatatcgacaaggacat

SEQ ID NO: 47350 - DNA, 21 bp, Artificial sequence
  SiRNA target sequence
ccttatatcgacaaggacatg

SEQ ID NO: 47351 - DNA, 21 bp, Artificial sequence
  SiRNA target sequence
cttatatcgacaaggacatga

SEQ ID NO: 47352 - DNA, 21 bp, Artificial sequence
  SiRNA target sequence
ttatatcgacaaggacatgat

SEQ ID NO: 47353 - DNA, 21 bp, Artificial sequence
  SiRNA target sequence
tatatcgacaaggacatgatc

SEQ ID NO: 47354 - DNA, 21 bp, Artificial sequence
  SiRNA target sequence
atatcgacaaggacatgatcg

SEQ ID NO: 47355 - DNA, 21 bp, Artificial sequence
  SiRNA target sequence
tatcgacaaggacatgatcga

SEQ ID NO: 47356 - DNA, 21 bp, Artificial sequence
  SiRNA target sequence
atcgacaaggacatgatcgag

SEQ ID NO: 47357 - DNA, 21 bp, Artificial sequence
  SiRNA target sequence
tcgacaaggacatgatcgagg

SEQ ID NO: 47358 - DNA, 21 bp, Artificial sequence
  SiRNA target sequence
cgacaaggacatgatcgagga

SEQ ID NO: 47359 - DNA, 21 bp, Artificial sequence
  SiRNA target sequence
gacaaggacatgatcgaggaa

SEQ ID NO: 47360 - DNA, 21 bp, Artificial sequence
  SiRNA target sequence
acaaggacatgatcgaggaag

SEQ ID NO: 47361 - DNA, 21 bp, Artificial sequence
  SiRNA target sequence
caaggacatgatcgaggaagc

SEQ ID NO: 47362 - DNA, 21 bp, Artificial sequence
  SiRNA target sequence
aaggacatgatcgaggaagca

SEQ ID NO: 47363 - DNA, 21 bp, Artificial sequence
  SiRNA target sequence
aggacatgatcgaggaagcat

SEQ ID NO: 47364 - DNA, 21 bp, Artificial sequence
  SiRNA target sequence
ggacatgatcgaggaagcata

SEQ ID NO: 47365 - DNA, 21 bp, Artificial sequence
  SiRNA target sequence
gacatgatcgaggaagcatat

SEQ ID NO: 47366 - DNA, 21 bp, Artificial sequence
  SiRNA target sequence
acatgatcgaggaagcatatc

SEQ ID NO: 47367 - DNA, 21 bp, Artificial sequence
  SiRNA target sequence
catgatcgaggaagcatatca

SEQ ID NO: 47368 - DNA, 21 bp, Artificial sequence
  SiRNA target sequence
atgatcgaggaagcatatcag

SEQ ID NO: 47369 - DNA, 21 bp, Artificial sequence
  SiRNA target sequence
tgatcgaggaagcatatcagt

SEQ ID NO: 47370 - DNA, 21 bp, Artificial sequence
  SiRNA target sequence
gatcgaggaagcatatcagtt

SEQ ID NO: 47371 - DNA, 21 bp, Artificial sequence
  SiRNA target sequence
atcgaggaagcatatcagtta

SEQ ID NO: 47372 - DNA, 21 bp, Artificial sequence
  SiRNA target sequence
tcgaggaagcatatcagttaa

SEQ ID NO: 47373 - DNA, 21 bp, Artificial sequence
  SiRNA target sequence
cgaggaagcatatcagttaac

SEQ ID NO: 47374 - DNA, 21 bp, Artificial sequence
  SiRNA target sequence
gaggaagcatatcagttaact

SEQ ID NO: 47375 - DNA, 21 bp, Artificial sequence
  SiRNA target sequence
aggaagcatatcagttaacta

SEQ ID NO: 47376 - DNA, 21 bp, Artificial sequence
  SiRNA target sequence
ggaagcatatcagttaactaa

SEQ ID NO: 47377 - DNA, 21 bp, Artificial sequence
  SiRNA target sequence
gaagcatatcagttaactaaa

SEQ ID NO: 47378 - DNA, 21 bp, Artificial sequence
  SiRNA target sequence
aagcatatcagttaactaaat

SEQ ID NO: 47379 - DNA, 21 bp, Artificial sequence
  SiRNA target sequence
agcatatcagttaactaaatc

SEQ ID NO: 47380 - DNA, 21 bp, Artificial sequence
  SiRNA target sequence
gcatatcagttaactaaatcc

SEQ ID NO: 47381 - DNA, 21 bp, Artificial sequence
  SiRNA target sequence
catatcagttaactaaatccg

SEQ ID NO: 47382 - DNA, 21 bp, Artificial sequence
  SiRNA target sequence
atatcagttaactaaatccgt

SEQ ID NO: 47383 - DNA, 21 bp, Artificial sequence
  SiRNA target sequence
tatcagttaactaaatccgtt

SEQ ID NO: 47384 - DNA, 21 bp, Artificial sequence
  SiRNA target sequence
atcagttaactaaatccgttt

SEQ ID NO: 47385 - DNA, 21 bp, Artificial sequence
  SiRNA target sequence
tcagttaactaaatccgtttg

SEQ ID NO: 47386 - DNA, 21 bp, Artificial sequence
  SiRNA target sequence
cagttaactaaatccgtttgg

SEQ ID NO: 47387 - DNA, 21 bp, Artificial sequence
  SiRNA target sequence
agttaactaaatccgtttggt

SEQ ID NO: 47388 - DNA, 21 bp, Artificial sequence
  SiRNA target sequence
gttaactaaatccgtttggtt

SEQ ID NO: 47389 - DNA, 21 bp, Artificial sequence
  SiRNA target sequence
ttaactaaatccgtttggtta

SEQ ID NO: 47390 - DNA, 21 bp, Artificial sequence
  SiRNA target sequence
taactaaatccgtttggttaa

SEQ ID NO: 47391 - DNA, 21 bp, Artificial sequence
  SiRNA target sequence
aactaaatccgtttggttaaa

SEQ ID NO: 47392 - DNA, 21 bp, Artificial sequence
  SiRNA target sequence
actaaatccgtttggttaaaa

SEQ ID NO: 47393 - DNA, 21 bp, Artificial sequence
  SiRNA target sequence
ctaaatccgtttggttaaaag

SEQ ID NO: 47394 - DNA, 21 bp, Artificial sequence
  SiRNA target sequence
taaatccgtttggttaaaagg

SEQ ID NO: 47395 - DNA, 21 bp, Artificial sequence
  SiRNA target sequence
aaatccgtttggttaaaaggt

SEQ ID NO: 47396 - DNA, 21 bp, Artificial sequence
  SiRNA target sequence
aatccgtttggttaaaaggta

SEQ ID NO: 47397 - DNA, 21 bp, Artificial sequence
  SiRNA target sequence
atccgtttggttaaaaggtat

SEQ ID NO: 47398 - DNA, 21 bp, Artificial sequence
  SiRNA target sequence
tccgtttggttaaaaggtatg

SEQ ID NO: 47399 - DNA, 21 bp, Artificial sequence
  SiRNA target sequence
ccgtttggttaaaaggtatgc

SEQ ID NO: 47400 - DNA, 21 bp, Artificial sequence
  SiRNA target sequence
cgtttggttaaaaggtatgcg

SEQ ID NO: 47401 - DNA, 21 bp, Artificial sequence
  SiRNA target sequence
gtttggttaaaaggtatgcga

SEQ ID NO: 47402 - DNA, 21 bp, Artificial sequence
  SiRNA target sequence
tttggttaaaaggtatgcgag

SEQ ID NO: 47403 - DNA, 21 bp, Artificial sequence
  SiRNA target sequence
ttggttaaaaggtatgcgaga

SEQ ID NO: 47404 - DNA, 21 bp, Artificial sequence
  SiRNA target sequence
tggttaaaaggtatgcgagat

SEQ ID NO: 47405 - DNA, 21 bp, Artificial sequence
  SiRNA target sequence
ggttaaaaggtatgcgagatg

SEQ ID NO: 47406 - DNA, 21 bp, Artificial sequence
  SiRNA target sequence
gttaaaaggtatgcgagatga

SEQ ID NO: 47407 - DNA, 21 bp, Artificial sequence
  SiRNA target sequence
ttaaaaggtatgcgagatgaa

SEQ ID NO: 47408 - DNA, 21 bp, Artificial sequence
  SiRNA target sequence
taaaaggtatgcgagatgaat

SEQ ID NO: 47409 - DNA, 21 bp, Artificial sequence
  SiRNA target sequence
aaaaggtatgcgagatgaatt

SEQ ID NO: 47410 - DNA, 21 bp, Artificial sequence
  SiRNA target sequence
aaaggtatgcgagatgaattg

SEQ ID NO: 47411 - DNA, 21 bp, Artificial sequence
  SiRNA target sequence
aaggtatgcgagatgaattga

SEQ ID NO: 47412 - DNA, 21 bp, Artificial sequence
  SiRNA target sequence
aggtatgcgagatgaattgaa

SEQ ID NO: 47413 - DNA, 21 bp, Artificial sequence
  SiRNA target sequence
ggtatgcgagatgaattgaaa

SEQ ID NO: 47414 - DNA, 21 bp, Artificial sequence
  SiRNA target sequence
gtatgcgagatgaattgaaaa

SEQ ID NO: 47415 - DNA, 21 bp, Artificial sequence
  SiRNA target sequence
tatgcgagatgaattgaaaaa

SEQ ID NO: 47416 - DNA, 21 bp, Artificial sequence
  SiRNA target sequence
atgcgagatgaattgaaaaag

SEQ ID NO: 47417 - DNA, 21 bp, Artificial sequence
  SiRNA target sequence
tgcgagatgaattgaaaaagg

SEQ ID NO: 47418 - DNA, 21 bp, Artificial sequence
  SiRNA target sequence
gcgagatgaattgaaaaaggt

SEQ ID NO: 47419 - DNA, 21 bp, Artificial sequence
  SiRNA target sequence
cgagatgaattgaaaaaggtt

SEQ ID NO: 47420 - DNA, 21 bp, Artificial sequence
  SiRNA target sequence
gagatgaattgaaaaaggttc

SEQ ID NO: 47421 - DNA, 21 bp, Artificial sequence
  SiRNA target sequence
agatgaattgaaaaaggttct

SEQ ID NO: 47422 - DNA, 21 bp, Artificial sequence
  SiRNA target sequence
gatgaattgaaaaaggttctc

SEQ ID NO: 47423 - DNA, 21 bp, Artificial sequence
  SiRNA target sequence
atgaattgaaaaaggttctca

SEQ ID NO: 47424 - DNA, 21 bp, Artificial sequence
  SiRNA target sequence
tgaattgaaaaaggttctcac

SEQ ID NO: 47425 - DNA, 21 bp, Artificial sequence
  SiRNA target sequence
gaattgaaaaaggttctcact

SEQ ID NO: 47426 - DNA, 21 bp, Artificial sequence
  SiRNA target sequence
aattgaaaaaggttctcactt

SEQ ID NO: 47427 - DNA, 21 bp, Artificial sequence
  SiRNA target sequence
attgaaaaaggttctcactta

SEQ ID NO: 47428 - DNA, 21 bp, Artificial sequence
  SiRNA target sequence
ttgaaaaaggttctcacttat

SEQ ID NO: 47429 - DNA, 21 bp, Artificial sequence
  SiRNA target sequence
tgaaaaaggttctcacttatg

SEQ ID NO: 47430 - DNA, 21 bp, Artificial sequence
  SiRNA target sequence
gaaaaaggttctcacttatga

SEQ ID NO: 47431 - DNA, 21 bp, Artificial sequence
  SiRNA target sequence
aaaaaggttctcacttatgaa

SEQ ID NO: 47432 - DNA, 21 bp, Artificial sequence
  SiRNA target sequence
aaaaggttctcacttatgaag

SEQ ID NO: 47433 - DNA, 21 bp, Artificial sequence
  SiRNA target sequence
aaaggttctcacttatgaaga

SEQ ID NO: 47434 - DNA, 21 bp, Artificial sequence
  SiRNA target sequence
aaggttctcacttatgaagaa

SEQ ID NO: 47435 - DNA, 21 bp, Artificial sequence
  SiRNA target sequence
aggttctcacttatgaagaag

SEQ ID NO: 47436 - DNA, 21 bp, Artificial sequence
  SiRNA target sequence
ggttctcacttatgaagaagc

SEQ ID NO: 47437 - DNA, 21 bp, Artificial sequence
  SiRNA target sequence
gttctcacttatgaagaagcc

SEQ ID NO: 47438 - DNA, 21 bp, Artificial sequence
  SiRNA target sequence
ttctcacttatgaagaagcca

SEQ ID NO: 47439 - DNA, 21 bp, Artificial sequence
  SiRNA target sequence
tctcacttatgaagaagccat

SEQ ID NO: 47440 - DNA, 21 bp, Artificial sequence
  SiRNA target sequence
ctcacttatgaagaagccatt

SEQ ID NO: 47441 - DNA, 21 bp, Artificial sequence
  SiRNA target sequence
tcacttatgaagaagccattt

SEQ ID NO: 47442 - DNA, 21 bp, Artificial sequence
  SiRNA target sequence
cacttatgaagaagccatttg

SEQ ID NO: 47443 - DNA, 21 bp, Artificial sequence
  SiRNA target sequence
acttatgaagaagccatttgt

SEQ ID NO: 47444 - DNA, 21 bp, Artificial sequence
  SiRNA target sequence
cttatgaagaagccatttgtg

SEQ ID NO: 47445 - DNA, 21 bp, Artificial sequence
  SiRNA target sequence
ttatgaagaagccatttgtgg

SEQ ID NO: 47446 - DNA, 21 bp, Artificial sequence
  SiRNA target sequence
tatgaagaagccatttgtggc

SEQ ID NO: 47447 - DNA, 21 bp, Artificial sequence
  SiRNA target sequence
atgaagaagccatttgtggct

SEQ ID NO: 47448 - DNA, 21 bp, Artificial sequence
  SiRNA target sequence
tgaagaagccatttgtggctc

SEQ ID NO: 47449 - DNA, 21 bp, Artificial sequence
  SiRNA target sequence
gaagaagccatttgtggctct

SEQ ID NO: 47450 - DNA, 21 bp, Artificial sequence
  SiRNA target sequence
aagaagccatttgtggctctg

SEQ ID NO: 47451 - DNA, 21 bp, Artificial sequence
  SiRNA target sequence
agaagccatttgtggctctga

SEQ ID NO: 47452 - DNA, 21 bp, Artificial sequence
  SiRNA target sequence
gaagccatttgtggctctgaa

SEQ ID NO: 47453 - DNA, 21 bp, Artificial sequence
  SiRNA target sequence
aagccatttgtggctctgaag

SEQ ID NO: 47454 - DNA, 21 bp, Artificial sequence
  SiRNA target sequence
agccatttgtggctctgaagt

SEQ ID NO: 47455 - DNA, 21 bp, Artificial sequence
  SiRNA target sequence
gccatttgtggctctgaagta

SEQ ID NO: 47456 - DNA, 21 bp, Artificial sequence
  SiRNA target sequence
ccatttgtggctctgaagtaa

SEQ ID NO: 47457 - DNA, 21 bp, Artificial sequence
  SiRNA target sequence
catttgtggctctgaagtaag

SEQ ID NO: 47458 - DNA, 21 bp, Artificial sequence
  SiRNA target sequence
atttgtggctctgaagtaagt

SEQ ID NO: 47459 - DNA, 21 bp, Artificial sequence
  SiRNA target sequence
tttgtggctctgaagtaagtg

SEQ ID NO: 47460 - DNA, 21 bp, Artificial sequence
  SiRNA target sequence
ttgtggctctgaagtaagtga

SEQ ID NO: 47461 - DNA, 21 bp, Artificial sequence
  SiRNA target sequence
tgtggctctgaagtaagtgaa

SEQ ID NO: 47462 - DNA, 21 bp, Artificial sequence
  SiRNA target sequence
gtggctctgaagtaagtgaat

SEQ ID NO: 47463 - DNA, 21 bp, Artificial sequence
  SiRNA target sequence
tggctctgaagtaagtgaata

SEQ ID NO: 47464 - DNA, 21 bp, Artificial sequence
  SiRNA target sequence
ggctctgaagtaagtgaatac

SEQ ID NO: 47465 - DNA, 21 bp, Artificial sequence
  SiRNA target sequence
gctctgaagtaagtgaataca

SEQ ID NO: 47466 - DNA, 21 bp, Artificial sequence
  SiRNA target sequence
ctctgaagtaagtgaatacat

SEQ ID NO: 47467 - DNA, 21 bp, Artificial sequence
  SiRNA target sequence
tctgaagtaagtgaatacatt

SEQ ID NO: 47468 - DNA, 21 bp, Artificial sequence
  SiRNA target sequence
ctgaagtaagtgaatacattt

SEQ ID NO: 47469 - DNA, 21 bp, Artificial sequence
  SiRNA target sequence
tgaagtaagtgaatacatttc

SEQ ID NO: 47470 - DNA, 21 bp, Artificial sequence
  SiRNA target sequence
gaagtaagtgaatacatttct

SEQ ID NO: 47471 - DNA, 21 bp, Artificial sequence
  SiRNA target sequence
aagtaagtgaatacatttctt

SEQ ID NO: 47472 - DNA, 21 bp, Artificial sequence
  SiRNA target sequence
agtaagtgaatacatttcttc

SEQ ID NO: 47473 - DNA, 21 bp, Artificial sequence
  SiRNA target sequence
gtaagtgaatacatttcttca

SEQ ID NO: 47474 - DNA, 21 bp, Artificial sequence
  SiRNA target sequence
taagtgaatacatttcttcaa

SEQ ID NO: 47475 - DNA, 21 bp, Artificial sequence
  SiRNA target sequence
aagtgaatacatttcttcaat

SEQ ID NO: 47476 - DNA, 21 bp, Artificial sequence
  SiRNA target sequence
agtgaatacatttcttcaatt

SEQ ID NO: 47477 - DNA, 21 bp, Artificial sequence
  SiRNA target sequence
gtgaatacatttcttcaatta

SEQ ID NO: 47478 - DNA, 21 bp, Artificial sequence
  SiRNA target sequence
tgaatacatttcttcaattaa

SEQ ID NO: 47479 - DNA, 21 bp, Artificial sequence
  SiRNA target sequence
gaatacatttcttcaattaat

SEQ ID NO: 47480 - DNA, 21 bp, Artificial sequence
  SiRNA target sequence
aatacatttcttcaattaata

SEQ ID NO: 47481 - DNA, 21 bp, Artificial sequence
  SiRNA target sequence
atacatttcttcaattaatag

SEQ ID NO: 47482 - DNA, 21 bp, Artificial sequence
  SiRNA target sequence
tacatttcttcaattaatagg

SEQ ID NO: 47483 - DNA, 21 bp, Artificial sequence
  SiRNA target sequence
acatttcttcaattaatagga

SEQ ID NO: 47484 - DNA, 21 bp, Artificial sequence
  SiRNA target sequence
catttcttcaattaataggag

SEQ ID NO: 47485 - DNA, 21 bp, Artificial sequence
  SiRNA target sequence
atttcttcaattaataggagt

SEQ ID NO: 47486 - DNA, 21 bp, Artificial sequence
  SiRNA target sequence
tttcttcaattaataggagta

SEQ ID NO: 47487 - DNA, 21 bp, Artificial sequence
  SiRNA target sequence
ttcttcaattaataggagtag

SEQ ID NO: 47488 - DNA, 21 bp, Artificial sequence
  SiRNA target sequence
tcttcaattaataggagtagc

SEQ ID NO: 47489 - DNA, 21 bp, Artificial sequence
  SiRNA target sequence
cttcaattaataggagtagct

SEQ ID NO: 47490 - DNA, 21 bp, Artificial sequence
  SiRNA target sequence
ttcaattaataggagtagctc

SEQ ID NO: 47491 - DNA, 21 bp, Artificial sequence
  SiRNA target sequence
tcaattaataggagtagctcc

SEQ ID NO: 47492 - DNA, 21 bp, Artificial sequence
  SiRNA target sequence
caattaataggagtagctccc

SEQ ID NO: 47493 - DNA, 21 bp, Artificial sequence
  SiRNA target sequence
aattaataggagtagctcccc

SEQ ID NO: 47494 - DNA, 21 bp, Artificial sequence
  SiRNA target sequence
attaataggagtagctcccca

SEQ ID NO: 47495 - DNA, 21 bp, Artificial sequence
  SiRNA target sequence
ttaataggagtagctccccag

SEQ ID NO: 47496 - DNA, 21 bp, Artificial sequence
  SiRNA target sequence
taataggagtagctccccagg

SEQ ID NO: 47497 - DNA, 21 bp, Artificial sequence
  SiRNA target sequence
aataggagtagctccccagga

SEQ ID NO: 47498 - DNA, 21 bp, Artificial sequence
  SiRNA target sequence
ataggagtagctccccaggat

SEQ ID NO: 47499 - DNA, 21 bp, Artificial sequence
  SiRNA target sequence
taggagtagctccccaggata

SEQ ID NO: 47500 - DNA, 21 bp, Artificial sequence
  SiRNA target sequence
aggagtagctccccaggatat

SEQ ID NO: 47501 - DNA, 21 bp, Artificial sequence
  SiRNA target sequence
ggagtagctccccaggatatc

SEQ ID NO: 47502 - DNA, 21 bp, Artificial sequence
  SiRNA target sequence
gagtagctccccaggatatcc

SEQ ID NO: 47503 - DNA, 21 bp, Artificial sequence
  SiRNA target sequence
agtagctccccaggatatcct

SEQ ID NO: 47504 - DNA, 21 bp, Artificial sequence
  SiRNA target sequence
gtagctccccaggatatcctt

SEQ ID NO: 47505 - DNA, 21 bp, Artificial sequence
  SiRNA target sequence
tagctccccaggatatccttg

SEQ ID NO: 47506 - DNA, 21 bp, Artificial sequence
  SiRNA target sequence
agctccccaggatatccttgg

SEQ ID NO: 47507 - DNA, 21 bp, Artificial sequence
  SiRNA target sequence
gctccccaggatatccttgga

SEQ ID NO: 47508 - DNA, 21 bp, Artificial sequence
  SiRNA target sequence
ctccccaggatatccttggat

SEQ ID NO: 47509 - DNA, 21 bp, Artificial sequence
  SiRNA target sequence
tccccaggatatccttggata

SEQ ID NO: 47510 - DNA, 21 bp, Artificial sequence
  SiRNA target sequence
ccccaggatatccttggataa

SEQ ID NO: 47511 - DNA, 21 bp, Artificial sequence
  SiRNA target sequence
cccaggatatccttggataaa

SEQ ID NO: 47512 - DNA, 21 bp, Artificial sequence
  SiRNA target sequence
ccaggatatccttggataaag

SEQ ID NO: 47513 - DNA, 21 bp, Artificial sequence
  SiRNA target sequence
caggatatccttggataaagg

SEQ ID NO: 47514 - DNA, 21 bp, Artificial sequence
  SiRNA target sequence
aggatatccttggataaagga

SEQ ID NO: 47515 - DNA, 21 bp, Artificial sequence
  SiRNA target sequence
ggatatccttggataaaggat

SEQ ID NO: 47516 - DNA, 21 bp, Artificial sequence
  SiRNA target sequence
gatatccttggataaaggata

SEQ ID NO: 47517 - DNA, 21 bp, Artificial sequence
  SiRNA target sequence
atatccttggataaaggatag

SEQ ID NO: 47518 - DNA, 21 bp, Artificial sequence
  SiRNA target sequence
tatccttggataaaggataga

SEQ ID NO: 47519 - DNA, 21 bp, Artificial sequence
  SiRNA target sequence
atccttggataaaggatagag

SEQ ID NO: 47520 - DNA, 21 bp, Artificial sequence
  SiRNA target sequence
tccttggataaaggatagagt

SEQ ID NO: 47521 - DNA, 21 bp, Artificial sequence
  SiRNA target sequence
ccttggataaaggatagagtg

SEQ ID NO: 47522 - DNA, 21 bp, Artificial sequence
  SiRNA target sequence
cttggataaaggatagagtga

SEQ ID NO: 47523 - DNA, 21 bp, Artificial sequence
  SiRNA target sequence
ttggataaaggatagagtgaa

SEQ ID NO: 47524 - DNA, 21 bp, Artificial sequence
  SiRNA target sequence
tggataaaggatagagtgaaa

SEQ ID NO: 47525 - DNA, 21 bp, Artificial sequence
  SiRNA target sequence
ggataaaggatagagtgaaag

SEQ ID NO: 47526 - DNA, 21 bp, Artificial sequence
  SiRNA target sequence
gataaaggatagagtgaaagg

SEQ ID NO: 47527 - DNA, 21 bp, Artificial sequence
  SiRNA target sequence
ataaaggatagagtgaaagga

SEQ ID NO: 47528 - DNA, 21 bp, Artificial sequence
  SiRNA target sequence
taaaggatagagtgaaaggaa

SEQ ID NO: 47529 - DNA, 21 bp, Artificial sequence
  SiRNA target sequence
aaaggatagagtgaaaggaac

SEQ ID NO: 47530 - DNA, 21 bp, Artificial sequence
  SiRNA target sequence
aaggatagagtgaaaggaact

SEQ ID NO: 47531 - DNA, 21 bp, Artificial sequence
  SiRNA target sequence
aggatagagtgaaaggaacta

SEQ ID NO: 47532 - DNA, 21 bp, Artificial sequence
  SiRNA target sequence
ggatagagtgaaaggaactaa

SEQ ID NO: 47533 - DNA, 21 bp, Artificial sequence
  SiRNA target sequence
gatagagtgaaaggaactaaa

SEQ ID NO: 47534 - DNA, 21 bp, Artificial sequence
  SiRNA target sequence
atagagtgaaaggaactaaag

SEQ ID NO: 47535 - DNA, 21 bp, Artificial sequence
  SiRNA target sequence
tagagtgaaaggaactaaagg

SEQ ID NO: 47536 - DNA, 21 bp, Artificial sequence
  SiRNA target sequence
agagtgaaaggaactaaagga

SEQ ID NO: 47537 - DNA, 21 bp, Artificial sequence
  SiRNA target sequence
gagtgaaaggaactaaaggaa

SEQ ID NO: 47538 - DNA, 21 bp, Artificial sequence
  SiRNA target sequence
agtgaaaggaactaaaggaaa

SEQ ID NO: 47539 - DNA, 21 bp, Artificial sequence
  SiRNA target sequence
gtgaaaggaactaaaggaaaa

SEQ ID NO: 47540 - DNA, 21 bp, Artificial sequence
  SiRNA target sequence
tgaaaggaactaaaggaaaac

SEQ ID NO: 47541 - DNA, 21 bp, Artificial sequence
  SiRNA target sequence
gaaaggaactaaaggaaaaca

SEQ ID NO: 47542 - DNA, 21 bp, Artificial sequence
  SiRNA target sequence
aaaggaactaaaggaaaacaa

SEQ ID NO: 47543 - DNA, 21 bp, Artificial sequence
  SiRNA target sequence
aaggaactaaaggaaaacaag

SEQ ID NO: 47544 - DNA, 21 bp, Artificial sequence
  SiRNA target sequence
aggaactaaaggaaaacaagg

SEQ ID NO: 47545 - DNA, 21 bp, Artificial sequence
  SiRNA target sequence
ggaactaaaggaaaacaaggc

SEQ ID NO: 47546 - DNA, 21 bp, Artificial sequence
  SiRNA target sequence
gaactaaaggaaaacaaggct

SEQ ID NO: 47547 - DNA, 21 bp, Artificial sequence
  SiRNA target sequence
aactaaaggaaaacaaggctg

SEQ ID NO: 47548 - DNA, 21 bp, Artificial sequence
  SiRNA target sequence
actaaaggaaaacaaggctgg

SEQ ID NO: 47549 - DNA, 21 bp, Artificial sequence
  SiRNA target sequence
ctaaaggaaaacaaggctggt

SEQ ID NO: 47550 - DNA, 21 bp, Artificial sequence
  SiRNA target sequence
taaaggaaaacaaggctggtt

SEQ ID NO: 47551 - DNA, 21 bp, Artificial sequence
  SiRNA target sequence
aaaggaaaacaaggctggttt

SEQ ID NO: 47552 - DNA, 21 bp, Artificial sequence
  SiRNA target sequence
aaggaaaacaaggctggtttg

SEQ ID NO: 47553 - DNA, 21 bp, Artificial sequence
  SiRNA target sequence
aggaaaacaaggctggtttgg

SEQ ID NO: 47554 - DNA, 21 bp, Artificial sequence
  SiRNA target sequence
ggaaaacaaggctggtttggt

SEQ ID NO: 47555 - DNA, 21 bp, Artificial sequence
  SiRNA target sequence
gaaaacaaggctggtttggta

SEQ ID NO: 47556 - DNA, 21 bp, Artificial sequence
  SiRNA target sequence
aaaacaaggctggtttggtac

SEQ ID NO: 47557 - DNA, 21 bp, Artificial sequence
  SiRNA target sequence
aaacaaggctggtttggtact

SEQ ID NO: 47558 - DNA, 21 bp, Artificial sequence
  SiRNA target sequence
aacaaggctggtttggtactg

SEQ ID NO: 47559 - DNA, 21 bp, Artificial sequence
  SiRNA target sequence
acaaggctggtttggtactga

SEQ ID NO: 47560 - DNA, 21 bp, Artificial sequence
  SiRNA target sequence
caaggctggtttggtactgat

SEQ ID NO: 47561 - DNA, 21 bp, Artificial sequence
  SiRNA target sequence
aaggctggtttggtactgatg

SEQ ID NO: 47562 - DNA, 21 bp, Artificial sequence
  SiRNA target sequence
aggctggtttggtactgatgg

SEQ ID NO: 47563 - DNA, 21 bp, Artificial sequence
  SiRNA target sequence
ggctggtttggtactgatgga

SEQ ID NO: 47564 - DNA, 21 bp, Artificial sequence
  SiRNA target sequence
gctggtttggtactgatggag

SEQ ID NO: 47565 - DNA, 21 bp, Artificial sequence
  SiRNA target sequence
ctggtttggtactgatggaga

SEQ ID NO: 47566 - DNA, 21 bp, Artificial sequence
  SiRNA target sequence
tggtttggtactgatggagaa

SEQ ID NO: 47567 - DNA, 21 bp, Artificial sequence
  SiRNA target sequence
ggtttggtactgatggagaat

SEQ ID NO: 47568 - DNA, 21 bp, Artificial sequence
  SiRNA target sequence
gtttggtactgatggagaatt

SEQ ID NO: 47569 - DNA, 21 bp, Artificial sequence
  SiRNA target sequence
tttggtactgatggagaattt

SEQ ID NO: 47570 - DNA, 21 bp, Artificial sequence
  SiRNA target sequence
ttggtactgatggagaattta

SEQ ID NO: 47571 - DNA, 21 bp, Artificial sequence
  SiRNA target sequence
tggtactgatggagaatttat

SEQ ID NO: 47572 - DNA, 21 bp, Artificial sequence
  SiRNA target sequence
ggtactgatggagaatttatt

SEQ ID NO: 47573 - DNA, 21 bp, Artificial sequence
  SiRNA target sequence
gtactgatggagaatttattc

SEQ ID NO: 47574 - DNA, 21 bp, Artificial sequence
  SiRNA target sequence
tactgatggagaatttattct

SEQ ID NO: 47575 - DNA, 21 bp, Artificial sequence
  SiRNA target sequence
actgatggagaatttattctc

SEQ ID NO: 47576 - DNA, 21 bp, Artificial sequence
  SiRNA target sequence
ctgatggagaatttattctca

SEQ ID NO: 47577 - DNA, 21 bp, Artificial sequence
  SiRNA target sequence
tgatggagaatttattctcaa

SEQ ID NO: 47578 - DNA, 21 bp, Artificial sequence
  SiRNA target sequence
gatggagaatttattctcaac

SEQ ID NO: 47579 - DNA, 21 bp, Artificial sequence
  SiRNA target sequence
atggagaatttattctcaacg

SEQ ID NO: 47580 - DNA, 21 bp, Artificial sequence
  SiRNA target sequence
tggagaatttattctcaacga

SEQ ID NO: 47581 - DNA, 21 bp, Artificial sequence
  SiRNA target sequence
ggagaatttattctcaacgaa

SEQ ID NO: 47582 - DNA, 21 bp, Artificial sequence
  SiRNA target sequence
gagaatttattctcaacgaag

SEQ ID NO: 47583 - DNA, 21 bp, Artificial sequence
  SiRNA target sequence
agaatttattctcaacgaaga

SEQ ID NO: 47584 - DNA, 21 bp, Artificial sequence
  SiRNA target sequence
gaatttattctcaacgaagat

SEQ ID NO: 47585 - DNA, 21 bp, Artificial sequence
  SiRNA target sequence
aatttattctcaacgaagatg

SEQ ID NO: 47586 - DNA, 21 bp, Artificial sequence
  SiRNA target sequence
atttattctcaacgaagatgt

SEQ ID NO: 47587 - DNA, 21 bp, Artificial sequence
  SiRNA target sequence
tttattctcaacgaagatgtc

SEQ ID NO: 47588 - DNA, 21 bp, Artificial sequence
  SiRNA target sequence
ttattctcaacgaagatgtcg

SEQ ID NO: 47589 - DNA, 21 bp, Artificial sequence
  SiRNA target sequence
tattctcaacgaagatgtcga

SEQ ID NO: 47590 - DNA, 21 bp, Artificial sequence
  SiRNA target sequence
attctcaacgaagatgtcgaa

SEQ ID NO: 47591 - DNA, 21 bp, Artificial sequence
  SiRNA target sequence
ttctcaacgaagatgtcgaat

SEQ ID NO: 47592 - DNA, 21 bp, Artificial sequence
  SiRNA target sequence
tctcaacgaagatgtcgaatt

SEQ ID NO: 47593 - DNA, 21 bp, Artificial sequence
  SiRNA target sequence
ctcaacgaagatgtcgaatta

SEQ ID NO: 47594 - DNA, 21 bp, Artificial sequence
  SiRNA target sequence
tcaacgaagatgtcgaattag

SEQ ID NO: 47595 - DNA, 21 bp, Artificial sequence
  SiRNA target sequence
caacgaagatgtcgaattagc

SEQ ID NO: 47596 - DNA, 21 bp, Artificial sequence
  SiRNA target sequence
aacgaagatgtcgaattagcc

SEQ ID NO: 47597 - DNA, 21 bp, Artificial sequence
  SiRNA target sequence
acgaagatgtcgaattagccg

SEQ ID NO: 47598 - DNA, 21 bp, Artificial sequence
  SiRNA target sequence
cgaagatgtcgaattagccgt

SEQ ID NO: 47599 - DNA, 21 bp, Artificial sequence
  SiRNA target sequence
gaagatgtcgaattagccgta

SEQ ID NO: 47600 - DNA, 21 bp, Artificial sequence
  SiRNA target sequence
aagatgtcgaattagccgtac

SEQ ID NO: 47601 - DNA, 21 bp, Artificial sequence
  SiRNA target sequence
agatgtcgaattagccgtaca

SEQ ID NO: 47602 - DNA, 21 bp, Artificial sequence
  SiRNA target sequence
gatgtcgaattagccgtacaa

SEQ ID NO: 47603 - DNA, 21 bp, Artificial sequence
  SiRNA target sequence
atgtcgaattagccgtacaac

SEQ ID NO: 47604 - DNA, 21 bp, Artificial sequence
  SiRNA target sequence
tgtcgaattagccgtacaacg

SEQ ID NO: 47605 - DNA, 21 bp, Artificial sequence
  SiRNA target sequence
gtcgaattagccgtacaacga

SEQ ID NO: 47606 - DNA, 21 bp, Artificial sequence
  SiRNA target sequence
tcgaattagccgtacaacgac

SEQ ID NO: 47607 - DNA, 21 bp, Artificial sequence
  SiRNA target sequence
cgaattagccgtacaacgacg

SEQ ID NO: 47608 - DNA, 21 bp, Artificial sequence
  SiRNA target sequence
gaattagccgtacaacgacga

SEQ ID NO: 47609 - DNA, 21 bp, Artificial sequence
  SiRNA target sequence
aattagccgtacaacgacgac

SEQ ID NO: 47610 - DNA, 21 bp, Artificial sequence
  SiRNA target sequence
attagccgtacaacgacgact

SEQ ID NO: 47611 - DNA, 21 bp, Artificial sequence
  SiRNA target sequence
ttagccgtacaacgacgacta

SEQ ID NO: 47612 - DNA, 21 bp, Artificial sequence
  SiRNA target sequence
tagccgtacaacgacgactac

SEQ ID NO: 47613 - DNA, 21 bp, Artificial sequence
  SiRNA target sequence
agccgtacaacgacgactaca

SEQ ID NO: 47614 - DNA, 21 bp, Artificial sequence
  SiRNA target sequence
gccgtacaacgacgactacaa

SEQ ID NO: 47615 - DNA, 21 bp, Artificial sequence
  SiRNA target sequence
ccgtacaacgacgactacaag

SEQ ID NO: 47616 - DNA, 21 bp, Artificial sequence
  SiRNA target sequence
cgtacaacgacgactacaagc

SEQ ID NO: 47617 - DNA, 21 bp, Artificial sequence
  SiRNA target sequence
gtacaacgacgactacaagca

SEQ ID NO: 47618 - DNA, 21 bp, Artificial sequence
  SiRNA target sequence
tacaacgacgactacaagcag

SEQ ID NO: 47619 - DNA, 21 bp, Artificial sequence
  SiRNA target sequence
acaacgacgactacaagcagc

SEQ ID NO: 47620 - DNA, 21 bp, Artificial sequence
  SiRNA target sequence
caacgacgactacaagcagct

SEQ ID NO: 47621 - DNA, 21 bp, Artificial sequence
  SiRNA target sequence
aacgacgactacaagcagctc

SEQ ID NO: 47622 - DNA, 21 bp, Artificial sequence
  SiRNA target sequence
acgacgactacaagcagctcg

SEQ ID NO: 47623 - DNA, 21 bp, Artificial sequence
  SiRNA target sequence
cgacgactacaagcagctcgt

SEQ ID NO: 47624 - DNA, 21 bp, Artificial sequence
  SiRNA target sequence
gacgactacaagcagctcgtg

SEQ ID NO: 47625 - DNA, 21 bp, Artificial sequence
  SiRNA target sequence
acgactacaagcagctcgtga

SEQ ID NO: 47626 - DNA, 21 bp, Artificial sequence
  SiRNA target sequence
cgactacaagcagctcgtgaa

SEQ ID NO: 47627 - DNA, 21 bp, Artificial sequence
  SiRNA target sequence
gactacaagcagctcgtgaag

SEQ ID NO: 47628 - DNA, 21 bp, Artificial sequence
  SiRNA target sequence
actacaagcagctcgtgaagg

SEQ ID NO: 47629 - DNA, 21 bp, Artificial sequence
  SiRNA target sequence
ctacaagcagctcgtgaagga

SEQ ID NO: 47630 - DNA, 21 bp, Artificial sequence
  SiRNA target sequence
tacaagcagctcgtgaaggaa

SEQ ID NO: 47631 - DNA, 21 bp, Artificial sequence
  SiRNA target sequence
acaagcagctcgtgaaggaaa

SEQ ID NO: 47632 - DNA, 21 bp, Artificial sequence
  SiRNA target sequence
caagcagctcgtgaaggaaaa

SEQ ID NO: 47633 - DNA, 21 bp, Artificial sequence
  SiRNA target sequence
aagcagctcgtgaaggaaaac

SEQ ID NO: 47634 - DNA, 21 bp, Artificial sequence
  SiRNA target sequence
agcagctcgtgaaggaaaacg

SEQ ID NO: 47635 - DNA, 21 bp, Artificial sequence
  SiRNA target sequence
gcagctcgtgaaggaaaacga

SEQ ID NO: 47636 - DNA, 21 bp, Artificial sequence
  SiRNA target sequence
cagctcgtgaaggaaaacgat

SEQ ID NO: 47637 - DNA, 21 bp, Artificial sequence
  SiRNA target sequence
agctcgtgaaggaaaacgatt

SEQ ID NO: 47638 - DNA, 21 bp, Artificial sequence
  SiRNA target sequence
gctcgtgaaggaaaacgatta

SEQ ID NO: 47639 - DNA, 21 bp, Artificial sequence
  SiRNA target sequence
ctcgtgaaggaaaacgattac

SEQ ID NO: 47640 - DNA, 21 bp, Artificial sequence
  SiRNA target sequence
tcgtgaaggaaaacgattacc

SEQ ID NO: 47641 - DNA, 21 bp, Artificial sequence
  SiRNA target sequence
cgtgaaggaaaacgattacct

SEQ ID NO: 47642 - DNA, 21 bp, Artificial sequence
  SiRNA target sequence
gtgaaggaaaacgattacctg

SEQ ID NO: 47643 - DNA, 21 bp, Artificial sequence
  SiRNA target sequence
tgaaggaaaacgattacctgt

SEQ ID NO: 47644 - DNA, 21 bp, Artificial sequence
  SiRNA target sequence
gaaggaaaacgattacctgtg

SEQ ID NO: 47645 - DNA, 21 bp, Artificial sequence
  SiRNA target sequence
aaggaaaacgattacctgtga

SEQ ID NO: 47646 - DNA, 21 bp, Artificial sequence
  SiRNA target sequence
aggaaaacgattacctgtgat

SEQ ID NO: 47647 - DNA, 21 bp, Artificial sequence
  SiRNA target sequence
ggaaaacgattacctgtgatg

SEQ ID NO: 47648 - DNA, 21 bp, Artificial sequence
  SiRNA target sequence
gaaaacgattacctgtgatgt

SEQ ID NO: 47649 - DNA, 21 bp, Artificial sequence
  SiRNA target sequence
aaaacgattacctgtgatgtg

SEQ ID NO: 47650 - DNA, 21 bp, Artificial sequence
  SiRNA target sequence
aaacgattacctgtgatgtgg

SEQ ID NO: 47651 - DNA, 21 bp, Artificial sequence
  SiRNA target sequence
aacgattacctgtgatgtggg

SEQ ID NO: 47652 - DNA, 21 bp, Artificial sequence
  SiRNA target sequence
acgattacctgtgatgtgggt

SEQ ID NO: 47653 - DNA, 21 bp, Artificial sequence
  SiRNA target sequence
cgattacctgtgatgtgggtc

SEQ ID NO: 47654 - DNA, 21 bp, Artificial sequence
  SiRNA target sequence
gattacctgtgatgtgggtcg

SEQ ID NO: 47655 - DNA, 21 bp, Artificial sequence
  SiRNA target sequence
attacctgtgatgtgggtcga

SEQ ID NO: 47656 - DNA, 21 bp, Artificial sequence
  SiRNA target sequence
ttacctgtgatgtgggtcgac

SEQ ID NO: 47657 - DNA, 21 bp, Artificial sequence
  SiRNA target sequence
tacctgtgatgtgggtcgaca

SEQ ID NO: 47658 - DNA, 21 bp, Artificial sequence
  SiRNA target sequence
acctgtgatgtgggtcgacac

SEQ ID NO: 47659 - DNA, 21 bp, Artificial sequence
  SiRNA target sequence
cctgtgatgtgggtcgacaca

SEQ ID NO: 47660 - DNA, 21 bp, Artificial sequence
  SiRNA target sequence
ctgtgatgtgggtcgacacat

SEQ ID NO: 47661 - DNA, 21 bp, Artificial sequence
  SiRNA target sequence
tgtgatgtgggtcgacacatt

SEQ ID NO: 47662 - DNA, 21 bp, Artificial sequence
  SiRNA target sequence
gtgatgtgggtcgacacattg

SEQ ID NO: 47663 - DNA, 21 bp, Artificial sequence
  SiRNA target sequence
tgatgtgggtcgacacattga

SEQ ID NO: 47664 - DNA, 21 bp, Artificial sequence
  SiRNA target sequence
gatgtgggtcgacacattgaa

SEQ ID NO: 47665 - DNA, 21 bp, Artificial sequence
  SiRNA target sequence
atgtgggtcgacacattgaaa

SEQ ID NO: 47666 - DNA, 21 bp, Artificial sequence
  SiRNA target sequence
tgtgggtcgacacattgaaag

SEQ ID NO: 47667 - DNA, 21 bp, Artificial sequence
  SiRNA target sequence
gtgggtcgacacattgaaaga

SEQ ID NO: 47668 - DNA, 21 bp, Artificial sequence
  SiRNA target sequence
tgggtcgacacattgaaagat

SEQ ID NO: 47669 - DNA, 21 bp, Artificial sequence
  SiRNA target sequence
gggtcgacacattgaaagatg

SEQ ID NO: 47670 - DNA, 21 bp, Artificial sequence
  SiRNA target sequence
ggtcgacacattgaaagatga

SEQ ID NO: 47671 - DNA, 21 bp, Artificial sequence
  SiRNA target sequence
gtcgacacattgaaagatgaa

SEQ ID NO: 47672 - DNA, 21 bp, Artificial sequence
  SiRNA target sequence
tcgacacattgaaagatgaac

SEQ ID NO: 47673 - DNA, 21 bp, Artificial sequence
  SiRNA target sequence
cgacacattgaaagatgaacg

SEQ ID NO: 47674 - DNA, 21 bp, Artificial sequence
  SiRNA target sequence
gacacattgaaagatgaacgt

SEQ ID NO: 47675 - DNA, 21 bp, Artificial sequence
  SiRNA target sequence
acacattgaaagatgaacgtc

SEQ ID NO: 47676 - DNA, 21 bp, Artificial sequence
  SiRNA target sequence
cacattgaaagatgaacgtcg

SEQ ID NO: 47677 - DNA, 21 bp, Artificial sequence
  SiRNA target sequence
acattgaaagatgaacgtcga

SEQ ID NO: 47678 - DNA, 21 bp, Artificial sequence
  SiRNA target sequence
cattgaaagatgaacgtcgac

SEQ ID NO: 47679 - DNA, 21 bp, Artificial sequence
  SiRNA target sequence
attgaaagatgaacgtcgacc

SEQ ID NO: 47680 - DNA, 21 bp, Artificial sequence
  SiRNA target sequence
ttgaaagatgaacgtcgacct

SEQ ID NO: 47681 - DNA, 21 bp, Artificial sequence
  SiRNA target sequence
tgaaagatgaacgtcgaccta

SEQ ID NO: 47682 - DNA, 21 bp, Artificial sequence
  SiRNA target sequence
gaaagatgaacgtcgacctat

SEQ ID NO: 47683 - DNA, 21 bp, Artificial sequence
  SiRNA target sequence
aaagatgaacgtcgacctatt

SEQ ID NO: 47684 - DNA, 21 bp, Artificial sequence
  SiRNA target sequence
aagatgaacgtcgacctattg

SEQ ID NO: 47685 - DNA, 21 bp, Artificial sequence
  SiRNA target sequence
agatgaacgtcgacctattga

SEQ ID NO: 47686 - DNA, 21 bp, Artificial sequence
  SiRNA target sequence
gatgaacgtcgacctattgaa

SEQ ID NO: 47687 - DNA, 21 bp, Artificial sequence
  SiRNA target sequence
atgaacgtcgacctattgaaa

SEQ ID NO: 47688 - DNA, 21 bp, Artificial sequence
  SiRNA target sequence
tgaacgtcgacctattgaaaa

SEQ ID NO: 47689 - DNA, 21 bp, Artificial sequence
  SiRNA target sequence
gaacgtcgacctattgaaaaa

SEQ ID NO: 47690 - DNA, 21 bp, Artificial sequence
  SiRNA target sequence
aacgtcgacctattgaaaaag

SEQ ID NO: 47691 - DNA, 21 bp, Artificial sequence
  SiRNA target sequence
acgtcgacctattgaaaaagt

SEQ ID NO: 47692 - DNA, 21 bp, Artificial sequence
  SiRNA target sequence
cgtcgacctattgaaaaagtt

SEQ ID NO: 47693 - DNA, 21 bp, Artificial sequence
  SiRNA target sequence
gtcgacctattgaaaaagtta

SEQ ID NO: 47694 - DNA, 21 bp, Artificial sequence
  SiRNA target sequence
tcgacctattgaaaaagttaa

SEQ ID NO: 47695 - DNA, 21 bp, Artificial sequence
  SiRNA target sequence
cgacctattgaaaaagttaat

SEQ ID NO: 47696 - DNA, 21 bp, Artificial sequence
  SiRNA target sequence
gacctattgaaaaagttaatc

SEQ ID NO: 47697 - DNA, 21 bp, Artificial sequence
  SiRNA target sequence
acctattgaaaaagttaatca

SEQ ID NO: 47698 - DNA, 21 bp, Artificial sequence
  SiRNA target sequence
cctattgaaaaagttaatcaa

SEQ ID NO: 47699 - DNA, 21 bp, Artificial sequence
  SiRNA target sequence
ctattgaaaaagttaatcaat

SEQ ID NO: 47700 - DNA, 21 bp, Artificial sequence
  SiRNA target sequence
tattgaaaaagttaatcaatt

SEQ ID NO: 47701 - DNA, 21 bp, Artificial sequence
  SiRNA target sequence
attgaaaaagttaatcaattg

SEQ ID NO: 47702 - DNA, 21 bp, Artificial sequence
  SiRNA target sequence
ttgaaaaagttaatcaattga

SEQ ID NO: 47703 - DNA, 21 bp, Artificial sequence
  SiRNA target sequence
tgaaaaagttaatcaattgaa

SEQ ID NO: 47704 - DNA, 21 bp, Artificial sequence
  SiRNA target sequence
gaaaaagttaatcaattgaaa

SEQ ID NO: 47705 - DNA, 21 bp, Artificial sequence
  SiRNA target sequence
aaaaagttaatcaattgaaaa

SEQ ID NO: 47706 - DNA, 21 bp, Artificial sequence
  SiRNA target sequence
aaaagttaatcaattgaaaac

SEQ ID NO: 47707 - DNA, 21 bp, Artificial sequence
  SiRNA target sequence
aaagttaatcaattgaaaaca

SEQ ID NO: 47708 - DNA, 21 bp, Artificial sequence
  SiRNA target sequence
aagttaatcaattgaaaacac

SEQ ID NO: 47709 - DNA, 21 bp, Artificial sequence
  SiRNA target sequence
agttaatcaattgaaaacacg

SEQ ID NO: 47710 - DNA, 21 bp, Artificial sequence
  SiRNA target sequence
gttaatcaattgaaaacacga

SEQ ID NO: 47711 - DNA, 21 bp, Artificial sequence
  SiRNA target sequence
ttaatcaattgaaaacacgag

SEQ ID NO: 47712 - DNA, 21 bp, Artificial sequence
  SiRNA target sequence
taatcaattgaaaacacgagt

SEQ ID NO: 47713 - DNA, 21 bp, Artificial sequence
  SiRNA target sequence
aatcaattgaaaacacgagta

SEQ ID NO: 47714 - DNA, 21 bp, Artificial sequence
  SiRNA target sequence
atcaattgaaaacacgagtat

SEQ ID NO: 47715 - DNA, 21 bp, Artificial sequence
  SiRNA target sequence
tcaattgaaaacacgagtatt

SEQ ID NO: 47716 - DNA, 21 bp, Artificial sequence
  SiRNA target sequence
caattgaaaacacgagtattc

SEQ ID NO: 47717 - DNA, 21 bp, Artificial sequence
  SiRNA target sequence
aattgaaaacacgagtattct

SEQ ID NO: 47718 - DNA, 21 bp, Artificial sequence
  SiRNA target sequence
attgaaaacacgagtattctc

SEQ ID NO: 47719 - DNA, 21 bp, Artificial sequence
  SiRNA target sequence
ttgaaaacacgagtattctca

SEQ ID NO: 47720 - DNA, 21 bp, Artificial sequence
  SiRNA target sequence
tgaaaacacgagtattctcaa

SEQ ID NO: 47721 - DNA, 21 bp, Artificial sequence
  SiRNA target sequence
gaaaacacgagtattctcaaa

SEQ ID NO: 47722 - DNA, 21 bp, Artificial sequence
  SiRNA target sequence
aaaacacgagtattctcaaat

SEQ ID NO: 47723 - DNA, 21 bp, Artificial sequence
  SiRNA target sequence
aaacacgagtattctcaaatg

SEQ ID NO: 47724 - DNA, 21 bp, Artificial sequence
  SiRNA target sequence
aacacgagtattctcaaatgg

SEQ ID NO: 47725 - DNA, 21 bp, Artificial sequence
  SiRNA target sequence
acacgagtattctcaaatgga

SEQ ID NO: 47726 - DNA, 21 bp, Artificial sequence
  SiRNA target sequence
cacgagtattctcaaatggac

SEQ ID NO: 47727 - DNA, 21 bp, Artificial sequence
  SiRNA target sequence
acgagtattctcaaatggacc

SEQ ID NO: 47728 - DNA, 21 bp, Artificial sequence
  SiRNA target sequence
cgagtattctcaaatggacca

SEQ ID NO: 47729 - DNA, 21 bp, Artificial sequence
  SiRNA target sequence
gagtattctcaaatggaccaa

SEQ ID NO: 47730 - DNA, 21 bp, Artificial sequence
  SiRNA target sequence
agtattctcaaatggaccaat

SEQ ID NO: 47731 - DNA, 21 bp, Artificial sequence
  SiRNA target sequence
gtattctcaaatggaccaatg

SEQ ID NO: 47732 - DNA, 21 bp, Artificial sequence
  SiRNA target sequence
tattctcaaatggaccaatgg

SEQ ID NO: 47733 - DNA, 21 bp, Artificial sequence
  SiRNA target sequence
attctcaaatggaccaatgga

SEQ ID NO: 47734 - DNA, 21 bp, Artificial sequence
  SiRNA target sequence
ttctcaaatggaccaatggac

SEQ ID NO: 47735 - DNA, 21 bp, Artificial sequence
  SiRNA target sequence
tctcaaatggaccaatggact

SEQ ID NO: 47736 - DNA, 21 bp, Artificial sequence
  SiRNA target sequence
ctcaaatggaccaatggactt

SEQ ID NO: 47737 - DNA, 21 bp, Artificial sequence
  SiRNA target sequence
tcaaatggaccaatggacttc

SEQ ID NO: 47738 - DNA, 21 bp, Artificial sequence
  SiRNA target sequence
caaatggaccaatggacttct

SEQ ID NO: 47739 - DNA, 21 bp, Artificial sequence
  SiRNA target sequence
aaatggaccaatggacttctc

SEQ ID NO: 47740 - DNA, 21 bp, Artificial sequence
  SiRNA target sequence
aatggaccaatggacttctca

SEQ ID NO: 47741 - DNA, 21 bp, Artificial sequence
  SiRNA target sequence
atggaccaatggacttctcaa

SEQ ID NO: 47742 - DNA, 21 bp, Artificial sequence
  SiRNA target sequence
tggaccaatggacttctcaat

SEQ ID NO: 47743 - DNA, 21 bp, Artificial sequence
  SiRNA target sequence
ggaccaatggacttctcaatt

SEQ ID NO: 47744 - DNA, 21 bp, Artificial sequence
  SiRNA target sequence
gaccaatggacttctcaattg

SEQ ID NO: 47745 - DNA, 21 bp, Artificial sequence
  SiRNA target sequence
accaatggacttctcaattgc

SEQ ID NO: 47746 - DNA, 21 bp, Artificial sequence
  SiRNA target sequence
ccaatggacttctcaattgcg

SEQ ID NO: 47747 - DNA, 21 bp, Artificial sequence
  SiRNA target sequence
caatggacttctcaattgcgt

SEQ ID NO: 47748 - DNA, 21 bp, Artificial sequence
  SiRNA target sequence
aatggacttctcaattgcgtt

SEQ ID NO: 47749 - DNA, 21 bp, Artificial sequence
  SiRNA target sequence
atggacttctcaattgcgttt

SEQ ID NO: 47750 - DNA, 21 bp, Artificial sequence
  SiRNA target sequence
tggacttctcaattgcgtttc

SEQ ID NO: 47751 - DNA, 21 bp, Artificial sequence
  SiRNA target sequence
ggacttctcaattgcgtttcg

SEQ ID NO: 47752 - DNA, 21 bp, Artificial sequence
  SiRNA target sequence
gacttctcaattgcgtttcga

SEQ ID NO: 47753 - DNA, 21 bp, Artificial sequence
  SiRNA target sequence
acttctcaattgcgtttcgaa

SEQ ID NO: 47754 - DNA, 21 bp, Artificial sequence
  SiRNA target sequence
cttctcaattgcgtttcgaat

SEQ ID NO: 47755 - DNA, 21 bp, Artificial sequence
  SiRNA target sequence
ttctcaattgcgtttcgaatg

SEQ ID NO: 47756 - DNA, 21 bp, Artificial sequence
  SiRNA target sequence
tctcaattgcgtttcgaatgt

SEQ ID NO: 47757 - DNA, 21 bp, Artificial sequence
  SiRNA target sequence
ctcaattgcgtttcgaatgta

SEQ ID NO: 47758 - DNA, 21 bp, Artificial sequence
  SiRNA target sequence
tcaattgcgtttcgaatgtat

SEQ ID NO: 47759 - DNA, 21 bp, Artificial sequence
  SiRNA target sequence
caattgcgtttcgaatgtatt

SEQ ID NO: 47760 - DNA, 21 bp, Artificial sequence
  SiRNA target sequence
aattgcgtttcgaatgtatta

SEQ ID NO: 47761 - DNA, 21 bp, Artificial sequence
  SiRNA target sequence
attgcgtttcgaatgtattat

SEQ ID NO: 47762 - DNA, 21 bp, Artificial sequence
  SiRNA target sequence
ttgcgtttcgaatgtattatt

SEQ ID NO: 47763 - DNA, 21 bp, Artificial sequence
  SiRNA target sequence
tgcgtttcgaatgtattattt

SEQ ID NO: 47764 - DNA, 21 bp, Artificial sequence
  SiRNA target sequence
gcgtttcgaatgtattatttg

SEQ ID NO: 47765 - DNA, 21 bp, Artificial sequence
  SiRNA target sequence
cgtttcgaatgtattatttgg

SEQ ID NO: 47766 - DNA, 21 bp, Artificial sequence
  SiRNA target sequence
gtttcgaatgtattatttggg

SEQ ID NO: 47767 - DNA, 21 bp, Artificial sequence
  SiRNA target sequence
tttcgaatgtattatttgggc

SEQ ID NO: 47768 - DNA, 21 bp, Artificial sequence
  SiRNA target sequence
ttcgaatgtattatttgggct

SEQ ID NO: 47769 - DNA, 21 bp, Artificial sequence
  SiRNA target sequence
tcgaatgtattatttgggctt

SEQ ID NO: 47770 - DNA, 21 bp, Artificial sequence
  SiRNA target sequence
cgaatgtattatttgggcttt

SEQ ID NO: 47771 - DNA, 21 bp, Artificial sequence
  SiRNA target sequence
gaatgtattatttgggcttta

SEQ ID NO: 47772 - DNA, 21 bp, Artificial sequence
  SiRNA target sequence
aatgtattatttgggctttat

SEQ ID NO: 47773 - DNA, 21 bp, Artificial sequence
  SiRNA target sequence
atgtattatttgggctttata

SEQ ID NO: 47774 - DNA, 21 bp, Artificial sequence
  SiRNA target sequence
tgtattatttgggctttatag

SEQ ID NO: 47775 - DNA, 21 bp, Artificial sequence
  SiRNA target sequence
gtattatttgggctttatagc

SEQ ID NO: 47776 - DNA, 21 bp, Artificial sequence
  SiRNA target sequence
tattatttgggctttatagct

SEQ ID NO: 47777 - DNA, 21 bp, Artificial sequence
  SiRNA target sequence
attatttgggctttatagctc

SEQ ID NO: 47778 - DNA, 21 bp, Artificial sequence
  SiRNA target sequence
ttatttgggctttatagctca

SEQ ID NO: 47779 - DNA, 21 bp, Artificial sequence
  SiRNA target sequence
tatttgggctttatagctcat

SEQ ID NO: 47780 - DNA, 21 bp, Artificial sequence
  SiRNA target sequence
atttgggctttatagctcatt

SEQ ID NO: 47781 - DNA, 21 bp, Artificial sequence
  SiRNA target sequence
tttgggctttatagctcattt

SEQ ID NO: 47782 - DNA, 21 bp, Artificial sequence
  SiRNA target sequence
ttgggctttatagctcatttg

SEQ ID NO: 47783 - DNA, 21 bp, Artificial sequence
  SiRNA target sequence
tgggctttatagctcatttga

SEQ ID NO: 47784 - DNA, 21 bp, Artificial sequence
  SiRNA target sequence
gggctttatagctcatttgat

SEQ ID NO: 47785 - DNA, 21 bp, Artificial sequence
  SiRNA target sequence
ggctttatagctcatttgatg

SEQ ID NO: 47786 - DNA, 21 bp, Artificial sequence
  SiRNA target sequence
gctttatagctcatttgatgg

SEQ ID NO: 47787 - DNA, 21 bp, Artificial sequence
  SiRNA target sequence
ctttatagctcatttgatgga

SEQ ID NO: 47788 - DNA, 21 bp, Artificial sequence
  SiRNA target sequence
tttatagctcatttgatggaa

SEQ ID NO: 47789 - DNA, 21 bp, Artificial sequence
  SiRNA target sequence
ttatagctcatttgatggaaa

SEQ ID NO: 47790 - DNA, 21 bp, Artificial sequence
  SiRNA target sequence
tatagctcatttgatggaaaa

SEQ ID NO: 47791 - DNA, 21 bp, Artificial sequence
  SiRNA target sequence
atagctcatttgatggaaaat

SEQ ID NO: 47792 - DNA, 21 bp, Artificial sequence
  SiRNA target sequence
tagctcatttgatggaaaatc

SEQ ID NO: 47793 - DNA, 21 bp, Artificial sequence
  SiRNA target sequence
agctcatttgatggaaaatcg

SEQ ID NO: 47794 - DNA, 21 bp, Artificial sequence
  SiRNA target sequence
gctcatttgatggaaaatcga

SEQ ID NO: 47795 - DNA, 21 bp, Artificial sequence
  SiRNA target sequence
ctcatttgatggaaaatcgaa

SEQ ID NO: 47796 - DNA, 21 bp, Artificial sequence
  SiRNA target sequence
tcatttgatggaaaatcgaat

SEQ ID NO: 47797 - DNA, 21 bp, Artificial sequence
  SiRNA target sequence
catttgatggaaaatcgaatt

SEQ ID NO: 47798 - DNA, 21 bp, Artificial sequence
  SiRNA target sequence
atttgatggaaaatcgaatta

SEQ ID NO: 47799 - DNA, 21 bp, Artificial sequence
  SiRNA target sequence
tttgatggaaaatcgaattac

SEQ ID NO: 47800 - DNA, 21 bp, Artificial sequence
  SiRNA target sequence
ttgatggaaaatcgaattacg

SEQ ID NO: 47801 - DNA, 21 bp, Artificial sequence
  SiRNA target sequence
tgatggaaaatcgaattacga

SEQ ID NO: 47802 - DNA, 21 bp, Artificial sequence
  SiRNA target sequence
gatggaaaatcgaattacgaa

SEQ ID NO: 47803 - DNA, 21 bp, Artificial sequence
  SiRNA target sequence
atggaaaatcgaattacgaat

SEQ ID NO: 47804 - DNA, 21 bp, Artificial sequence
  SiRNA target sequence
tggaaaatcgaattacgaatg

SEQ ID NO: 47805 - DNA, 21 bp, Artificial sequence
  SiRNA target sequence
ggaaaatcgaattacgaatga

SEQ ID NO: 47806 - DNA, 21 bp, Artificial sequence
  SiRNA target sequence
gaaaatcgaattacgaatgaa

SEQ ID NO: 47807 - DNA, 21 bp, Artificial sequence
  SiRNA target sequence
aaaatcgaattacgaatgaag

SEQ ID NO: 47808 - DNA, 21 bp, Artificial sequence
  SiRNA target sequence
aaatcgaattacgaatgaagt

SEQ ID NO: 47809 - DNA, 21 bp, Artificial sequence
  SiRNA target sequence
aatcgaattacgaatgaagtg

SEQ ID NO: 47810 - DNA, 21 bp, Artificial sequence
  SiRNA target sequence
atcgaattacgaatgaagtgt

SEQ ID NO: 47811 - DNA, 21 bp, Artificial sequence
  SiRNA target sequence
tcgaattacgaatgaagtgtc

SEQ ID NO: 47812 - DNA, 21 bp, Artificial sequence
  SiRNA target sequence
cgaattacgaatgaagtgtct

SEQ ID NO: 47813 - DNA, 21 bp, Artificial sequence
  SiRNA target sequence
gaattacgaatgaagtgtcta

SEQ ID NO: 47814 - DNA, 21 bp, Artificial sequence
  SiRNA target sequence
aattacgaatgaagtgtctat

SEQ ID NO: 47815 - DNA, 21 bp, Artificial sequence
  SiRNA target sequence
attacgaatgaagtgtctatt

SEQ ID NO: 47816 - DNA, 21 bp, Artificial sequence
  SiRNA target sequence
ttacgaatgaagtgtctattg

SEQ ID NO: 47817 - DNA, 21 bp, Artificial sequence
  SiRNA target sequence
tacgaatgaagtgtctattgg

SEQ ID NO: 47818 - DNA, 21 bp, Artificial sequence
  SiRNA target sequence
acgaatgaagtgtctattgga

SEQ ID NO: 47819 - DNA, 21 bp, Artificial sequence
  SiRNA target sequence
cgaatgaagtgtctattggaa

SEQ ID NO: 47820 - DNA, 21 bp, Artificial sequence
  SiRNA target sequence
gaatgaagtgtctattggaac

SEQ ID NO: 47821 - DNA, 21 bp, Artificial sequence
  SiRNA target sequence
aatgaagtgtctattggaacg

SEQ ID NO: 47822 - DNA, 21 bp, Artificial sequence
  SiRNA target sequence
atgaagtgtctattggaacga

SEQ ID NO: 47823 - DNA, 21 bp, Artificial sequence
  SiRNA target sequence
tgaagtgtctattggaacgaa

SEQ ID NO: 47824 - DNA, 21 bp, Artificial sequence
  SiRNA target sequence
gaagtgtctattggaacgaat

SEQ ID NO: 47825 - DNA, 21 bp, Artificial sequence
  SiRNA target sequence
aagtgtctattggaacgaatg

SEQ ID NO: 47826 - DNA, 21 bp, Artificial sequence
  SiRNA target sequence
agtgtctattggaacgaatgt

SEQ ID NO: 47827 - DNA, 21 bp, Artificial sequence
  SiRNA target sequence
gtgtctattggaacgaatgtt

SEQ ID NO: 47828 - DNA, 21 bp, Artificial sequence
  SiRNA target sequence
tgtctattggaacgaatgttt

SEQ ID NO: 47829 - DNA, 21 bp, Artificial sequence
  SiRNA target sequence
gtctattggaacgaatgttta

SEQ ID NO: 47830 - DNA, 21 bp, Artificial sequence
  SiRNA target sequence
tctattggaacgaatgtttac

SEQ ID NO: 47831 - DNA, 21 bp, Artificial sequence
  SiRNA target sequence
ctattggaacgaatgtttact

SEQ ID NO: 47832 - DNA, 21 bp, Artificial sequence
  SiRNA target sequence
tattggaacgaatgtttactc

SEQ ID NO: 47833 - DNA, 21 bp, Artificial sequence
  SiRNA target sequence
attggaacgaatgtttactca

SEQ ID NO: 47834 - DNA, 21 bp, Artificial sequence
  SiRNA target sequence
ttggaacgaatgtttactcac

SEQ ID NO: 47835 - DNA, 21 bp, Artificial sequence
  SiRNA target sequence
tggaacgaatgtttactcaca

SEQ ID NO: 47836 - DNA, 21 bp, Artificial sequence
  SiRNA target sequence
ggaacgaatgtttactcacaa

SEQ ID NO: 47837 - DNA, 21 bp, Artificial sequence
  SiRNA target sequence
gaacgaatgtttactcacaag

SEQ ID NO: 47838 - DNA, 21 bp, Artificial sequence
  SiRNA target sequence
aacgaatgtttactcacaaga

SEQ ID NO: 47839 - DNA, 21 bp, Artificial sequence
  SiRNA target sequence
acgaatgtttactcacaagac

SEQ ID NO: 47840 - DNA, 21 bp, Artificial sequence
  SiRNA target sequence
cgaatgtttactcacaagact

SEQ ID NO: 47841 - DNA, 21 bp, Artificial sequence
  SiRNA target sequence
gaatgtttactcacaagactg

SEQ ID NO: 47842 - DNA, 21 bp, Artificial sequence
  SiRNA target sequence
aatgtttactcacaagactgg

SEQ ID NO: 47843 - DNA, 21 bp, Artificial sequence
  SiRNA target sequence
atgtttactcacaagactgga

SEQ ID NO: 47844 - DNA, 21 bp, Artificial sequence
  SiRNA target sequence
tgtttactcacaagactggag

SEQ ID NO: 47845 - DNA, 21 bp, Artificial sequence
  SiRNA target sequence
gtttactcacaagactggagt

SEQ ID NO: 47846 - DNA, 21 bp, Artificial sequence
  SiRNA target sequence
tttactcacaagactggagta

SEQ ID NO: 47847 - DNA, 21 bp, Artificial sequence
  SiRNA target sequence
ttactcacaagactggagtaa

SEQ ID NO: 47848 - DNA, 21 bp, Artificial sequence
  SiRNA target sequence
tactcacaagactggagtaaa

SEQ ID NO: 47849 - DNA, 21 bp, Artificial sequence
  SiRNA target sequence
actcacaagactggagtaaaa

SEQ ID NO: 47850 - DNA, 21 bp, Artificial sequence
  SiRNA target sequence
ctcacaagactggagtaaaac

SEQ ID NO: 47851 - DNA, 21 bp, Artificial sequence
  SiRNA target sequence
tcacaagactggagtaaaact

SEQ ID NO: 47852 - DNA, 21 bp, Artificial sequence
  SiRNA target sequence
cacaagactggagtaaaactg

SEQ ID NO: 47853 - DNA, 21 bp, Artificial sequence
  SiRNA target sequence
acaagactggagtaaaactgt

SEQ ID NO: 47854 - DNA, 21 bp, Artificial sequence
  SiRNA target sequence
caagactggagtaaaactgtt

SEQ ID NO: 47855 - DNA, 21 bp, Artificial sequence
  SiRNA target sequence
aagactggagtaaaactgtta

SEQ ID NO: 47856 - DNA, 21 bp, Artificial sequence
  SiRNA target sequence
agactggagtaaaactgttag

SEQ ID NO: 47857 - DNA, 21 bp, Artificial sequence
  SiRNA target sequence
gactggagtaaaactgttagg

SEQ ID NO: 47858 - DNA, 21 bp, Artificial sequence
  SiRNA target sequence
actggagtaaaactgttagga

SEQ ID NO: 47859 - DNA, 21 bp, Artificial sequence
  SiRNA target sequence
ctggagtaaaactgttaggaa

SEQ ID NO: 47860 - DNA, 21 bp, Artificial sequence
  SiRNA target sequence
tggagtaaaactgttaggaaa

SEQ ID NO: 47861 - DNA, 21 bp, Artificial sequence
  SiRNA target sequence
ggagtaaaactgttaggaaat

SEQ ID NO: 47862 - DNA, 21 bp, Artificial sequence
  SiRNA target sequence
gagtaaaactgttaggaaatt

SEQ ID NO: 47863 - DNA, 21 bp, Artificial sequence
  SiRNA target sequence
agtaaaactgttaggaaatta

SEQ ID NO: 47864 - DNA, 21 bp, Artificial sequence
  SiRNA target sequence
gtaaaactgttaggaaattaa

SEQ ID NO: 47865 - DNA, 21 bp, Artificial sequence
  SiRNA target sequence
taaaactgttaggaaattaac

SEQ ID NO: 47866 - DNA, 21 bp, Artificial sequence
  SiRNA target sequence
aaaactgttaggaaattaacc

SEQ ID NO: 47867 - DNA, 21 bp, Artificial sequence
  SiRNA target sequence
aaactgttaggaaattaacca

SEQ ID NO: 47868 - DNA, 21 bp, Artificial sequence
  SiRNA target sequence
aactgttaggaaattaaccaa

SEQ ID NO: 47869 - DNA, 21 bp, Artificial sequence
  SiRNA target sequence
actgttaggaaattaaccaaa

SEQ ID NO: 47870 - DNA, 21 bp, Artificial sequence
  SiRNA target sequence
ctgttaggaaattaaccaaat

SEQ ID NO: 47871 - DNA, 21 bp, Artificial sequence
  SiRNA target sequence
tgttaggaaattaaccaaatt

SEQ ID NO: 47872 - DNA, 21 bp, Artificial sequence
  SiRNA target sequence
gttaggaaattaaccaaattt

SEQ ID NO: 47873 - DNA, 21 bp, Artificial sequence
  SiRNA target sequence
ttaggaaattaaccaaatttg

SEQ ID NO: 47874 - DNA, 21 bp, Artificial sequence
  SiRNA target sequence
taggaaattaaccaaatttgg

SEQ ID NO: 47875 - DNA, 21 bp, Artificial sequence
  SiRNA target sequence
aggaaattaaccaaatttgga

SEQ ID NO: 47876 - DNA, 21 bp, Artificial sequence
  SiRNA target sequence
ggaaattaaccaaatttggaa

SEQ ID NO: 47877 - DNA, 21 bp, Artificial sequence
  SiRNA target sequence
gaaattaaccaaatttggaaa

SEQ ID NO: 47878 - DNA, 21 bp, Artificial sequence
  SiRNA target sequence
aaattaaccaaatttggaaat

SEQ ID NO: 47879 - DNA, 21 bp, Artificial sequence
  SiRNA target sequence
aattaaccaaatttggaaata

SEQ ID NO: 47880 - DNA, 21 bp, Artificial sequence
  SiRNA target sequence
attaaccaaatttggaaataa

SEQ ID NO: 47881 - DNA, 21 bp, Artificial sequence
  SiRNA target sequence
ttaaccaaatttggaaataaa

SEQ ID NO: 47882 - DNA, 21 bp, Artificial sequence
  SiRNA target sequence
taaccaaatttggaaataaag

SEQ ID NO: 47883 - DNA, 21 bp, Artificial sequence
  SiRNA target sequence
aaccaaatttggaaataaagt

SEQ ID NO: 47884 - DNA, 21 bp, Artificial sequence
  SiRNA target sequence
accaaatttggaaataaagta

SEQ ID NO: 47885 - DNA, 21 bp, Artificial sequence
  SiRNA target sequence
ccaaatttggaaataaagtaa

SEQ ID NO: 47886 - DNA, 21 bp, Artificial sequence
  SiRNA target sequence
caaatttggaaataaagtaat

SEQ ID NO: 47887 - DNA, 21 bp, Artificial sequence
  SiRNA target sequence
aaatttggaaataaagtaatt

SEQ ID NO: 47888 - DNA, 21 bp, Artificial sequence
  SiRNA target sequence
aatttggaaataaagtaattg

SEQ ID NO: 47889 - DNA, 21 bp, Artificial sequence
  SiRNA target sequence
atttggaaataaagtaattgc

SEQ ID NO: 47890 - DNA, 21 bp, Artificial sequence
  SiRNA target sequence
tttggaaataaagtaattgct

SEQ ID NO: 47891 - DNA, 21 bp, Artificial sequence
  SiRNA target sequence
ttggaaataaagtaattgctg

SEQ ID NO: 47892 - DNA, 21 bp, Artificial sequence
  SiRNA target sequence
tggaaataaagtaattgctgg

SEQ ID NO: 47893 - DNA, 21 bp, Artificial sequence
  SiRNA target sequence
ggaaataaagtaattgctggt

SEQ ID NO: 47894 - DNA, 21 bp, Artificial sequence
  SiRNA target sequence
gaaataaagtaattgctggtg

SEQ ID NO: 47895 - DNA, 21 bp, Artificial sequence
  SiRNA target sequence
aaataaagtaattgctggtga

SEQ ID NO: 47896 - DNA, 21 bp, Artificial sequence
  SiRNA target sequence
aataaagtaattgctggtgat

SEQ ID NO: 47897 - DNA, 21 bp, Artificial sequence
  SiRNA target sequence
ataaagtaattgctggtgatt

SEQ ID NO: 47898 - DNA, 21 bp, Artificial sequence
  SiRNA target sequence
taaagtaattgctggtgattt

SEQ ID NO: 47899 - DNA, 21 bp, Artificial sequence
  SiRNA target sequence
aaagtaattgctggtgatttt

SEQ ID NO: 47900 - DNA, 21 bp, Artificial sequence
  SiRNA target sequence
aagtaattgctggtgattttt

SEQ ID NO: 47901 - DNA, 21 bp, Artificial sequence
  SiRNA target sequence
agtaattgctggtgatttttc

SEQ ID NO: 47902 - DNA, 21 bp, Artificial sequence
  SiRNA target sequence
gtaattgctggtgatttttca

SEQ ID NO: 47903 - DNA, 21 bp, Artificial sequence
  SiRNA target sequence
taattgctggtgatttttcaa

SEQ ID NO: 47904 - DNA, 21 bp, Artificial sequence
  SiRNA target sequence
aattgctggtgatttttcaac

SEQ ID NO: 47905 - DNA, 21 bp, Artificial sequence
  SiRNA target sequence
attgctggtgatttttcaact

SEQ ID NO: 47906 - DNA, 21 bp, Artificial sequence
  SiRNA target sequence
ttgctggtgatttttcaactt

SEQ ID NO: 47907 - DNA, 21 bp, Artificial sequence
  SiRNA target sequence
tgctggtgatttttcaacttt

SEQ ID NO: 47908 - DNA, 21 bp, Artificial sequence
  SiRNA target sequence
gctggtgatttttcaactttt

SEQ ID NO: 47909 - DNA, 21 bp, Artificial sequence
  SiRNA target sequence
ctggtgatttttcaacttttg

SEQ ID NO: 47910 - DNA, 21 bp, Artificial sequence
  SiRNA target sequence
tggtgatttttcaacttttga

SEQ ID NO: 47911 - DNA, 21 bp, Artificial sequence
  SiRNA target sequence
ggtgatttttcaacttttgat

SEQ ID NO: 47912 - DNA, 21 bp, Artificial sequence
  SiRNA target sequence
gtgatttttcaacttttgatg

SEQ ID NO: 47913 - DNA, 21 bp, Artificial sequence
  SiRNA target sequence
tgatttttcaacttttgatgg

SEQ ID NO: 47914 - DNA, 21 bp, Artificial sequence
  SiRNA target sequence
gatttttcaacttttgatgga

SEQ ID NO: 47915 - DNA, 21 bp, Artificial sequence
  SiRNA target sequence
atttttcaacttttgatggat

SEQ ID NO: 47916 - DNA, 21 bp, Artificial sequence
  SiRNA target sequence
tttttcaacttttgatggatc

SEQ ID NO: 47917 - DNA, 21 bp, Artificial sequence
  SiRNA target sequence
ttttcaacttttgatggatca

SEQ ID NO: 47918 - DNA, 21 bp, Artificial sequence
  SiRNA target sequence
tttcaacttttgatggatcac

SEQ ID NO: 47919 - DNA, 21 bp, Artificial sequence
  SiRNA target sequence
ttcaacttttgatggatcact

SEQ ID NO: 47920 - DNA, 21 bp, Artificial sequence
  SiRNA target sequence
tcaacttttgatggatcacta

SEQ ID NO: 47921 - DNA, 21 bp, Artificial sequence
  SiRNA target sequence
caacttttgatggatcactaa

SEQ ID NO: 47922 - DNA, 21 bp, Artificial sequence
  SiRNA target sequence
aacttttgatggatcactaaa

SEQ ID NO: 47923 - DNA, 21 bp, Artificial sequence
  SiRNA target sequence
acttttgatggatcactaaac

SEQ ID NO: 47924 - DNA, 21 bp, Artificial sequence
  SiRNA target sequence
cttttgatggatcactaaacg

SEQ ID NO: 47925 - DNA, 21 bp, Artificial sequence
  SiRNA target sequence
ttttgatggatcactaaacgt

SEQ ID NO: 47926 - DNA, 21 bp, Artificial sequence
  SiRNA target sequence
tttgatggatcactaaacgtt

SEQ ID NO: 47927 - DNA, 21 bp, Artificial sequence
  SiRNA target sequence
ttgatggatcactaaacgttt

SEQ ID NO: 47928 - DNA, 21 bp, Artificial sequence
  SiRNA target sequence
tgatggatcactaaacgtttg

SEQ ID NO: 47929 - DNA, 21 bp, Artificial sequence
  SiRNA target sequence
gatggatcactaaacgtttgc

SEQ ID NO: 47930 - DNA, 21 bp, Artificial sequence
  SiRNA target sequence
atggatcactaaacgtttgca

SEQ ID NO: 47931 - DNA, 21 bp, Artificial sequence
  SiRNA target sequence
tggatcactaaacgtttgcat

SEQ ID NO: 47932 - DNA, 21 bp, Artificial sequence
  SiRNA target sequence
ggatcactaaacgtttgcatt

SEQ ID NO: 47933 - DNA, 21 bp, Artificial sequence
  SiRNA target sequence
gatcactaaacgtttgcatta

SEQ ID NO: 47934 - DNA, 21 bp, Artificial sequence
  SiRNA target sequence
atcactaaacgtttgcattat

SEQ ID NO: 47935 - DNA, 21 bp, Artificial sequence
  SiRNA target sequence
tcactaaacgtttgcattatg

SEQ ID NO: 47936 - DNA, 21 bp, Artificial sequence
  SiRNA target sequence
cactaaacgtttgcattatgg

SEQ ID NO: 47937 - DNA, 21 bp, Artificial sequence
  SiRNA target sequence
actaaacgtttgcattatgga

SEQ ID NO: 47938 - DNA, 21 bp, Artificial sequence
  SiRNA target sequence
ctaaacgtttgcattatggaa

SEQ ID NO: 47939 - DNA, 21 bp, Artificial sequence
  SiRNA target sequence
taaacgtttgcattatggaaa

SEQ ID NO: 47940 - DNA, 21 bp, Artificial sequence
  SiRNA target sequence
aaacgtttgcattatggaaaa

SEQ ID NO: 47941 - DNA, 21 bp, Artificial sequence
  SiRNA target sequence
aacgtttgcattatggaaaaa

SEQ ID NO: 47942 - DNA, 21 bp, Artificial sequence
  SiRNA target sequence
acgtttgcattatggaaaaat

SEQ ID NO: 47943 - DNA, 21 bp, Artificial sequence
  SiRNA target sequence
cgtttgcattatggaaaaatt

SEQ ID NO: 47944 - DNA, 21 bp, Artificial sequence
  SiRNA target sequence
gtttgcattatggaaaaattt

SEQ ID NO: 47945 - DNA, 21 bp, Artificial sequence
  SiRNA target sequence
tttgcattatggaaaaatttg

SEQ ID NO: 47946 - DNA, 21 bp, Artificial sequence
  SiRNA target sequence
ttgcattatggaaaaatttgc

SEQ ID NO: 47947 - DNA, 21 bp, Artificial sequence
  SiRNA target sequence
tgcattatggaaaaatttgca

SEQ ID NO: 47948 - DNA, 21 bp, Artificial sequence
  SiRNA target sequence
gcattatggaaaaatttgcag

SEQ ID NO: 47949 - DNA, 21 bp, Artificial sequence
  SiRNA target sequence
cattatggaaaaatttgcaga

SEQ ID NO: 47950 - DNA, 21 bp, Artificial sequence
  SiRNA target sequence
attatggaaaaatttgcagat

SEQ ID NO: 47951 - DNA, 21 bp, Artificial sequence
  SiRNA target sequence
ttatggaaaaatttgcagatt

SEQ ID NO: 47952 - DNA, 21 bp, Artificial sequence
  SiRNA target sequence
tatggaaaaatttgcagattt

SEQ ID NO: 47953 - DNA, 21 bp, Artificial sequence
  SiRNA target sequence
atggaaaaatttgcagattta

SEQ ID NO: 47954 - DNA, 21 bp, Artificial sequence
  SiRNA target sequence
tggaaaaatttgcagatttag

SEQ ID NO: 47955 - DNA, 21 bp, Artificial sequence
  SiRNA target sequence
ggaaaaatttgcagatttagc

SEQ ID NO: 47956 - DNA, 21 bp, Artificial sequence
  SiRNA target sequence
gaaaaatttgcagatttagct

SEQ ID NO: 47957 - DNA, 21 bp, Artificial sequence
  SiRNA target sequence
aaaaatttgcagatttagcta

SEQ ID NO: 47958 - DNA, 21 bp, Artificial sequence
  SiRNA target sequence
aaaatttgcagatttagctaa

SEQ ID NO: 47959 - DNA, 21 bp, Artificial sequence
  SiRNA target sequence
aaatttgcagatttagctaat

SEQ ID NO: 47960 - DNA, 21 bp, Artificial sequence
  SiRNA target sequence
aatttgcagatttagctaatg

SEQ ID NO: 47961 - DNA, 21 bp, Artificial sequence
  SiRNA target sequence
atttgcagatttagctaatga

SEQ ID NO: 47962 - DNA, 21 bp, Artificial sequence
  SiRNA target sequence
tttgcagatttagctaatgag

SEQ ID NO: 47963 - DNA, 21 bp, Artificial sequence
  SiRNA target sequence
ttgcagatttagctaatgagt

SEQ ID NO: 47964 - DNA, 21 bp, Artificial sequence
  SiRNA target sequence
tgcagatttagctaatgagtt

SEQ ID NO: 47965 - DNA, 21 bp, Artificial sequence
  SiRNA target sequence
gcagatttagctaatgagttt

SEQ ID NO: 47966 - DNA, 21 bp, Artificial sequence
  SiRNA target sequence
cagatttagctaatgagtttt

SEQ ID NO: 47967 - DNA, 21 bp, Artificial sequence
  SiRNA target sequence
agatttagctaatgagtttta

SEQ ID NO: 47968 - DNA, 21 bp, Artificial sequence
  SiRNA target sequence
gatttagctaatgagttttac

SEQ ID NO: 47969 - DNA, 21 bp, Artificial sequence
  SiRNA target sequence
atttagctaatgagttttacg

SEQ ID NO: 47970 - DNA, 21 bp, Artificial sequence
  SiRNA target sequence
tttagctaatgagttttacga

SEQ ID NO: 47971 - DNA, 21 bp, Artificial sequence
  SiRNA target sequence
ttagctaatgagttttacgat

SEQ ID NO: 47972 - DNA, 21 bp, Artificial sequence
  SiRNA target sequence
tagctaatgagttttacgatg

SEQ ID NO: 47973 - DNA, 21 bp, Artificial sequence
  SiRNA target sequence
agctaatgagttttacgatga

SEQ ID NO: 47974 - DNA, 21 bp, Artificial sequence
  SiRNA target sequence
gctaatgagttttacgatgac

SEQ ID NO: 47975 - DNA, 21 bp, Artificial sequence
  SiRNA target sequence
ctaatgagttttacgatgacg

SEQ ID NO: 47976 - DNA, 21 bp, Artificial sequence
  SiRNA target sequence
taatgagttttacgatgacgg

SEQ ID NO: 47977 - DNA, 21 bp, Artificial sequence
  SiRNA target sequence
aatgagttttacgatgacgga

SEQ ID NO: 47978 - DNA, 21 bp, Artificial sequence
  SiRNA target sequence
atgagttttacgatgacggac

SEQ ID NO: 47979 - DNA, 21 bp, Artificial sequence
  SiRNA target sequence
tgagttttacgatgacggacc

SEQ ID NO: 47980 - DNA, 21 bp, Artificial sequence
  SiRNA target sequence
gagttttacgatgacggaccg

SEQ ID NO: 47981 - DNA, 21 bp, Artificial sequence
  SiRNA target sequence
agttttacgatgacggaccgg

SEQ ID NO: 47982 - DNA, 21 bp, Artificial sequence
  SiRNA target sequence
gttttacgatgacggaccgga

SEQ ID NO: 47983 - DNA, 21 bp, Artificial sequence
  SiRNA target sequence
ttttacgatgacggaccggaa

SEQ ID NO: 47984 - DNA, 21 bp, Artificial sequence
  SiRNA target sequence
tttacgatgacggaccggaaa

SEQ ID NO: 47985 - DNA, 21 bp, Artificial sequence
  SiRNA target sequence
ttacgatgacggaccggaaaa

SEQ ID NO: 47986 - DNA, 21 bp, Artificial sequence
  SiRNA target sequence
tacgatgacggaccggaaaat

SEQ ID NO: 47987 - DNA, 21 bp, Artificial sequence
  SiRNA target sequence
acgatgacggaccggaaaatg

SEQ ID NO: 47988 - DNA, 21 bp, Artificial sequence
  SiRNA target sequence
cgatgacggaccggaaaatgc

SEQ ID NO: 47989 - DNA, 21 bp, Artificial sequence
  SiRNA target sequence
gatgacggaccggaaaatgct

SEQ ID NO: 47990 - DNA, 21 bp, Artificial sequence
  SiRNA target sequence
atgacggaccggaaaatgctt

SEQ ID NO: 47991 - DNA, 21 bp, Artificial sequence
  SiRNA target sequence
tgacggaccggaaaatgcttt

SEQ ID NO: 47992 - DNA, 21 bp, Artificial sequence
  SiRNA target sequence
gacggaccggaaaatgctttg

SEQ ID NO: 47993 - DNA, 21 bp, Artificial sequence
  SiRNA target sequence
acggaccggaaaatgctttga

SEQ ID NO: 47994 - DNA, 21 bp, Artificial sequence
  SiRNA target sequence
cggaccggaaaatgctttgat

SEQ ID NO: 47995 - DNA, 21 bp, Artificial sequence
  SiRNA target sequence
ggaccggaaaatgctttgata

SEQ ID NO: 47996 - DNA, 21 bp, Artificial sequence
  SiRNA target sequence
gaccggaaaatgctttgatac

SEQ ID NO: 47997 - DNA, 21 bp, Artificial sequence
  SiRNA target sequence
accggaaaatgctttgatacg

SEQ ID NO: 47998 - DNA, 21 bp, Artificial sequence
  SiRNA target sequence
ccggaaaatgctttgatacgt

SEQ ID NO: 47999 - DNA, 21 bp, Artificial sequence
  SiRNA target sequence
cggaaaatgctttgatacgtc

SEQ ID NO: 48000 - DNA, 21 bp, Artificial sequence
  SiRNA target sequence
ggaaaatgctttgatacgtca

SEQ ID NO: 48001 - DNA, 21 bp, Artificial sequence
  SiRNA target sequence
gaaaatgctttgatacgtcat

SEQ ID NO: 48002 - DNA, 21 bp, Artificial sequence
  SiRNA target sequence
aaaatgctttgatacgtcatg

SEQ ID NO: 48003 - DNA, 21 bp, Artificial sequence
  SiRNA target sequence
aaatgctttgatacgtcatgt

SEQ ID NO: 48004 - DNA, 21 bp, Artificial sequence
  SiRNA target sequence
aatgctttgatacgtcatgtt

SEQ ID NO: 48005 - DNA, 21 bp, Artificial sequence
  SiRNA target sequence
atgctttgatacgtcatgttc

SEQ ID NO: 48006 - DNA, 21 bp, Artificial sequence
  SiRNA target sequence
tgctttgatacgtcatgttct

SEQ ID NO: 48007 - DNA, 21 bp, Artificial sequence
  SiRNA target sequence
gctttgatacgtcatgttcta

SEQ ID NO: 48008 - DNA, 21 bp, Artificial sequence
  SiRNA target sequence
ctttgatacgtcatgttctat

SEQ ID NO: 48009 - DNA, 21 bp, Artificial sequence
  SiRNA target sequence
tttgatacgtcatgttctatt

SEQ ID NO: 48010 - DNA, 21 bp, Artificial sequence
  SiRNA target sequence
ttgatacgtcatgttctattg

SEQ ID NO: 48011 - DNA, 21 bp, Artificial sequence
  SiRNA target sequence
tgatacgtcatgttctattga

SEQ ID NO: 48012 - DNA, 21 bp, Artificial sequence
  SiRNA target sequence
gatacgtcatgttctattgat

SEQ ID NO: 48013 - DNA, 21 bp, Artificial sequence
  SiRNA target sequence
atacgtcatgttctattgatg

SEQ ID NO: 48014 - DNA, 21 bp, Artificial sequence
  SiRNA target sequence
tacgtcatgttctattgatgg

SEQ ID NO: 48015 - DNA, 21 bp, Artificial sequence
  SiRNA target sequence
acgtcatgttctattgatgga

SEQ ID NO: 48016 - DNA, 21 bp, Artificial sequence
  SiRNA target sequence
cgtcatgttctattgatggat

SEQ ID NO: 48017 - DNA, 21 bp, Artificial sequence
  SiRNA target sequence
gtcatgttctattgatggatg

SEQ ID NO: 48018 - DNA, 21 bp, Artificial sequence
  SiRNA target sequence
tcatgttctattgatggatgt

SEQ ID NO: 48019 - DNA, 21 bp, Artificial sequence
  SiRNA target sequence
catgttctattgatggatgtg

SEQ ID NO: 48020 - DNA, 21 bp, Artificial sequence
  SiRNA target sequence
atgttctattgatggatgtgt

SEQ ID NO: 48021 - DNA, 21 bp, Artificial sequence
  SiRNA target sequence
tgttctattgatggatgtgta

SEQ ID NO: 48022 - DNA, 21 bp, Artificial sequence
  SiRNA target sequence
gttctattgatggatgtgtac

SEQ ID NO: 48023 - DNA, 21 bp, Artificial sequence
  SiRNA target sequence
ttctattgatggatgtgtaca

SEQ ID NO: 48024 - DNA, 21 bp, Artificial sequence
  SiRNA target sequence
tctattgatggatgtgtacaa

SEQ ID NO: 48025 - DNA, 21 bp, Artificial sequence
  SiRNA target sequence
ctattgatggatgtgtacaat

SEQ ID NO: 48026 - DNA, 21 bp, Artificial sequence
  SiRNA target sequence
tattgatggatgtgtacaatt

SEQ ID NO: 48027 - DNA, 21 bp, Artificial sequence
  SiRNA target sequence
attgatggatgtgtacaattc

SEQ ID NO: 48028 - DNA, 21 bp, Artificial sequence
  SiRNA target sequence
ttgatggatgtgtacaattct

SEQ ID NO: 48029 - DNA, 21 bp, Artificial sequence
  SiRNA target sequence
tgatggatgtgtacaattctg

SEQ ID NO: 48030 - DNA, 21 bp, Artificial sequence
  SiRNA target sequence
gatggatgtgtacaattctgt

SEQ ID NO: 48031 - DNA, 21 bp, Artificial sequence
  SiRNA target sequence
atggatgtgtacaattctgta

SEQ ID NO: 48032 - DNA, 21 bp, Artificial sequence
  SiRNA target sequence
tggatgtgtacaattctgtac

SEQ ID NO: 48033 - DNA, 21 bp, Artificial sequence
  SiRNA target sequence
ggatgtgtacaattctgtaca

SEQ ID NO: 48034 - DNA, 21 bp, Artificial sequence
  SiRNA target sequence
gatgtgtacaattctgtacat

SEQ ID NO: 48035 - DNA, 21 bp, Artificial sequence
  SiRNA target sequence
atgtgtacaattctgtacatg

SEQ ID NO: 48036 - DNA, 21 bp, Artificial sequence
  SiRNA target sequence
tgtgtacaattctgtacatgt

SEQ ID NO: 48037 - DNA, 21 bp, Artificial sequence
  SiRNA target sequence
gtgtacaattctgtacatgtc

SEQ ID NO: 48038 - DNA, 21 bp, Artificial sequence
  SiRNA target sequence
tgtacaattctgtacatgtct

SEQ ID NO: 48039 - DNA, 21 bp, Artificial sequence
  SiRNA target sequence
gtacaattctgtacatgtctg

SEQ ID NO: 48040 - DNA, 21 bp, Artificial sequence
  SiRNA target sequence
tacaattctgtacatgtctgt

SEQ ID NO: 48041 - DNA, 21 bp, Artificial sequence
  SiRNA target sequence
acaattctgtacatgtctgta

SEQ ID NO: 48042 - DNA, 21 bp, Artificial sequence
  SiRNA target sequence
caattctgtacatgtctgtaa

SEQ ID NO: 48043 - DNA, 21 bp, Artificial sequence
  SiRNA target sequence
aattctgtacatgtctgtaat

SEQ ID NO: 48044 - DNA, 21 bp, Artificial sequence
  SiRNA target sequence
attctgtacatgtctgtaatg

SEQ ID NO: 48045 - DNA, 21 bp, Artificial sequence
  SiRNA target sequence
ttctgtacatgtctgtaatga

SEQ ID NO: 48046 - DNA, 21 bp, Artificial sequence
  SiRNA target sequence
tctgtacatgtctgtaatgat

SEQ ID NO: 48047 - DNA, 21 bp, Artificial sequence
  SiRNA target sequence
ctgtacatgtctgtaatgatt

SEQ ID NO: 48048 - DNA, 21 bp, Artificial sequence
  SiRNA target sequence
tgtacatgtctgtaatgattc

SEQ ID NO: 48049 - DNA, 21 bp, Artificial sequence
  SiRNA target sequence
gtacatgtctgtaatgattca

SEQ ID NO: 48050 - DNA, 21 bp, Artificial sequence
  SiRNA target sequence
tacatgtctgtaatgattcag

SEQ ID NO: 48051 - DNA, 21 bp, Artificial sequence
  SiRNA target sequence
acatgtctgtaatgattcagt

SEQ ID NO: 48052 - DNA, 21 bp, Artificial sequence
  SiRNA target sequence
catgtctgtaatgattcagta

SEQ ID NO: 48053 - DNA, 21 bp, Artificial sequence
  SiRNA target sequence
atgtctgtaatgattcagtat

SEQ ID NO: 48054 - DNA, 21 bp, Artificial sequence
  SiRNA target sequence
tgtctgtaatgattcagtata

SEQ ID NO: 48055 - DNA, 21 bp, Artificial sequence
  SiRNA target sequence
gtctgtaatgattcagtatac

SEQ ID NO: 48056 - DNA, 21 bp, Artificial sequence
  SiRNA target sequence
tctgtaatgattcagtataca

SEQ ID NO: 48057 - DNA, 21 bp, Artificial sequence
  SiRNA target sequence
ctgtaatgattcagtatacat

SEQ ID NO: 48058 - DNA, 21 bp, Artificial sequence
  SiRNA target sequence
tgtaatgattcagtatacatg

SEQ ID NO: 48059 - DNA, 21 bp, Artificial sequence
  SiRNA target sequence
gtaatgattcagtatacatga

SEQ ID NO: 48060 - DNA, 21 bp, Artificial sequence
  SiRNA target sequence
taatgattcagtatacatgat

SEQ ID NO: 48061 - DNA, 21 bp, Artificial sequence
  SiRNA target sequence
aatgattcagtatacatgatg

SEQ ID NO: 48062 - DNA, 21 bp, Artificial sequence
  SiRNA target sequence
atgattcagtatacatgatga

SEQ ID NO: 48063 - DNA, 21 bp, Artificial sequence
  SiRNA target sequence
tgattcagtatacatgatgac

SEQ ID NO: 48064 - DNA, 21 bp, Artificial sequence
  SiRNA target sequence
gattcagtatacatgatgact

SEQ ID NO: 48065 - DNA, 21 bp, Artificial sequence
  SiRNA target sequence
attcagtatacatgatgactc

SEQ ID NO: 48066 - DNA, 21 bp, Artificial sequence
  SiRNA target sequence
ttcagtatacatgatgactca

SEQ ID NO: 48067 - DNA, 21 bp, Artificial sequence
  SiRNA target sequence
tcagtatacatgatgactcat

SEQ ID NO: 48068 - DNA, 21 bp, Artificial sequence
  SiRNA target sequence
cagtatacatgatgactcata

SEQ ID NO: 48069 - DNA, 21 bp, Artificial sequence
  SiRNA target sequence
agtatacatgatgactcatag

SEQ ID NO: 48070 - DNA, 21 bp, Artificial sequence
  SiRNA target sequence
gtatacatgatgactcatagc

SEQ ID NO: 48071 - DNA, 21 bp, Artificial sequence
  SiRNA target sequence
tatacatgatgactcatagcc

SEQ ID NO: 48072 - DNA, 21 bp, Artificial sequence
  SiRNA target sequence
atacatgatgactcatagcca

SEQ ID NO: 48073 - DNA, 21 bp, Artificial sequence
  SiRNA target sequence
tacatgatgactcatagccaa

SEQ ID NO: 48074 - DNA, 21 bp, Artificial sequence
  SiRNA target sequence
acatgatgactcatagccaac

SEQ ID NO: 48075 - DNA, 21 bp, Artificial sequence
  SiRNA target sequence
catgatgactcatagccaacc

SEQ ID NO: 48076 - DNA, 21 bp, Artificial sequence
  SiRNA target sequence
atgatgactcatagccaacct

SEQ ID NO: 48077 - DNA, 21 bp, Artificial sequence
  SiRNA target sequence
tgatgactcatagccaacctt

SEQ ID NO: 48078 - DNA, 21 bp, Artificial sequence
  SiRNA target sequence
gatgactcatagccaaccttc

SEQ ID NO: 48079 - DNA, 21 bp, Artificial sequence
  SiRNA target sequence
atgactcatagccaaccttca

SEQ ID NO: 48080 - DNA, 21 bp, Artificial sequence
  SiRNA target sequence
tgactcatagccaaccttcag

SEQ ID NO: 48081 - DNA, 21 bp, Artificial sequence
  SiRNA target sequence
gactcatagccaaccttcagg

SEQ ID NO: 48082 - DNA, 21 bp, Artificial sequence
  SiRNA target sequence
actcatagccaaccttcagga

SEQ ID NO: 48083 - DNA, 21 bp, Artificial sequence
  SiRNA target sequence
ctcatagccaaccttcaggaa

SEQ ID NO: 48084 - DNA, 21 bp, Artificial sequence
  SiRNA target sequence
tcatagccaaccttcaggaaa

SEQ ID NO: 48085 - DNA, 21 bp, Artificial sequence
  SiRNA target sequence
catagccaaccttcaggaaac

SEQ ID NO: 48086 - DNA, 21 bp, Artificial sequence
  SiRNA target sequence
atagccaaccttcaggaaacc

SEQ ID NO: 48087 - DNA, 21 bp, Artificial sequence
  SiRNA target sequence
tagccaaccttcaggaaaccc

SEQ ID NO: 48088 - DNA, 21 bp, Artificial sequence
  SiRNA target sequence
agccaaccttcaggaaacccc

SEQ ID NO: 48089 - DNA, 21 bp, Artificial sequence
  SiRNA target sequence
gccaaccttcaggaaaccccg

SEQ ID NO: 48090 - DNA, 21 bp, Artificial sequence
  SiRNA target sequence
ccaaccttcaggaaaccccgc

SEQ ID NO: 48091 - DNA, 21 bp, Artificial sequence
  SiRNA target sequence
caaccttcaggaaaccccgca

SEQ ID NO: 48092 - DNA, 21 bp, Artificial sequence
  SiRNA target sequence
aaccttcaggaaaccccgcaa

SEQ ID NO: 48093 - DNA, 21 bp, Artificial sequence
  SiRNA target sequence
accttcaggaaaccccgcaac

SEQ ID NO: 48094 - DNA, 21 bp, Artificial sequence
  SiRNA target sequence
ccttcaggaaaccccgcaaca

SEQ ID NO: 48095 - DNA, 21 bp, Artificial sequence
  SiRNA target sequence
cttcaggaaaccccgcaacaa

SEQ ID NO: 48096 - DNA, 21 bp, Artificial sequence
  SiRNA target sequence
ttcaggaaaccccgcaacaac

SEQ ID NO: 48097 - DNA, 21 bp, Artificial sequence
  SiRNA target sequence
tcaggaaaccccgcaacaaca

SEQ ID NO: 48098 - DNA, 21 bp, Artificial sequence
  SiRNA target sequence
caggaaaccccgcaacaacac

SEQ ID NO: 48099 - DNA, 21 bp, Artificial sequence
  SiRNA target sequence
aggaaaccccgcaacaacacc

SEQ ID NO: 48100 - DNA, 21 bp, Artificial sequence
  SiRNA target sequence
ggaaaccccgcaacaacaccc

SEQ ID NO: 48101 - DNA, 21 bp, Artificial sequence
  SiRNA target sequence
gaaaccccgcaacaacacccc

SEQ ID NO: 48102 - DNA, 21 bp, Artificial sequence
  SiRNA target sequence
aaaccccgcaacaacacccct

SEQ ID NO: 48103 - DNA, 21 bp, Artificial sequence
  SiRNA target sequence
aaccccgcaacaacacccctt

SEQ ID NO: 48104 - DNA, 21 bp, Artificial sequence
  SiRNA target sequence
accccgcaacaacacccctta

SEQ ID NO: 48105 - DNA, 21 bp, Artificial sequence
  SiRNA target sequence
ccccgcaacaacaccccttaa

SEQ ID NO: 48106 - DNA, 21 bp, Artificial sequence
  SiRNA target sequence
cccgcaacaacaccccttaac

SEQ ID NO: 48107 - DNA, 21 bp, Artificial sequence
  SiRNA target sequence
ccgcaacaacaccccttaact

SEQ ID NO: 48108 - DNA, 21 bp, Artificial sequence
  SiRNA target sequence
cgcaacaacaccccttaactg

SEQ ID NO: 48109 - DNA, 21 bp, Artificial sequence
  SiRNA target sequence
gcaacaacaccccttaactgt

SEQ ID NO: 48110 - DNA, 21 bp, Artificial sequence
  SiRNA target sequence
caacaacaccccttaactgtt

SEQ ID NO: 48111 - DNA, 21 bp, Artificial sequence
  SiRNA target sequence
aacaacaccccttaactgttt

SEQ ID NO: 48112 - DNA, 21 bp, Artificial sequence
  SiRNA target sequence
acaacaccccttaactgtttc

SEQ ID NO: 48113 - DNA, 21 bp, Artificial sequence
  SiRNA target sequence
caacaccccttaactgtttca

SEQ ID NO: 48114 - DNA, 21 bp, Artificial sequence
  SiRNA target sequence
aacaccccttaactgtttcat

SEQ ID NO: 48115 - DNA, 21 bp, Artificial sequence
  SiRNA target sequence
acaccccttaactgtttcatt

SEQ ID NO: 48116 - DNA, 21 bp, Artificial sequence
  SiRNA target sequence
caccccttaactgtttcatta

SEQ ID NO: 48117 - DNA, 21 bp, Artificial sequence
  SiRNA target sequence
accccttaactgtttcattaa

SEQ ID NO: 48118 - DNA, 21 bp, Artificial sequence
  SiRNA target sequence
ccccttaactgtttcattaat

SEQ ID NO: 48119 - DNA, 21 bp, Artificial sequence
  SiRNA target sequence
cccttaactgtttcattaata

SEQ ID NO: 48120 - DNA, 21 bp, Artificial sequence
  SiRNA target sequence
ccttaactgtttcattaatag

SEQ ID NO: 48121 - DNA, 21 bp, Artificial sequence
  SiRNA target sequence
cttaactgtttcattaatagc

SEQ ID NO: 48122 - DNA, 21 bp, Artificial sequence
  SiRNA target sequence
ttaactgtttcattaatagca

SEQ ID NO: 48123 - DNA, 21 bp, Artificial sequence
  SiRNA target sequence
taactgtttcattaatagcat

SEQ ID NO: 48124 - DNA, 21 bp, Artificial sequence
  SiRNA target sequence
aactgtttcattaatagcatg

SEQ ID NO: 48125 - DNA, 21 bp, Artificial sequence
  SiRNA target sequence
actgtttcattaatagcatgg

SEQ ID NO: 48126 - DNA, 21 bp, Artificial sequence
  SiRNA target sequence
ctgtttcattaatagcatggg

SEQ ID NO: 48127 - DNA, 21 bp, Artificial sequence
  SiRNA target sequence
tgtttcattaatagcatggga

SEQ ID NO: 48128 - DNA, 21 bp, Artificial sequence
  SiRNA target sequence
gtttcattaatagcatgggat

SEQ ID NO: 48129 - DNA, 21 bp, Artificial sequence
  SiRNA target sequence
tttcattaatagcatgggatt

SEQ ID NO: 48130 - DNA, 21 bp, Artificial sequence
  SiRNA target sequence
ttcattaatagcatgggattg

SEQ ID NO: 48131 - DNA, 21 bp, Artificial sequence
  SiRNA target sequence
tcattaatagcatgggattga

SEQ ID NO: 48132 - DNA, 21 bp, Artificial sequence
  SiRNA target sequence
cattaatagcatgggattgag

SEQ ID NO: 48133 - DNA, 21 bp, Artificial sequence
  SiRNA target sequence
attaatagcatgggattgaga

SEQ ID NO: 48134 - DNA, 21 bp, Artificial sequence
  SiRNA target sequence
ttaatagcatgggattgagaa

SEQ ID NO: 48135 - DNA, 21 bp, Artificial sequence
  SiRNA target sequence
taatagcatgggattgagaat

SEQ ID NO: 48136 - DNA, 21 bp, Artificial sequence
  SiRNA target sequence
aatagcatgggattgagaatg

SEQ ID NO: 48137 - DNA, 21 bp, Artificial sequence
  SiRNA target sequence
atagcatgggattgagaatgt

SEQ ID NO: 48138 - DNA, 21 bp, Artificial sequence
  SiRNA target sequence
tagcatgggattgagaatgtg

SEQ ID NO: 48139 - DNA, 21 bp, Artificial sequence
  SiRNA target sequence
agcatgggattgagaatgtgt

SEQ ID NO: 48140 - DNA, 21 bp, Artificial sequence
  SiRNA target sequence
gcatgggattgagaatgtgtt

SEQ ID NO: 48141 - DNA, 21 bp, Artificial sequence
  SiRNA target sequence
catgggattgagaatgtgttt

SEQ ID NO: 48142 - DNA, 21 bp, Artificial sequence
  SiRNA target sequence
atgggattgagaatgtgtttc

SEQ ID NO: 48143 - DNA, 21 bp, Artificial sequence
  SiRNA target sequence
tgggattgagaatgtgtttct

SEQ ID NO: 48144 - DNA, 21 bp, Artificial sequence
  SiRNA target sequence
gggattgagaatgtgtttctc

SEQ ID NO: 48145 - DNA, 21 bp, Artificial sequence
  SiRNA target sequence
ggattgagaatgtgtttctca

SEQ ID NO: 48146 - DNA, 21 bp, Artificial sequence
  SiRNA target sequence
gattgagaatgtgtttctcaa

SEQ ID NO: 48147 - DNA, 21 bp, Artificial sequence
  SiRNA target sequence
attgagaatgtgtttctcaat

SEQ ID NO: 48148 - DNA, 21 bp, Artificial sequence
  SiRNA target sequence
ttgagaatgtgtttctcaatt

SEQ ID NO: 48149 - DNA, 21 bp, Artificial sequence
  SiRNA target sequence
tgagaatgtgtttctcaattt

SEQ ID NO: 48150 - DNA, 21 bp, Artificial sequence
  SiRNA target sequence
gagaatgtgtttctcaatttg

SEQ ID NO: 48151 - DNA, 21 bp, Artificial sequence
  SiRNA target sequence
agaatgtgtttctcaatttgt

SEQ ID NO: 48152 - DNA, 21 bp, Artificial sequence
  SiRNA target sequence
gaatgtgtttctcaatttgtg

SEQ ID NO: 48153 - DNA, 21 bp, Artificial sequence
  SiRNA target sequence
aatgtgtttctcaatttgtgc

SEQ ID NO: 48154 - DNA, 21 bp, Artificial sequence
  SiRNA target sequence
atgtgtttctcaatttgtgct

SEQ ID NO: 48155 - DNA, 21 bp, Artificial sequence
  SiRNA target sequence
tgtgtttctcaatttgtgcta

SEQ ID NO: 48156 - DNA, 21 bp, Artificial sequence
  SiRNA target sequence
gtgtttctcaatttgtgctac

SEQ ID NO: 48157 - DNA, 21 bp, Artificial sequence
  SiRNA target sequence
tgtttctcaatttgtgctact

SEQ ID NO: 48158 - DNA, 21 bp, Artificial sequence
  SiRNA target sequence
gtttctcaatttgtgctacta

SEQ ID NO: 48159 - DNA, 21 bp, Artificial sequence
  SiRNA target sequence
tttctcaatttgtgctactaa

SEQ ID NO: 48160 - DNA, 21 bp, Artificial sequence
  SiRNA target sequence
ttctcaatttgtgctactaaa

SEQ ID NO: 48161 - DNA, 21 bp, Artificial sequence
  SiRNA target sequence
tctcaatttgtgctactaaag

SEQ ID NO: 48162 - DNA, 21 bp, Artificial sequence
  SiRNA target sequence
ctcaatttgtgctactaaagc

SEQ ID NO: 48163 - DNA, 21 bp, Artificial sequence
  SiRNA target sequence
tcaatttgtgctactaaagca

SEQ ID NO: 48164 - DNA, 21 bp, Artificial sequence
  SiRNA target sequence
caatttgtgctactaaagcag

SEQ ID NO: 48165 - DNA, 21 bp, Artificial sequence
  SiRNA target sequence
aatttgtgctactaaagcagc

SEQ ID NO: 48166 - DNA, 21 bp, Artificial sequence
  SiRNA target sequence
atttgtgctactaaagcagcg

SEQ ID NO: 48167 - DNA, 21 bp, Artificial sequence
  SiRNA target sequence
tttgtgctactaaagcagcgg

SEQ ID NO: 48168 - DNA, 21 bp, Artificial sequence
  SiRNA target sequence
ttgtgctactaaagcagcggt

SEQ ID NO: 48169 - DNA, 21 bp, Artificial sequence
  SiRNA target sequence
tgtgctactaaagcagcggtt

SEQ ID NO: 48170 - DNA, 21 bp, Artificial sequence
  SiRNA target sequence
gtgctactaaagcagcggtta

SEQ ID NO: 48171 - DNA, 21 bp, Artificial sequence
  SiRNA target sequence
tgctactaaagcagcggttaa

SEQ ID NO: 48172 - DNA, 21 bp, Artificial sequence
  SiRNA target sequence
gctactaaagcagcggttaaa

SEQ ID NO: 48173 - DNA, 21 bp, Artificial sequence
  SiRNA target sequence
ctactaaagcagcggttaaaa

SEQ ID NO: 48174 - DNA, 21 bp, Artificial sequence
  SiRNA target sequence
tactaaagcagcggttaaaat

SEQ ID NO: 48175 - DNA, 21 bp, Artificial sequence
  SiRNA target sequence
actaaagcagcggttaaaatg

SEQ ID NO: 48176 - DNA, 21 bp, Artificial sequence
  SiRNA target sequence
ctaaagcagcggttaaaatga

SEQ ID NO: 48177 - DNA, 21 bp, Artificial sequence
  SiRNA target sequence
taaagcagcggttaaaatgac

SEQ ID NO: 48178 - DNA, 21 bp, Artificial sequence
  SiRNA target sequence
aaagcagcggttaaaatgacg

SEQ ID NO: 48179 - DNA, 21 bp, Artificial sequence
  SiRNA target sequence
aagcagcggttaaaatgacga

SEQ ID NO: 48180 - DNA, 21 bp, Artificial sequence
  SiRNA target sequence
agcagcggttaaaatgacgat

SEQ ID NO: 48181 - DNA, 21 bp, Artificial sequence
  SiRNA target sequence
gcagcggttaaaatgacgatg

SEQ ID NO: 48182 - DNA, 21 bp, Artificial sequence
  SiRNA target sequence
cagcggttaaaatgacgatga

SEQ ID NO: 48183 - DNA, 21 bp, Artificial sequence
  SiRNA target sequence
agcggttaaaatgacgatgag

SEQ ID NO: 48184 - DNA, 21 bp, Artificial sequence
  SiRNA target sequence
gcggttaaaatgacgatgaga

SEQ ID NO: 48185 - DNA, 21 bp, Artificial sequence
  SiRNA target sequence
cggttaaaatgacgatgagag

SEQ ID NO: 48186 - DNA, 21 bp, Artificial sequence
  SiRNA target sequence
ggttaaaatgacgatgagaga

SEQ ID NO: 48187 - DNA, 21 bp, Artificial sequence
  SiRNA target sequence
gttaaaatgacgatgagagat

SEQ ID NO: 48188 - DNA, 21 bp, Artificial sequence
  SiRNA target sequence
ttaaaatgacgatgagagatt

SEQ ID NO: 48189 - DNA, 21 bp, Artificial sequence
  SiRNA target sequence
taaaatgacgatgagagattt

SEQ ID NO: 48190 - DNA, 21 bp, Artificial sequence
  SiRNA target sequence
aaaatgacgatgagagatttt

SEQ ID NO: 48191 - DNA, 21 bp, Artificial sequence
  SiRNA target sequence
aaatgacgatgagagatttta

SEQ ID NO: 48192 - DNA, 21 bp, Artificial sequence
  SiRNA target sequence
aatgacgatgagagattttag

SEQ ID NO: 48193 - DNA, 21 bp, Artificial sequence
  SiRNA target sequence
atgacgatgagagattttagt

SEQ ID NO: 48194 - DNA, 21 bp, Artificial sequence
  SiRNA target sequence
tgacgatgagagattttagta

SEQ ID NO: 48195 - DNA, 21 bp, Artificial sequence
  SiRNA target sequence
gacgatgagagattttagtaa

SEQ ID NO: 48196 - DNA, 21 bp, Artificial sequence
  SiRNA target sequence
acgatgagagattttagtaaa

SEQ ID NO: 48197 - DNA, 21 bp, Artificial sequence
  SiRNA target sequence
cgatgagagattttagtaaac

SEQ ID NO: 48198 - DNA, 21 bp, Artificial sequence
  SiRNA target sequence
gatgagagattttagtaaaca

SEQ ID NO: 48199 - DNA, 21 bp, Artificial sequence
  SiRNA target sequence
atgagagattttagtaaacat

SEQ ID NO: 48200 - DNA, 21 bp, Artificial sequence
  SiRNA target sequence
tgagagattttagtaaacatg

SEQ ID NO: 48201 - DNA, 21 bp, Artificial sequence
  SiRNA target sequence
gagagattttagtaaacatgt

SEQ ID NO: 48202 - DNA, 21 bp, Artificial sequence
  SiRNA target sequence
agagattttagtaaacatgtt

SEQ ID NO: 48203 - DNA, 21 bp, Artificial sequence
  SiRNA target sequence
gagattttagtaaacatgttt

SEQ ID NO: 48204 - DNA, 21 bp, Artificial sequence
  SiRNA target sequence
agattttagtaaacatgtttc

SEQ ID NO: 48205 - DNA, 21 bp, Artificial sequence
  SiRNA target sequence
gattttagtaaacatgtttcc

SEQ ID NO: 48206 - DNA, 21 bp, Artificial sequence
  SiRNA target sequence
attttagtaaacatgtttccc

SEQ ID NO: 48207 - DNA, 21 bp, Artificial sequence
  SiRNA target sequence
ttttagtaaacatgtttccct

SEQ ID NO: 48208 - DNA, 21 bp, Artificial sequence
  SiRNA target sequence
tttagtaaacatgtttccctc

SEQ ID NO: 48209 - DNA, 21 bp, Artificial sequence
  SiRNA target sequence
ttagtaaacatgtttccctcg

SEQ ID NO: 48210 - DNA, 21 bp, Artificial sequence
  SiRNA target sequence
tagtaaacatgtttccctcgt

SEQ ID NO: 48211 - DNA, 21 bp, Artificial sequence
  SiRNA target sequence
agtaaacatgtttccctcgtc

SEQ ID NO: 48212 - DNA, 21 bp, Artificial sequence
  SiRNA target sequence
gtaaacatgtttccctcgtct

SEQ ID NO: 48213 - DNA, 21 bp, Artificial sequence
  SiRNA target sequence
taaacatgtttccctcgtctc

SEQ ID NO: 48214 - DNA, 21 bp, Artificial sequence
  SiRNA target sequence
aaacatgtttccctcgtctct

SEQ ID NO: 48215 - DNA, 21 bp, Artificial sequence
  SiRNA target sequence
aacatgtttccctcgtctctt

SEQ ID NO: 48216 - DNA, 21 bp, Artificial sequence
  SiRNA target sequence
acatgtttccctcgtctctta

SEQ ID NO: 48217 - DNA, 21 bp, Artificial sequence
  SiRNA target sequence
catgtttccctcgtctcttat

SEQ ID NO: 48218 - DNA, 21 bp, Artificial sequence
  SiRNA target sequence
atgtttccctcgtctcttatg

SEQ ID NO: 48219 - DNA, 21 bp, Artificial sequence
  SiRNA target sequence
tgtttccctcgtctcttatgg

SEQ ID NO: 48220 - DNA, 21 bp, Artificial sequence
  SiRNA target sequence
gtttccctcgtctcttatgga

SEQ ID NO: 48221 - DNA, 21 bp, Artificial sequence
  SiRNA target sequence
tttccctcgtctcttatggag

SEQ ID NO: 48222 - DNA, 21 bp, Artificial sequence
  SiRNA target sequence
ttccctcgtctcttatggaga

SEQ ID NO: 48223 - DNA, 21 bp, Artificial sequence
  SiRNA target sequence
tccctcgtctcttatggagat

SEQ ID NO: 48224 - DNA, 21 bp, Artificial sequence
  SiRNA target sequence
ccctcgtctcttatggagatg

SEQ ID NO: 48225 - DNA, 21 bp, Artificial sequence
  SiRNA target sequence
cctcgtctcttatggagatga

SEQ ID NO: 48226 - DNA, 21 bp, Artificial sequence
  SiRNA target sequence
ctcgtctcttatggagatgat

SEQ ID NO: 48227 - DNA, 21 bp, Artificial sequence
  SiRNA target sequence
tcgtctcttatggagatgata

SEQ ID NO: 48228 - DNA, 21 bp, Artificial sequence
  SiRNA target sequence
cgtctcttatggagatgataa

SEQ ID NO: 48229 - DNA, 21 bp, Artificial sequence
  SiRNA target sequence
gtctcttatggagatgataat

SEQ ID NO: 48230 - DNA, 21 bp, Artificial sequence
  SiRNA target sequence
tctcttatggagatgataatg

SEQ ID NO: 48231 - DNA, 21 bp, Artificial sequence
  SiRNA target sequence
ctcttatggagatgataatgt

SEQ ID NO: 48232 - DNA, 21 bp, Artificial sequence
  SiRNA target sequence
tcttatggagatgataatgta

SEQ ID NO: 48233 - DNA, 21 bp, Artificial sequence
  SiRNA target sequence
cttatggagatgataatgtaa

SEQ ID NO: 48234 - DNA, 21 bp, Artificial sequence
  SiRNA target sequence
ttatggagatgataatgtaat

SEQ ID NO: 48235 - DNA, 21 bp, Artificial sequence
  SiRNA target sequence
tatggagatgataatgtaatt

SEQ ID NO: 48236 - DNA, 21 bp, Artificial sequence
  SiRNA target sequence
atggagatgataatgtaatta

SEQ ID NO: 48237 - DNA, 21 bp, Artificial sequence
  SiRNA target sequence
tggagatgataatgtaattaa

SEQ ID NO: 48238 - DNA, 21 bp, Artificial sequence
  SiRNA target sequence
ggagatgataatgtaattaac

SEQ ID NO: 48239 - DNA, 21 bp, Artificial sequence
  SiRNA target sequence
gagatgataatgtaattaact

SEQ ID NO: 48240 - DNA, 21 bp, Artificial sequence
  SiRNA target sequence
agatgataatgtaattaactt

SEQ ID NO: 48241 - DNA, 21 bp, Artificial sequence
  SiRNA target sequence
gatgataatgtaattaacttc

SEQ ID NO: 48242 - DNA, 21 bp, Artificial sequence
  SiRNA target sequence
atgataatgtaattaacttca

SEQ ID NO: 48243 - DNA, 21 bp, Artificial sequence
  SiRNA target sequence
tgataatgtaattaacttcag

SEQ ID NO: 48244 - DNA, 21 bp, Artificial sequence
  SiRNA target sequence
gataatgtaattaacttcagt

SEQ ID NO: 48245 - DNA, 21 bp, Artificial sequence
  SiRNA target sequence
ataatgtaattaacttcagtg

SEQ ID NO: 48246 - DNA, 21 bp, Artificial sequence
  SiRNA target sequence
taatgtaattaacttcagtga

SEQ ID NO: 48247 - DNA, 21 bp, Artificial sequence
  SiRNA target sequence
aatgtaattaacttcagtgat

SEQ ID NO: 48248 - DNA, 21 bp, Artificial sequence
  SiRNA target sequence
atgtaattaacttcagtgatg

SEQ ID NO: 48249 - DNA, 21 bp, Artificial sequence
  SiRNA target sequence
tgtaattaacttcagtgatga

SEQ ID NO: 48250 - DNA, 21 bp, Artificial sequence
  SiRNA target sequence
gtaattaacttcagtgatgaa

SEQ ID NO: 48251 - DNA, 21 bp, Artificial sequence
  SiRNA target sequence
taattaacttcagtgatgaag

SEQ ID NO: 48252 - DNA, 21 bp, Artificial sequence
  SiRNA target sequence
aattaacttcagtgatgaagt

SEQ ID NO: 48253 - DNA, 21 bp, Artificial sequence
  SiRNA target sequence
attaacttcagtgatgaagtt

SEQ ID NO: 48254 - DNA, 21 bp, Artificial sequence
  SiRNA target sequence
ttaacttcagtgatgaagtta

SEQ ID NO: 48255 - DNA, 21 bp, Artificial sequence
  SiRNA target sequence
taacttcagtgatgaagttag

SEQ ID NO: 48256 - DNA, 21 bp, Artificial sequence
  SiRNA target sequence
aacttcagtgatgaagttagt

SEQ ID NO: 48257 - DNA, 21 bp, Artificial sequence
  SiRNA target sequence
acttcagtgatgaagttagtg

SEQ ID NO: 48258 - DNA, 21 bp, Artificial sequence
  SiRNA target sequence
cttcagtgatgaagttagtgc

SEQ ID NO: 48259 - DNA, 21 bp, Artificial sequence
  SiRNA target sequence
ttcagtgatgaagttagtgca

SEQ ID NO: 48260 - DNA, 21 bp, Artificial sequence
  SiRNA target sequence
tcagtgatgaagttagtgcat

SEQ ID NO: 48261 - DNA, 21 bp, Artificial sequence
  SiRNA target sequence
cagtgatgaagttagtgcatg

SEQ ID NO: 48262 - DNA, 21 bp, Artificial sequence
  SiRNA target sequence
agtgatgaagttagtgcatgg

SEQ ID NO: 48263 - DNA, 21 bp, Artificial sequence
  SiRNA target sequence
gtgatgaagttagtgcatggt

SEQ ID NO: 48264 - DNA, 21 bp, Artificial sequence
  SiRNA target sequence
tgatgaagttagtgcatggta

SEQ ID NO: 48265 - DNA, 21 bp, Artificial sequence
  SiRNA target sequence
gatgaagttagtgcatggtat

SEQ ID NO: 48266 - DNA, 21 bp, Artificial sequence
  SiRNA target sequence
atgaagttagtgcatggtata

SEQ ID NO: 48267 - DNA, 21 bp, Artificial sequence
  SiRNA target sequence
tgaagttagtgcatggtataa

SEQ ID NO: 48268 - DNA, 21 bp, Artificial sequence
  SiRNA target sequence
gaagttagtgcatggtataac

SEQ ID NO: 48269 - DNA, 21 bp, Artificial sequence
  SiRNA target sequence
aagttagtgcatggtataaca

SEQ ID NO: 48270 - DNA, 21 bp, Artificial sequence
  SiRNA target sequence
agttagtgcatggtataacat

SEQ ID NO: 48271 - DNA, 21 bp, Artificial sequence
  SiRNA target sequence
gttagtgcatggtataacatg

SEQ ID NO: 48272 - DNA, 21 bp, Artificial sequence
  SiRNA target sequence
ttagtgcatggtataacatgt

SEQ ID NO: 48273 - DNA, 21 bp, Artificial sequence
  SiRNA target sequence
tagtgcatggtataacatgtc

SEQ ID NO: 48274 - DNA, 21 bp, Artificial sequence
  SiRNA target sequence
agtgcatggtataacatgtct

SEQ ID NO: 48275 - DNA, 21 bp, Artificial sequence
  SiRNA target sequence
gtgcatggtataacatgtcta

SEQ ID NO: 48276 - DNA, 21 bp, Artificial sequence
  SiRNA target sequence
tgcatggtataacatgtctac

SEQ ID NO: 48277 - DNA, 21 bp, Artificial sequence
  SiRNA target sequence
gcatggtataacatgtctact

SEQ ID NO: 48278 - DNA, 21 bp, Artificial sequence
  SiRNA target sequence
catggtataacatgtctacta

SEQ ID NO: 48279 - DNA, 21 bp, Artificial sequence
  SiRNA target sequence
atggtataacatgtctactat

SEQ ID NO: 48280 - DNA, 21 bp, Artificial sequence
  SiRNA target sequence
tggtataacatgtctactatt

SEQ ID NO: 48281 - DNA, 21 bp, Artificial sequence
  SiRNA target sequence
ggtataacatgtctactattg

SEQ ID NO: 48282 - DNA, 21 bp, Artificial sequence
  SiRNA target sequence
gtataacatgtctactattgc

SEQ ID NO: 48283 - DNA, 21 bp, Artificial sequence
  SiRNA target sequence
tataacatgtctactattgca

SEQ ID NO: 48284 - DNA, 21 bp, Artificial sequence
  SiRNA target sequence
ataacatgtctactattgcag

SEQ ID NO: 48285 - DNA, 21 bp, Artificial sequence
  SiRNA target sequence
taacatgtctactattgcaga

SEQ ID NO: 48286 - DNA, 21 bp, Artificial sequence
  SiRNA target sequence
aacatgtctactattgcagag

SEQ ID NO: 48287 - DNA, 21 bp, Artificial sequence
  SiRNA target sequence
acatgtctactattgcagagg

SEQ ID NO: 48288 - DNA, 21 bp, Artificial sequence
  SiRNA target sequence
catgtctactattgcagaggc

SEQ ID NO: 48289 - DNA, 21 bp, Artificial sequence
  SiRNA target sequence
atgtctactattgcagaggct

SEQ ID NO: 48290 - DNA, 21 bp, Artificial sequence
  SiRNA target sequence
tgtctactattgcagaggctt

SEQ ID NO: 48291 - DNA, 21 bp, Artificial sequence
  SiRNA target sequence
gtctactattgcagaggcttt

SEQ ID NO: 48292 - DNA, 21 bp, Artificial sequence
  SiRNA target sequence
tctactattgcagaggctttt

SEQ ID NO: 48293 - DNA, 21 bp, Artificial sequence
  SiRNA target sequence
ctactattgcagaggcttttt

SEQ ID NO: 48294 - DNA, 21 bp, Artificial sequence
  SiRNA target sequence
tactattgcagaggctttttc

SEQ ID NO: 48295 - DNA, 21 bp, Artificial sequence
  SiRNA target sequence
actattgcagaggctttttca

SEQ ID NO: 48296 - DNA, 21 bp, Artificial sequence
  SiRNA target sequence
ctattgcagaggctttttcaa

SEQ ID NO: 48297 - DNA, 21 bp, Artificial sequence
  SiRNA target sequence
tattgcagaggctttttcaac

SEQ ID NO: 48298 - DNA, 21 bp, Artificial sequence
  SiRNA target sequence
attgcagaggctttttcaaca

SEQ ID NO: 48299 - DNA, 21 bp, Artificial sequence
  SiRNA target sequence
ttgcagaggctttttcaacac

SEQ ID NO: 48300 - DNA, 21 bp, Artificial sequence
  SiRNA target sequence
tgcagaggctttttcaacact

SEQ ID NO: 48301 - DNA, 21 bp, Artificial sequence
  SiRNA target sequence
gcagaggctttttcaacactt

SEQ ID NO: 48302 - DNA, 21 bp, Artificial sequence
  SiRNA target sequence
cagaggctttttcaacacttg

SEQ ID NO: 48303 - DNA, 21 bp, Artificial sequence
  SiRNA target sequence
agaggctttttcaacacttgg

SEQ ID NO: 48304 - DNA, 21 bp, Artificial sequence
  SiRNA target sequence
gaggctttttcaacacttgga

SEQ ID NO: 48305 - DNA, 21 bp, Artificial sequence
  SiRNA target sequence
aggctttttcaacacttggat

SEQ ID NO: 48306 - DNA, 21 bp, Artificial sequence
  SiRNA target sequence
ggctttttcaacacttggatt

SEQ ID NO: 48307 - DNA, 21 bp, Artificial sequence
  SiRNA target sequence
gctttttcaacacttggattc

SEQ ID NO: 48308 - DNA, 21 bp, Artificial sequence
  SiRNA target sequence
ctttttcaacacttggattca

SEQ ID NO: 48309 - DNA, 21 bp, Artificial sequence
  SiRNA target sequence
tttttcaacacttggattcac

SEQ ID NO: 48310 - DNA, 21 bp, Artificial sequence
  SiRNA target sequence
ttttcaacacttggattcact

SEQ ID NO: 48311 - DNA, 21 bp, Artificial sequence
  SiRNA target sequence
tttcaacacttggattcactt

SEQ ID NO: 48312 - DNA, 21 bp, Artificial sequence
  SiRNA target sequence
ttcaacacttggattcactta

SEQ ID NO: 48313 - DNA, 21 bp, Artificial sequence
  SiRNA target sequence
tcaacacttggattcacttat

SEQ ID NO: 48314 - DNA, 21 bp, Artificial sequence
  SiRNA target sequence
caacacttggattcacttata

SEQ ID NO: 48315 - DNA, 21 bp, Artificial sequence
  SiRNA target sequence
aacacttggattcacttatac

SEQ ID NO: 48316 - DNA, 21 bp, Artificial sequence
  SiRNA target sequence
acacttggattcacttataca

SEQ ID NO: 48317 - DNA, 21 bp, Artificial sequence
  SiRNA target sequence
cacttggattcacttatacag

SEQ ID NO: 48318 - DNA, 21 bp, Artificial sequence
  SiRNA target sequence
acttggattcacttatacaga

SEQ ID NO: 48319 - DNA, 21 bp, Artificial sequence
  SiRNA target sequence
cttggattcacttatacagat

SEQ ID NO: 48320 - DNA, 21 bp, Artificial sequence
  SiRNA target sequence
ttggattcacttatacagatg

SEQ ID NO: 48321 - DNA, 21 bp, Artificial sequence
  SiRNA target sequence
tggattcacttatacagatga

SEQ ID NO: 48322 - DNA, 21 bp, Artificial sequence
  SiRNA target sequence
ggattcacttatacagatgag

SEQ ID NO: 48323 - DNA, 21 bp, Artificial sequence
  SiRNA target sequence
gattcacttatacagatgagc

SEQ ID NO: 48324 - DNA, 21 bp, Artificial sequence
  SiRNA target sequence
attcacttatacagatgagct

SEQ ID NO: 48325 - DNA, 21 bp, Artificial sequence
  SiRNA target sequence
ttcacttatacagatgagctc

SEQ ID NO: 48326 - DNA, 21 bp, Artificial sequence
  SiRNA target sequence
tcacttatacagatgagctca

SEQ ID NO: 48327 - DNA, 21 bp, Artificial sequence
  SiRNA target sequence
cacttatacagatgagctcaa

SEQ ID NO: 48328 - DNA, 21 bp, Artificial sequence
  SiRNA target sequence
acttatacagatgagctcaag

SEQ ID NO: 48329 - DNA, 21 bp, Artificial sequence
  SiRNA target sequence
cttatacagatgagctcaagg

SEQ ID NO: 48330 - DNA, 21 bp, Artificial sequence
  SiRNA target sequence
ttatacagatgagctcaaggg

SEQ ID NO: 48331 - DNA, 21 bp, Artificial sequence
  SiRNA target sequence
tatacagatgagctcaaggga

SEQ ID NO: 48332 - DNA, 21 bp, Artificial sequence
  SiRNA target sequence
atacagatgagctcaagggag

SEQ ID NO: 48333 - DNA, 21 bp, Artificial sequence
  SiRNA target sequence
tacagatgagctcaagggagt

SEQ ID NO: 48334 - DNA, 21 bp, Artificial sequence
  SiRNA target sequence
acagatgagctcaagggagtt

SEQ ID NO: 48335 - DNA, 21 bp, Artificial sequence
  SiRNA target sequence
cagatgagctcaagggagtta

SEQ ID NO: 48336 - DNA, 21 bp, Artificial sequence
  SiRNA target sequence
agatgagctcaagggagttag

SEQ ID NO: 48337 - DNA, 21 bp, Artificial sequence
  SiRNA target sequence
gatgagctcaagggagttaga

SEQ ID NO: 48338 - DNA, 21 bp, Artificial sequence
  SiRNA target sequence
atgagctcaagggagttagag

SEQ ID NO: 48339 - DNA, 21 bp, Artificial sequence
  SiRNA target sequence
tgagctcaagggagttagagg

SEQ ID NO: 48340 - DNA, 21 bp, Artificial sequence
  SiRNA target sequence
gagctcaagggagttagaggc

SEQ ID NO: 48341 - DNA, 21 bp, Artificial sequence
  SiRNA target sequence
agctcaagggagttagaggcg

SEQ ID NO: 48342 - DNA, 21 bp, Artificial sequence
  SiRNA target sequence
gctcaagggagttagaggcga

SEQ ID NO: 48343 - DNA, 21 bp, Artificial sequence
  SiRNA target sequence
ctcaagggagttagaggcgag

SEQ ID NO: 48344 - DNA, 21 bp, Artificial sequence
  SiRNA target sequence
tcaagggagttagaggcgagg

SEQ ID NO: 48345 - DNA, 21 bp, Artificial sequence
  SiRNA target sequence
caagggagttagaggcgaggt

SEQ ID NO: 48346 - DNA, 21 bp, Artificial sequence
  SiRNA target sequence
aagggagttagaggcgaggta

SEQ ID NO: 48347 - DNA, 21 bp, Artificial sequence
  SiRNA target sequence
agggagttagaggcgaggtac

SEQ ID NO: 48348 - DNA, 21 bp, Artificial sequence
  SiRNA target sequence
gggagttagaggcgaggtacc

SEQ ID NO: 48349 - DNA, 21 bp, Artificial sequence
  SiRNA target sequence
ggagttagaggcgaggtacca

SEQ ID NO: 48350 - DNA, 21 bp, Artificial sequence
  SiRNA target sequence
gagttagaggcgaggtaccaa

SEQ ID NO: 48351 - DNA, 21 bp, Artificial sequence
  SiRNA target sequence
agttagaggcgaggtaccaaa

SEQ ID NO: 48352 - DNA, 21 bp, Artificial sequence
  SiRNA target sequence
gttagaggcgaggtaccaaat

SEQ ID NO: 48353 - DNA, 21 bp, Artificial sequence
  SiRNA target sequence
ttagaggcgaggtaccaaatt

SEQ ID NO: 48354 - DNA, 21 bp, Artificial sequence
  SiRNA target sequence
tagaggcgaggtaccaaattg

SEQ ID NO: 48355 - DNA, 21 bp, Artificial sequence
  SiRNA target sequence
agaggcgaggtaccaaattgg

SEQ ID NO: 48356 - DNA, 21 bp, Artificial sequence
  SiRNA target sequence
gaggcgaggtaccaaattggc

SEQ ID NO: 48357 - DNA, 21 bp, Artificial sequence
  SiRNA target sequence
aggcgaggtaccaaattggcg

SEQ ID NO: 48358 - DNA, 21 bp, Artificial sequence
  SiRNA target sequence
ggcgaggtaccaaattggcga

SEQ ID NO: 48359 - DNA, 21 bp, Artificial sequence
  SiRNA target sequence
gcgaggtaccaaattggcgat

SEQ ID NO: 48360 - DNA, 21 bp, Artificial sequence
  SiRNA target sequence
cgaggtaccaaattggcgatc

SEQ ID NO: 48361 - DNA, 21 bp, Artificial sequence
  SiRNA target sequence
gaggtaccaaattggcgatca

SEQ ID NO: 48362 - DNA, 21 bp, Artificial sequence
  SiRNA target sequence
aggtaccaaattggcgatcaa

SEQ ID NO: 48363 - DNA, 21 bp, Artificial sequence
  SiRNA target sequence
ggtaccaaattggcgatcaat

SEQ ID NO: 48364 - DNA, 21 bp, Artificial sequence
  SiRNA target sequence
gtaccaaattggcgatcaata

SEQ ID NO: 48365 - DNA, 21 bp, Artificial sequence
  SiRNA target sequence
taccaaattggcgatcaatac

SEQ ID NO: 48366 - DNA, 21 bp, Artificial sequence
  SiRNA target sequence
accaaattggcgatcaataca

SEQ ID NO: 48367 - DNA, 21 bp, Artificial sequence
  SiRNA target sequence
ccaaattggcgatcaatacag

SEQ ID NO: 48368 - DNA, 21 bp, Artificial sequence
  SiRNA target sequence
caaattggcgatcaatacagg

SEQ ID NO: 48369 - DNA, 21 bp, Artificial sequence
  SiRNA target sequence
aaattggcgatcaatacagga

SEQ ID NO: 48370 - DNA, 21 bp, Artificial sequence
  SiRNA target sequence
aattggcgatcaatacaggac

SEQ ID NO: 48371 - DNA, 21 bp, Artificial sequence
  SiRNA target sequence
attggcgatcaatacaggacg

SEQ ID NO: 48372 - DNA, 21 bp, Artificial sequence
  SiRNA target sequence
ttggcgatcaatacaggacgt

SEQ ID NO: 48373 - DNA, 21 bp, Artificial sequence
  SiRNA target sequence
tggcgatcaatacaggacgtg

SEQ ID NO: 48374 - DNA, 21 bp, Artificial sequence
  SiRNA target sequence
ggcgatcaatacaggacgtgc

SEQ ID NO: 48375 - DNA, 21 bp, Artificial sequence
  SiRNA target sequence
gcgatcaatacaggacgtgca

SEQ ID NO: 48376 - DNA, 21 bp, Artificial sequence
  SiRNA target sequence
cgatcaatacaggacgtgcaa

SEQ ID NO: 48377 - DNA, 21 bp, Artificial sequence
  SiRNA target sequence
gatcaatacaggacgtgcaat

SEQ ID NO: 48378 - DNA, 21 bp, Artificial sequence
  SiRNA target sequence
atcaatacaggacgtgcaata

SEQ ID NO: 48379 - DNA, 21 bp, Artificial sequence
  SiRNA target sequence
tcaatacaggacgtgcaatat

SEQ ID NO: 48380 - DNA, 21 bp, Artificial sequence
  SiRNA target sequence
caatacaggacgtgcaatatc

SEQ ID NO: 48381 - DNA, 21 bp, Artificial sequence
  SiRNA target sequence
aatacaggacgtgcaatatct

SEQ ID NO: 48382 - DNA, 21 bp, Artificial sequence
  SiRNA target sequence
atacaggacgtgcaatatctt

SEQ ID NO: 48383 - DNA, 21 bp, Artificial sequence
  SiRNA target sequence
tacaggacgtgcaatatctta

SEQ ID NO: 48384 - DNA, 21 bp, Artificial sequence
  SiRNA target sequence
acaggacgtgcaatatcttaa

SEQ ID NO: 48385 - DNA, 21 bp, Artificial sequence
  SiRNA target sequence
caggacgtgcaatatcttaaa

SEQ ID NO: 48386 - DNA, 21 bp, Artificial sequence
  SiRNA target sequence
aggacgtgcaatatcttaaac

SEQ ID NO: 48387 - DNA, 21 bp, Artificial sequence
  SiRNA target sequence
ggacgtgcaatatcttaaacg

SEQ ID NO: 48388 - DNA, 21 bp, Artificial sequence
  SiRNA target sequence
gacgtgcaatatcttaaacgt

SEQ ID NO: 48389 - DNA, 21 bp, Artificial sequence
  SiRNA target sequence
acgtgcaatatcttaaacgta

SEQ ID NO: 48390 - DNA, 21 bp, Artificial sequence
  SiRNA target sequence
cgtgcaatatcttaaacgtaa

SEQ ID NO: 48391 - DNA, 21 bp, Artificial sequence
  SiRNA target sequence
gtgcaatatcttaaacgtaag

SEQ ID NO: 48392 - DNA, 21 bp, Artificial sequence
  SiRNA target sequence
tgcaatatcttaaacgtaagt

SEQ ID NO: 48393 - DNA, 21 bp, Artificial sequence
  SiRNA target sequence
gcaatatcttaaacgtaagtt

SEQ ID NO: 48394 - DNA, 21 bp, Artificial sequence
  SiRNA target sequence
caatatcttaaacgtaagttt

SEQ ID NO: 48395 - DNA, 21 bp, Artificial sequence
  SiRNA target sequence
aatatcttaaacgtaagttta

SEQ ID NO: 48396 - DNA, 21 bp, Artificial sequence
  SiRNA target sequence
atatcttaaacgtaagtttag

SEQ ID NO: 48397 - DNA, 21 bp, Artificial sequence
  SiRNA target sequence
tatcttaaacgtaagtttaga

SEQ ID NO: 48398 - DNA, 21 bp, Artificial sequence
  SiRNA target sequence
atcttaaacgtaagtttagat

SEQ ID NO: 48399 - DNA, 21 bp, Artificial sequence
  SiRNA target sequence
tcttaaacgtaagtttagata

SEQ ID NO: 48400 - DNA, 21 bp, Artificial sequence
  SiRNA target sequence
cttaaacgtaagtttagatat

SEQ ID NO: 48401 - DNA, 21 bp, Artificial sequence
  SiRNA target sequence
ttaaacgtaagtttagatatg

SEQ ID NO: 48402 - DNA, 21 bp, Artificial sequence
  SiRNA target sequence
taaacgtaagtttagatatga

SEQ ID NO: 48403 - DNA, 21 bp, Artificial sequence
  SiRNA target sequence
aaacgtaagtttagatatgac

SEQ ID NO: 48404 - DNA, 21 bp, Artificial sequence
  SiRNA target sequence
aacgtaagtttagatatgaca

SEQ ID NO: 48405 - DNA, 21 bp, Artificial sequence
  SiRNA target sequence
acgtaagtttagatatgacaa

SEQ ID NO: 48406 - DNA, 21 bp, Artificial sequence
  SiRNA target sequence
cgtaagtttagatatgacaat

SEQ ID NO: 48407 - DNA, 21 bp, Artificial sequence
  SiRNA target sequence
gtaagtttagatatgacaatc

SEQ ID NO: 48408 - DNA, 21 bp, Artificial sequence
  SiRNA target sequence
taagtttagatatgacaatca

SEQ ID NO: 48409 - DNA, 21 bp, Artificial sequence
  SiRNA target sequence
aagtttagatatgacaatcaa

SEQ ID NO: 48410 - DNA, 21 bp, Artificial sequence
  SiRNA target sequence
agtttagatatgacaatcaac

SEQ ID NO: 48411 - DNA, 21 bp, Artificial sequence
  SiRNA target sequence
gtttagatatgacaatcaacg

SEQ ID NO: 48412 - DNA, 21 bp, Artificial sequence
  SiRNA target sequence
tttagatatgacaatcaacgg

SEQ ID NO: 48413 - DNA, 21 bp, Artificial sequence
  SiRNA target sequence
ttagatatgacaatcaacgga

SEQ ID NO: 48414 - DNA, 21 bp, Artificial sequence
  SiRNA target sequence
tagatatgacaatcaacggaa

SEQ ID NO: 48415 - DNA, 21 bp, Artificial sequence
  SiRNA target sequence
agatatgacaatcaacggaaa

SEQ ID NO: 48416 - DNA, 21 bp, Artificial sequence
  SiRNA target sequence
gatatgacaatcaacggaaag

SEQ ID NO: 48417 - DNA, 21 bp, Artificial sequence
  SiRNA target sequence
atatgacaatcaacggaaagt

SEQ ID NO: 48418 - DNA, 21 bp, Artificial sequence
  SiRNA target sequence
tatgacaatcaacggaaagtt

SEQ ID NO: 48419 - DNA, 21 bp, Artificial sequence
  SiRNA target sequence
atgacaatcaacggaaagttt

SEQ ID NO: 48420 - DNA, 21 bp, Artificial sequence
  SiRNA target sequence
tgacaatcaacggaaagtttg

SEQ ID NO: 48421 - DNA, 21 bp, Artificial sequence
  SiRNA target sequence
gacaatcaacggaaagtttgg

SEQ ID NO: 48422 - DNA, 21 bp, Artificial sequence
  SiRNA target sequence
acaatcaacggaaagtttggg

SEQ ID NO: 48423 - DNA, 21 bp, Artificial sequence
  SiRNA target sequence
caatcaacggaaagtttggga

SEQ ID NO: 48424 - DNA, 21 bp, Artificial sequence
  SiRNA target sequence
aatcaacggaaagtttgggaa

SEQ ID NO: 48425 - DNA, 21 bp, Artificial sequence
  SiRNA target sequence
atcaacggaaagtttgggaag

SEQ ID NO: 48426 - DNA, 21 bp, Artificial sequence
  SiRNA target sequence
tcaacggaaagtttgggaagc

SEQ ID NO: 48427 - DNA, 21 bp, Artificial sequence
  SiRNA target sequence
caacggaaagtttgggaagct

SEQ ID NO: 48428 - DNA, 21 bp, Artificial sequence
  SiRNA target sequence
aacggaaagtttgggaagctc

SEQ ID NO: 48429 - DNA, 21 bp, Artificial sequence
  SiRNA target sequence
acggaaagtttgggaagctcc

SEQ ID NO: 48430 - DNA, 21 bp, Artificial sequence
  SiRNA target sequence
cggaaagtttgggaagctcca

SEQ ID NO: 48431 - DNA, 21 bp, Artificial sequence
  SiRNA target sequence
ggaaagtttgggaagctccat

SEQ ID NO: 48432 - DNA, 21 bp, Artificial sequence
  SiRNA target sequence
gaaagtttgggaagctccatt

SEQ ID NO: 48433 - DNA, 21 bp, Artificial sequence
  SiRNA target sequence
aaagtttgggaagctccattg

SEQ ID NO: 48434 - DNA, 21 bp, Artificial sequence
  SiRNA target sequence
aagtttgggaagctccattgt

SEQ ID NO: 48435 - DNA, 21 bp, Artificial sequence
  SiRNA target sequence
agtttgggaagctccattgtg

SEQ ID NO: 48436 - DNA, 21 bp, Artificial sequence
  SiRNA target sequence
gtttgggaagctccattgtgt

SEQ ID NO: 48437 - DNA, 21 bp, Artificial sequence
  SiRNA target sequence
tttgggaagctccattgtgta

SEQ ID NO: 48438 - DNA, 21 bp, Artificial sequence
  SiRNA target sequence
ttgggaagctccattgtgtat

SEQ ID NO: 48439 - DNA, 21 bp, Artificial sequence
  SiRNA target sequence
tgggaagctccattgtgtatg

SEQ ID NO: 48440 - DNA, 21 bp, Artificial sequence
  SiRNA target sequence
gggaagctccattgtgtatgg

SEQ ID NO: 48441 - DNA, 21 bp, Artificial sequence
  SiRNA target sequence
ggaagctccattgtgtatgga

SEQ ID NO: 48442 - DNA, 21 bp, Artificial sequence
  SiRNA target sequence
gaagctccattgtgtatggac

SEQ ID NO: 48443 - DNA, 21 bp, Artificial sequence
  SiRNA target sequence
aagctccattgtgtatggaca

SEQ ID NO: 48444 - DNA, 21 bp, Artificial sequence
  SiRNA target sequence
agctccattgtgtatggacac

SEQ ID NO: 48445 - DNA, 21 bp, Artificial sequence
  SiRNA target sequence
gctccattgtgtatggacacg

SEQ ID NO: 48446 - DNA, 21 bp, Artificial sequence
  SiRNA target sequence
ctccattgtgtatggacacga

SEQ ID NO: 48447 - DNA, 21 bp, Artificial sequence
  SiRNA target sequence
tccattgtgtatggacacgat

SEQ ID NO: 48448 - DNA, 21 bp, Artificial sequence
  SiRNA target sequence
ccattgtgtatggacacgatt

SEQ ID NO: 48449 - DNA, 21 bp, Artificial sequence
  SiRNA target sequence
cattgtgtatggacacgattc

SEQ ID NO: 48450 - DNA, 21 bp, Artificial sequence
  SiRNA target sequence
attgtgtatggacacgattct

SEQ ID NO: 48451 - DNA, 21 bp, Artificial sequence
  SiRNA target sequence
ttgtgtatggacacgattctt

SEQ ID NO: 48452 - DNA, 21 bp, Artificial sequence
  SiRNA target sequence
tgtgtatggacacgattcttg

SEQ ID NO: 48453 - DNA, 21 bp, Artificial sequence
  SiRNA target sequence
gtgtatggacacgattcttga

SEQ ID NO: 48454 - DNA, 21 bp, Artificial sequence
  SiRNA target sequence
tgtatggacacgattcttgaa

SEQ ID NO: 48455 - DNA, 21 bp, Artificial sequence
  SiRNA target sequence
gtatggacacgattcttgaaa

SEQ ID NO: 48456 - DNA, 21 bp, Artificial sequence
  SiRNA target sequence
tatggacacgattcttgaaat

SEQ ID NO: 48457 - DNA, 21 bp, Artificial sequence
  SiRNA target sequence
atggacacgattcttgaaatg

SEQ ID NO: 48458 - DNA, 21 bp, Artificial sequence
  SiRNA target sequence
tggacacgattcttgaaatgc

SEQ ID NO: 48459 - DNA, 21 bp, Artificial sequence
  SiRNA target sequence
ggacacgattcttgaaatgcc

SEQ ID NO: 48460 - DNA, 21 bp, Artificial sequence
  SiRNA target sequence
gacacgattcttgaaatgcct

SEQ ID NO: 48461 - DNA, 21 bp, Artificial sequence
  SiRNA target sequence
acacgattcttgaaatgccta

SEQ ID NO: 48462 - DNA, 21 bp, Artificial sequence
  SiRNA target sequence
cacgattcttgaaatgcctaa

SEQ ID NO: 48463 - DNA, 21 bp, Artificial sequence
  SiRNA target sequence
acgattcttgaaatgcctaat

SEQ ID NO: 48464 - DNA, 21 bp, Artificial sequence
  SiRNA target sequence
cgattcttgaaatgcctaatt

SEQ ID NO: 48465 - DNA, 21 bp, Artificial sequence
  SiRNA target sequence
gattcttgaaatgcctaattg

SEQ ID NO: 48466 - DNA, 21 bp, Artificial sequence
  SiRNA target sequence
attcttgaaatgcctaattgg

SEQ ID NO: 48467 - DNA, 21 bp, Artificial sequence
  SiRNA target sequence
ttcttgaaatgcctaattggt

SEQ ID NO: 48468 - DNA, 21 bp, Artificial sequence
  SiRNA target sequence
tcttgaaatgcctaattggtg

SEQ ID NO: 48469 - DNA, 21 bp, Artificial sequence
  SiRNA target sequence
cttgaaatgcctaattggtgt

SEQ ID NO: 48470 - DNA, 21 bp, Artificial sequence
  SiRNA target sequence
ttgaaatgcctaattggtgtc

SEQ ID NO: 48471 - DNA, 21 bp, Artificial sequence
  SiRNA target sequence
tgaaatgcctaattggtgtcg

SEQ ID NO: 48472 - DNA, 21 bp, Artificial sequence
  SiRNA target sequence
gaaatgcctaattggtgtcga

SEQ ID NO: 48473 - DNA, 21 bp, Artificial sequence
  SiRNA target sequence
aaatgcctaattggtgtcgag

SEQ ID NO: 48474 - DNA, 21 bp, Artificial sequence
  SiRNA target sequence
aatgcctaattggtgtcgagg

SEQ ID NO: 48475 - DNA, 21 bp, Artificial sequence
  SiRNA target sequence
atgcctaattggtgtcgagga

SEQ ID NO: 48476 - DNA, 21 bp, Artificial sequence
  SiRNA target sequence
tgcctaattggtgtcgaggag

SEQ ID NO: 48477 - DNA, 21 bp, Artificial sequence
  SiRNA target sequence
gcctaattggtgtcgaggagg

SEQ ID NO: 48478 - DNA, 21 bp, Artificial sequence
  SiRNA target sequence
cctaattggtgtcgaggagga

SEQ ID NO: 48479 - DNA, 21 bp, Artificial sequence
  SiRNA target sequence
ctaattggtgtcgaggaggac

SEQ ID NO: 48480 - DNA, 21 bp, Artificial sequence
  SiRNA target sequence
taattggtgtcgaggaggact

SEQ ID NO: 48481 - DNA, 21 bp, Artificial sequence
  SiRNA target sequence
aattggtgtcgaggaggactc

SEQ ID NO: 48482 - DNA, 21 bp, Artificial sequence
  SiRNA target sequence
attggtgtcgaggaggactcg

SEQ ID NO: 48483 - DNA, 21 bp, Artificial sequence
  SiRNA target sequence
ttggtgtcgaggaggactcga

SEQ ID NO: 48484 - DNA, 21 bp, Artificial sequence
  SiRNA target sequence
tggtgtcgaggaggactcgat

SEQ ID NO: 48485 - DNA, 21 bp, Artificial sequence
  SiRNA target sequence
ggtgtcgaggaggactcgata

SEQ ID NO: 48486 - DNA, 21 bp, Artificial sequence
  SiRNA target sequence
gtgtcgaggaggactcgatat

SEQ ID NO: 48487 - DNA, 21 bp, Artificial sequence
  SiRNA target sequence
tgtcgaggaggactcgatatt

SEQ ID NO: 48488 - DNA, 21 bp, Artificial sequence
  SiRNA target sequence
gtcgaggaggactcgatattc

SEQ ID NO: 48489 - DNA, 21 bp, Artificial sequence
  SiRNA target sequence
tcgaggaggactcgatattca

SEQ ID NO: 48490 - DNA, 21 bp, Artificial sequence
  SiRNA target sequence
cgaggaggactcgatattcaa

SEQ ID NO: 48491 - DNA, 21 bp, Artificial sequence
  SiRNA target sequence
gaggaggactcgatattcaag

SEQ ID NO: 48492 - DNA, 21 bp, Artificial sequence
  SiRNA target sequence
aggaggactcgatattcaaga

SEQ ID NO: 48493 - DNA, 21 bp, Artificial sequence
  SiRNA target sequence
ggaggactcgatattcaagaa

SEQ ID NO: 48494 - DNA, 21 bp, Artificial sequence
  SiRNA target sequence
gaggactcgatattcaagaag

SEQ ID NO: 48495 - DNA, 21 bp, Artificial sequence
  SiRNA target sequence
aggactcgatattcaagaagg

SEQ ID NO: 48496 - DNA, 21 bp, Artificial sequence
  SiRNA target sequence
ggactcgatattcaagaaggt

SEQ ID NO: 48497 - DNA, 21 bp, Artificial sequence
  SiRNA target sequence
gactcgatattcaagaaggta

SEQ ID NO: 48498 - DNA, 21 bp, Artificial sequence
  SiRNA target sequence
actcgatattcaagaaggtac

SEQ ID NO: 48499 - DNA, 21 bp, Artificial sequence
  SiRNA target sequence
ctcgatattcaagaaggtaca

SEQ ID NO: 48500 - DNA, 21 bp, Artificial sequence
  SiRNA target sequence
tcgatattcaagaaggtacaa

SEQ ID NO: 48501 - DNA, 21 bp, Artificial sequence
  SiRNA target sequence
cgatattcaagaaggtacaaa

SEQ ID NO: 48502 - DNA, 21 bp, Artificial sequence
  SiRNA target sequence
gatattcaagaaggtacaaaa

SEQ ID NO: 48503 - DNA, 21 bp, Artificial sequence
  SiRNA target sequence
atattcaagaaggtacaaaat

SEQ ID NO: 48504 - DNA, 21 bp, Artificial sequence
  SiRNA target sequence
tattcaagaaggtacaaaatt

SEQ ID NO: 48505 - DNA, 21 bp, Artificial sequence
  SiRNA target sequence
attcaagaaggtacaaaattg

SEQ ID NO: 48506 - DNA, 21 bp, Artificial sequence
  SiRNA target sequence
ttcaagaaggtacaaaattga

SEQ ID NO: 48507 - DNA, 21 bp, Artificial sequence
  SiRNA target sequence
tcaagaaggtacaaaattgaa

SEQ ID NO: 48508 - DNA, 21 bp, Artificial sequence
  SiRNA target sequence
caagaaggtacaaaattgaac

SEQ ID NO: 48509 - DNA, 21 bp, Artificial sequence
  SiRNA target sequence
aagaaggtacaaaattgaact

SEQ ID NO: 48510 - DNA, 21 bp, Artificial sequence
  SiRNA target sequence
agaaggtacaaaattgaactg

SEQ ID NO: 48511 - DNA, 21 bp, Artificial sequence
  SiRNA target sequence
gaaggtacaaaattgaactgt

SEQ ID NO: 48512 - DNA, 21 bp, Artificial sequence
  SiRNA target sequence
aaggtacaaaattgaactgtg

SEQ ID NO: 48513 - DNA, 21 bp, Artificial sequence
  SiRNA target sequence
aggtacaaaattgaactgtga

SEQ ID NO: 48514 - DNA, 21 bp, Artificial sequence
  SiRNA target sequence
ggtacaaaattgaactgtgaa

SEQ ID NO: 48515 - DNA, 21 bp, Artificial sequence
  SiRNA target sequence
gtacaaaattgaactgtgaaa

SEQ ID NO: 48516 - DNA, 21 bp, Artificial sequence
  SiRNA target sequence
tacaaaattgaactgtgaaaa

SEQ ID NO: 48517 - DNA, 21 bp, Artificial sequence
  SiRNA target sequence
acaaaattgaactgtgaaaat

SEQ ID NO: 48518 - DNA, 21 bp, Artificial sequence
  SiRNA target sequence
caaaattgaactgtgaaaatg

SEQ ID NO: 48519 - DNA, 21 bp, Artificial sequence
  SiRNA target sequence
aaaattgaactgtgaaaatgc

SEQ ID NO: 48520 - DNA, 21 bp, Artificial sequence
  SiRNA target sequence
aaattgaactgtgaaaatgca

SEQ ID NO: 48521 - DNA, 21 bp, Artificial sequence
  SiRNA target sequence
aattgaactgtgaaaatgcaa

SEQ ID NO: 48522 - DNA, 21 bp, Artificial sequence
  SiRNA target sequence
attgaactgtgaaaatgcaat

SEQ ID NO: 48523 - DNA, 21 bp, Artificial sequence
  SiRNA target sequence
ttgaactgtgaaaatgcaata

SEQ ID NO: 48524 - DNA, 21 bp, Artificial sequence
  SiRNA target sequence
tgaactgtgaaaatgcaataa

SEQ ID NO: 48525 - DNA, 21 bp, Artificial sequence
  SiRNA target sequence
gaactgtgaaaatgcaataat

SEQ ID NO: 48526 - DNA, 21 bp, Artificial sequence
  SiRNA target sequence
aactgtgaaaatgcaataatg

SEQ ID NO: 48527 - DNA, 21 bp, Artificial sequence
  SiRNA target sequence
actgtgaaaatgcaataatgg

SEQ ID NO: 48528 - DNA, 21 bp, Artificial sequence
  SiRNA target sequence
ctgtgaaaatgcaataatgga

SEQ ID NO: 48529 - DNA, 21 bp, Artificial sequence
  SiRNA target sequence
tgtgaaaatgcaataatggaa

SEQ ID NO: 48530 - DNA, 21 bp, Artificial sequence
  SiRNA target sequence
gtgaaaatgcaataatggaac

SEQ ID NO: 48531 - DNA, 21 bp, Artificial sequence
  SiRNA target sequence
tgaaaatgcaataatggaact

SEQ ID NO: 48532 - DNA, 21 bp, Artificial sequence
  SiRNA target sequence
gaaaatgcaataatggaactt

SEQ ID NO: 48533 - DNA, 21 bp, Artificial sequence
  SiRNA target sequence
aaaatgcaataatggaacttt

SEQ ID NO: 48534 - DNA, 21 bp, Artificial sequence
  SiRNA target sequence
aaatgcaataatggaactttc

SEQ ID NO: 48535 - DNA, 21 bp, Artificial sequence
  SiRNA target sequence
aatgcaataatggaactttct

SEQ ID NO: 48536 - DNA, 21 bp, Artificial sequence
  SiRNA target sequence
atgcaataatggaactttcta

SEQ ID NO: 48537 - DNA, 21 bp, Artificial sequence
  SiRNA target sequence
tgcaataatggaactttctat

SEQ ID NO: 48538 - DNA, 21 bp, Artificial sequence
  SiRNA target sequence
gcaataatggaactttctatg

SEQ ID NO: 48539 - DNA, 21 bp, Artificial sequence
  SiRNA target sequence
caataatggaactttctatgc

SEQ ID NO: 48540 - DNA, 21 bp, Artificial sequence
  SiRNA target sequence
aataatggaactttctatgca

SEQ ID NO: 48541 - DNA, 21 bp, Artificial sequence
  SiRNA target sequence
ataatggaactttctatgcat

SEQ ID NO: 48542 - DNA, 21 bp, Artificial sequence
  SiRNA target sequence
taatggaactttctatgcatg

SEQ ID NO: 48543 - DNA, 21 bp, Artificial sequence
  SiRNA target sequence
aatggaactttctatgcatga

SEQ ID NO: 48544 - DNA, 21 bp, Artificial sequence
  SiRNA target sequence
atggaactttctatgcatgaa

SEQ ID NO: 48545 - DNA, 21 bp, Artificial sequence
  SiRNA target sequence
tggaactttctatgcatgaag

SEQ ID NO: 48546 - DNA, 21 bp, Artificial sequence
  SiRNA target sequence
ggaactttctatgcatgaaga

SEQ ID NO: 48547 - DNA, 21 bp, Artificial sequence
  SiRNA target sequence
gaactttctatgcatgaagag

SEQ ID NO: 48548 - DNA, 21 bp, Artificial sequence
  SiRNA target sequence
aactttctatgcatgaagagg

SEQ ID NO: 48549 - DNA, 21 bp, Artificial sequence
  SiRNA target sequence
actttctatgcatgaagagga

SEQ ID NO: 48550 - DNA, 21 bp, Artificial sequence
  SiRNA target sequence
ctttctatgcatgaagaggaa

SEQ ID NO: 48551 - DNA, 21 bp, Artificial sequence
  SiRNA target sequence
tttctatgcatgaagaggaag

SEQ ID NO: 48552 - DNA, 21 bp, Artificial sequence
  SiRNA target sequence
ttctatgcatgaagaggaagt

SEQ ID NO: 48553 - DNA, 21 bp, Artificial sequence
  SiRNA target sequence
tctatgcatgaagaggaagtc

SEQ ID NO: 48554 - DNA, 21 bp, Artificial sequence
  SiRNA target sequence
ctatgcatgaagaggaagtct

SEQ ID NO: 48555 - DNA, 21 bp, Artificial sequence
  SiRNA target sequence
tatgcatgaagaggaagtctt

SEQ ID NO: 48556 - DNA, 21 bp, Artificial sequence
  SiRNA target sequence
atgcatgaagaggaagtcttt

SEQ ID NO: 48557 - DNA, 21 bp, Artificial sequence
  SiRNA target sequence
tgcatgaagaggaagtctttg

SEQ ID NO: 48558 - DNA, 21 bp, Artificial sequence
  SiRNA target sequence
gcatgaagaggaagtctttga

SEQ ID NO: 48559 - DNA, 21 bp, Artificial sequence
  SiRNA target sequence
catgaagaggaagtctttgat

SEQ ID NO: 48560 - DNA, 21 bp, Artificial sequence
  SiRNA target sequence
atgaagaggaagtctttgata

SEQ ID NO: 48561 - DNA, 21 bp, Artificial sequence
  SiRNA target sequence
tgaagaggaagtctttgataa

SEQ ID NO: 48562 - DNA, 21 bp, Artificial sequence
  SiRNA target sequence
gaagaggaagtctttgataag

SEQ ID NO: 48563 - DNA, 21 bp, Artificial sequence
  SiRNA target sequence
aagaggaagtctttgataagt

SEQ ID NO: 48564 - DNA, 21 bp, Artificial sequence
  SiRNA target sequence
agaggaagtctttgataagtg

SEQ ID NO: 48565 - DNA, 21 bp, Artificial sequence
  SiRNA target sequence
gaggaagtctttgataagtgg

SEQ ID NO: 48566 - DNA, 21 bp, Artificial sequence
  SiRNA target sequence
aggaagtctttgataagtggt

SEQ ID NO: 48567 - DNA, 21 bp, Artificial sequence
  SiRNA target sequence
ggaagtctttgataagtggtc

SEQ ID NO: 48568 - DNA, 21 bp, Artificial sequence
  SiRNA target sequence
gaagtctttgataagtggtca

SEQ ID NO: 48569 - DNA, 21 bp, Artificial sequence
  SiRNA target sequence
aagtctttgataagtggtcaa

SEQ ID NO: 48570 - DNA, 21 bp, Artificial sequence
  SiRNA target sequence
agtctttgataagtggtcaaa

SEQ ID NO: 48571 - DNA, 21 bp, Artificial sequence
  SiRNA target sequence
gtctttgataagtggtcaaaa

SEQ ID NO: 48572 - DNA, 21 bp, Artificial sequence
  SiRNA target sequence
tctttgataagtggtcaaaag

SEQ ID NO: 48573 - DNA, 21 bp, Artificial sequence
  SiRNA target sequence
ctttgataagtggtcaaaagt

SEQ ID NO: 48574 - DNA, 21 bp, Artificial sequence
  SiRNA target sequence
tttgataagtggtcaaaagta

SEQ ID NO: 48575 - DNA, 21 bp, Artificial sequence
  SiRNA target sequence
ttgataagtggtcaaaagtaa

SEQ ID NO: 48576 - DNA, 21 bp, Artificial sequence
  SiRNA target sequence
tgataagtggtcaaaagtaat

SEQ ID NO: 48577 - DNA, 21 bp, Artificial sequence
  SiRNA target sequence
gataagtggtcaaaagtaatt

SEQ ID NO: 48578 - DNA, 21 bp, Artificial sequence
  SiRNA target sequence
ataagtggtcaaaagtaattg

SEQ ID NO: 48579 - DNA, 21 bp, Artificial sequence
  SiRNA target sequence
taagtggtcaaaagtaattga

SEQ ID NO: 48580 - DNA, 21 bp, Artificial sequence
  SiRNA target sequence
aagtggtcaaaagtaattgac

SEQ ID NO: 48581 - DNA, 21 bp, Artificial sequence
  SiRNA target sequence
agtggtcaaaagtaattgaca

SEQ ID NO: 48582 - DNA, 21 bp, Artificial sequence
  SiRNA target sequence
gtggtcaaaagtaattgacaa

SEQ ID NO: 48583 - DNA, 21 bp, Artificial sequence
  SiRNA target sequence
tggtcaaaagtaattgacaaa

SEQ ID NO: 48584 - DNA, 21 bp, Artificial sequence
  SiRNA target sequence
ggtcaaaagtaattgacaaag

SEQ ID NO: 48585 - DNA, 21 bp, Artificial sequence
  SiRNA target sequence
gtcaaaagtaattgacaaagc

SEQ ID NO: 48586 - DNA, 21 bp, Artificial sequence
  SiRNA target sequence
tcaaaagtaattgacaaagct

SEQ ID NO: 48587 - DNA, 21 bp, Artificial sequence
  SiRNA target sequence
caaaagtaattgacaaagctt

SEQ ID NO: 48588 - DNA, 21 bp, Artificial sequence
  SiRNA target sequence
aaaagtaattgacaaagctta

SEQ ID NO: 48589 - DNA, 21 bp, Artificial sequence
  SiRNA target sequence
aaagtaattgacaaagcttat

SEQ ID NO: 48590 - DNA, 21 bp, Artificial sequence
  SiRNA target sequence
aagtaattgacaaagcttatg

SEQ ID NO: 48591 - DNA, 21 bp, Artificial sequence
  SiRNA target sequence
agtaattgacaaagcttatgc

SEQ ID NO: 48592 - DNA, 21 bp, Artificial sequence
  SiRNA target sequence
gtaattgacaaagcttatgca

SEQ ID NO: 48593 - DNA, 21 bp, Artificial sequence
  SiRNA target sequence
taattgacaaagcttatgcaa

SEQ ID NO: 48594 - DNA, 21 bp, Artificial sequence
  SiRNA target sequence
aattgacaaagcttatgcaaa

SEQ ID NO: 48595 - DNA, 21 bp, Artificial sequence
  SiRNA target sequence
attgacaaagcttatgcaaag

SEQ ID NO: 48596 - DNA, 21 bp, Artificial sequence
  SiRNA target sequence
ttgacaaagcttatgcaaagg

SEQ ID NO: 48597 - DNA, 21 bp, Artificial sequence
  SiRNA target sequence
tgacaaagcttatgcaaaggc

SEQ ID NO: 48598 - DNA, 21 bp, Artificial sequence
  SiRNA target sequence
gacaaagcttatgcaaaggct

SEQ ID NO: 48599 - DNA, 21 bp, Artificial sequence
  SiRNA target sequence
acaaagcttatgcaaaggcta

SEQ ID NO: 48600 - DNA, 21 bp, Artificial sequence
  SiRNA target sequence
caaagcttatgcaaaggctac

SEQ ID NO: 48601 - DNA, 21 bp, Artificial sequence
  SiRNA target sequence
aaagcttatgcaaaggctaca

SEQ ID NO: 48602 - DNA, 21 bp, Artificial sequence
  SiRNA target sequence
aagcttatgcaaaggctacag

SEQ ID NO: 48603 - DNA, 21 bp, Artificial sequence
  SiRNA target sequence
agcttatgcaaaggctacagg

SEQ ID NO: 48604 - DNA, 21 bp, Artificial sequence
  SiRNA target sequence
gcttatgcaaaggctacagga

SEQ ID NO: 48605 - DNA, 21 bp, Artificial sequence
  SiRNA target sequence
cttatgcaaaggctacaggag

SEQ ID NO: 48606 - DNA, 21 bp, Artificial sequence
  SiRNA target sequence
ttatgcaaaggctacaggaga

SEQ ID NO: 48607 - DNA, 21 bp, Artificial sequence
  SiRNA target sequence
tatgcaaaggctacaggagat

SEQ ID NO: 48608 - DNA, 21 bp, Artificial sequence
  SiRNA target sequence
atgcaaaggctacaggagatc

SEQ ID NO: 48609 - DNA, 21 bp, Artificial sequence
  SiRNA target sequence
tgcaaaggctacaggagatca

SEQ ID NO: 48610 - DNA, 21 bp, Artificial sequence
  SiRNA target sequence
gcaaaggctacaggagatcac

SEQ ID NO: 48611 - DNA, 21 bp, Artificial sequence
  SiRNA target sequence
caaaggctacaggagatcacc

SEQ ID NO: 48612 - DNA, 21 bp, Artificial sequence
  SiRNA target sequence
aaaggctacaggagatcacct

SEQ ID NO: 48613 - DNA, 21 bp, Artificial sequence
  SiRNA target sequence
aaggctacaggagatcacctg

SEQ ID NO: 48614 - DNA, 21 bp, Artificial sequence
  SiRNA target sequence
aggctacaggagatcacctgg

SEQ ID NO: 48615 - DNA, 21 bp, Artificial sequence
  SiRNA target sequence
ggctacaggagatcacctgga

SEQ ID NO: 48616 - DNA, 21 bp, Artificial sequence
  SiRNA target sequence
gctacaggagatcacctggac

SEQ ID NO: 48617 - DNA, 21 bp, Artificial sequence
  SiRNA target sequence
ctacaggagatcacctggaca

SEQ ID NO: 48618 - DNA, 21 bp, Artificial sequence
  SiRNA target sequence
tacaggagatcacctggacat

SEQ ID NO: 48619 - DNA, 21 bp, Artificial sequence
  SiRNA target sequence
acaggagatcacctggacata

SEQ ID NO: 48620 - DNA, 21 bp, Artificial sequence
  SiRNA target sequence
caggagatcacctggacataa

SEQ ID NO: 48621 - DNA, 21 bp, Artificial sequence
  SiRNA target sequence
aggagatcacctggacataaa

SEQ ID NO: 48622 - DNA, 21 bp, Artificial sequence
  SiRNA target sequence
ggagatcacctggacataaac

SEQ ID NO: 48623 - DNA, 21 bp, Artificial sequence
  SiRNA target sequence
gagatcacctggacataaaca

SEQ ID NO: 48624 - DNA, 21 bp, Artificial sequence
  SiRNA target sequence
agatcacctggacataaacac

SEQ ID NO: 48625 - DNA, 21 bp, Artificial sequence
  SiRNA target sequence
gatcacctggacataaacact

SEQ ID NO: 48626 - DNA, 21 bp, Artificial sequence
  SiRNA target sequence
atcacctggacataaacactt

SEQ ID NO: 48627 - DNA, 21 bp, Artificial sequence
  SiRNA target sequence
tcacctggacataaacactta

SEQ ID NO: 48628 - DNA, 21 bp, Artificial sequence
  SiRNA target sequence
cacctggacataaacacttat

SEQ ID NO: 48629 - DNA, 21 bp, Artificial sequence
  SiRNA target sequence
acctggacataaacacttatc

SEQ ID NO: 48630 - DNA, 21 bp, Artificial sequence
  SiRNA target sequence
cctggacataaacacttatcg

SEQ ID NO: 48631 - DNA, 21 bp, Artificial sequence
  SiRNA target sequence
ctggacataaacacttatcgt

SEQ ID NO: 48632 - DNA, 21 bp, Artificial sequence
  SiRNA target sequence
tggacataaacacttatcgtg

SEQ ID NO: 48633 - DNA, 21 bp, Artificial sequence
  SiRNA target sequence
ggacataaacacttatcgtgg

SEQ ID NO: 48634 - DNA, 21 bp, Artificial sequence
  SiRNA target sequence
gacataaacacttatcgtgga

SEQ ID NO: 48635 - DNA, 21 bp, Artificial sequence
  SiRNA target sequence
acataaacacttatcgtggat

SEQ ID NO: 48636 - DNA, 21 bp, Artificial sequence
  SiRNA target sequence
cataaacacttatcgtggata

SEQ ID NO: 48637 - DNA, 21 bp, Artificial sequence
  SiRNA target sequence
ataaacacttatcgtggatat

SEQ ID NO: 48638 - DNA, 21 bp, Artificial sequence
  SiRNA target sequence
taaacacttatcgtggatatg

SEQ ID NO: 48639 - DNA, 21 bp, Artificial sequence
  SiRNA target sequence
aaacacttatcgtggatatgc

SEQ ID NO: 48640 - DNA, 21 bp, Artificial sequence
  SiRNA target sequence
aacacttatcgtggatatgct

SEQ ID NO: 48641 - DNA, 21 bp, Artificial sequence
  SiRNA target sequence
acacttatcgtggatatgctc

SEQ ID NO: 48642 - DNA, 21 bp, Artificial sequence
  SiRNA target sequence
cacttatcgtggatatgctca

SEQ ID NO: 48643 - DNA, 21 bp, Artificial sequence
  SiRNA target sequence
acttatcgtggatatgctcag

SEQ ID NO: 48644 - DNA, 21 bp, Artificial sequence
  SiRNA target sequence
cttatcgtggatatgctcagg

SEQ ID NO: 48645 - DNA, 21 bp, Artificial sequence
  SiRNA target sequence
ttatcgtggatatgctcagga

SEQ ID NO: 48646 - DNA, 21 bp, Artificial sequence
  SiRNA target sequence
tatcgtggatatgctcaggag

SEQ ID NO: 48647 - DNA, 21 bp, Artificial sequence
  SiRNA target sequence
atcgtggatatgctcaggagc

SEQ ID NO: 48648 - DNA, 21 bp, Artificial sequence
  SiRNA target sequence
tcgtggatatgctcaggagcg

SEQ ID NO: 48649 - DNA, 21 bp, Artificial sequence
  SiRNA target sequence
cgtggatatgctcaggagcgg

SEQ ID NO: 48650 - DNA, 21 bp, Artificial sequence
  SiRNA target sequence
gtggatatgctcaggagcggt

SEQ ID NO: 48651 - DNA, 21 bp, Artificial sequence
  SiRNA target sequence
tggatatgctcaggagcggta

SEQ ID NO: 48652 - DNA, 21 bp, Artificial sequence
  SiRNA target sequence
ggatatgctcaggagcggtat

SEQ ID NO: 48653 - DNA, 21 bp, Artificial sequence
  SiRNA target sequence
gatatgctcaggagcggtatc

SEQ ID NO: 48654 - DNA, 21 bp, Artificial sequence
  SiRNA target sequence
atatgctcaggagcggtatct

SEQ ID NO: 48655 - DNA, 21 bp, Artificial sequence
  SiRNA target sequence
tatgctcaggagcggtatctc

SEQ ID NO: 48656 - DNA, 21 bp, Artificial sequence
  SiRNA target sequence
atgctcaggagcggtatctcg

SEQ ID NO: 48657 - DNA, 21 bp, Artificial sequence
  SiRNA target sequence
tgctcaggagcggtatctcga

SEQ ID NO: 48658 - DNA, 21 bp, Artificial sequence
  SiRNA target sequence
gctcaggagcggtatctcgag

SEQ ID NO: 48659 - DNA, 21 bp, Artificial sequence
  SiRNA target sequence
ctcaggagcggtatctcgagt

SEQ ID NO: 48660 - DNA, 21 bp, Artificial sequence
  SiRNA target sequence
tcaggagcggtatctcgagta

SEQ ID NO: 48661 - DNA, 21 bp, Artificial sequence
  SiRNA target sequence
caggagcggtatctcgagtat

SEQ ID NO: 48662 - DNA, 21 bp, Artificial sequence
  SiRNA target sequence
aggagcggtatctcgagtatt

SEQ ID NO: 48663 - DNA, 21 bp, Artificial sequence
  SiRNA target sequence
ggagcggtatctcgagtatta

SEQ ID NO: 48664 - DNA, 21 bp, Artificial sequence
  SiRNA target sequence
gagcggtatctcgagtattat

SEQ ID NO: 48665 - DNA, 21 bp, Artificial sequence
  SiRNA target sequence
agcggtatctcgagtattata

SEQ ID NO: 48666 - DNA, 21 bp, Artificial sequence
  SiRNA target sequence
gcggtatctcgagtattatat

SEQ ID NO: 48667 - DNA, 21 bp, Artificial sequence
  SiRNA target sequence
cggtatctcgagtattatatg

SEQ ID NO: 48668 - DNA, 21 bp, Artificial sequence
  SiRNA target sequence
ggtatctcgagtattatatgt

SEQ ID NO: 48669 - DNA, 21 bp, Artificial sequence
  SiRNA target sequence
gtatctcgagtattatatgta

SEQ ID NO: 48670 - DNA, 21 bp, Artificial sequence
  SiRNA target sequence
tatctcgagtattatatgtaa

SEQ ID NO: 48671 - DNA, 21 bp, Artificial sequence
  SiRNA target sequence
atctcgagtattatatgtaaa

SEQ ID NO: 48672 - DNA, 21 bp, Artificial sequence
  SiRNA target sequence
tctcgagtattatatgtaaat

SEQ ID NO: 48673 - DNA, 21 bp, Artificial sequence
  SiRNA target sequence
ctcgagtattatatgtaaata

SEQ ID NO: 48674 - DNA, 21 bp, Artificial sequence
  SiRNA target sequence
tcgagtattatatgtaaatat

SEQ ID NO: 48675 - DNA, 21 bp, Artificial sequence
  SiRNA target sequence
cgagtattatatgtaaatata

SEQ ID NO: 48676 - DNA, 21 bp, Artificial sequence
  SiRNA target sequence
gagtattatatgtaaatataa

SEQ ID NO: 48677 - DNA, 21 bp, Artificial sequence
  SiRNA target sequence
agtattatatgtaaatataat

SEQ ID NO: 48678 - DNA, 21 bp, Artificial sequence
  SiRNA target sequence
gtattatatgtaaatataata

SEQ ID NO: 48679 - DNA, 21 bp, Artificial sequence
  SiRNA target sequence
tattatatgtaaatataatac

SEQ ID NO: 48680 - DNA, 21 bp, Artificial sequence
  SiRNA target sequence
attatatgtaaatataatact

SEQ ID NO: 48681 - DNA, 21 bp, Artificial sequence
  SiRNA target sequence
ttatatgtaaatataatactt

SEQ ID NO: 48682 - DNA, 21 bp, Artificial sequence
  SiRNA target sequence
tatatgtaaatataatacttg

SEQ ID NO: 48683 - DNA, 21 bp, Artificial sequence
  SiRNA target sequence
atatgtaaatataatacttga

SEQ ID NO: 48684 - DNA, 21 bp, Artificial sequence
  SiRNA target sequence
tatgtaaatataatacttgag

SEQ ID NO: 48685 - DNA, 21 bp, Artificial sequence
  SiRNA target sequence
atgtaaatataatacttgaga

SEQ ID NO: 48686 - DNA, 21 bp, Artificial sequence
  SiRNA target sequence
tgtaaatataatacttgagat

SEQ ID NO: 48687 - DNA, 21 bp, Artificial sequence
  SiRNA target sequence
gtaaatataatacttgagatg

SEQ ID NO: 48688 - DNA, 21 bp, Artificial sequence
  SiRNA target sequence
taaatataatacttgagatgc

SEQ ID NO: 48689 - DNA, 21 bp, Artificial sequence
  SiRNA target sequence
aaatataatacttgagatgca

SEQ ID NO: 48690 - DNA, 21 bp, Artificial sequence
  SiRNA target sequence
aatataatacttgagatgcac

SEQ ID NO: 48691 - DNA, 21 bp, Artificial sequence
  SiRNA target sequence
atataatacttgagatgcact

SEQ ID NO: 48692 - DNA, 21 bp, Artificial sequence
  SiRNA target sequence
tataatacttgagatgcactg

SEQ ID NO: 48693 - DNA, 21 bp, Artificial sequence
  SiRNA target sequence
ataatacttgagatgcactgt

SEQ ID NO: 48694 - DNA, 21 bp, Artificial sequence
  SiRNA target sequence
taatacttgagatgcactgtt

SEQ ID NO: 48695 - DNA, 21 bp, Artificial sequence
  SiRNA target sequence
aatacttgagatgcactgttt

SEQ ID NO: 48696 - DNA, 21 bp, Artificial sequence
  SiRNA target sequence
atacttgagatgcactgtttc

SEQ ID NO: 48697 - DNA, 21 bp, Artificial sequence
  SiRNA target sequence
tacttgagatgcactgtttca

SEQ ID NO: 48698 - DNA, 21 bp, Artificial sequence
  SiRNA target sequence
acttgagatgcactgtttcat

SEQ ID NO: 48699 - DNA, 21 bp, Artificial sequence
  SiRNA target sequence
cttgagatgcactgtttcatg

SEQ ID NO: 48700 - DNA, 21 bp, Artificial sequence
  SiRNA target sequence
ttgagatgcactgtttcatgg

SEQ ID NO: 48701 - DNA, 21 bp, Artificial sequence
  SiRNA target sequence
tgagatgcactgtttcatggt

SEQ ID NO: 48702 - DNA, 21 bp, Artificial sequence
  SiRNA target sequence
gagatgcactgtttcatggtt

SEQ ID NO: 48703 - DNA, 21 bp, Artificial sequence
  SiRNA target sequence
agatgcactgtttcatggtta

SEQ ID NO: 48704 - DNA, 21 bp, Artificial sequence
  SiRNA target sequence
gatgcactgtttcatggttac

SEQ ID NO: 48705 - DNA, 21 bp, Artificial sequence
  SiRNA target sequence
atgcactgtttcatggttacc

SEQ ID NO: 48706 - DNA, 21 bp, Artificial sequence
  SiRNA target sequence
tgcactgtttcatggttaccc

SEQ ID NO: 48707 - DNA, 21 bp, Artificial sequence
  SiRNA target sequence
gcactgtttcatggttaccca

SEQ ID NO: 48708 - DNA, 21 bp, Artificial sequence
  SiRNA target sequence
cactgtttcatggttacccat

SEQ ID NO: 48709 - DNA, 21 bp, Artificial sequence
  SiRNA target sequence
actgtttcatggttacccatc

SEQ ID NO: 48710 - DNA, 21 bp, Artificial sequence
  SiRNA target sequence
ctgtttcatggttacccatca

SEQ ID NO: 48711 - DNA, 21 bp, Artificial sequence
  SiRNA target sequence
tgtttcatggttacccatcat

SEQ ID NO: 48712 - DNA, 21 bp, Artificial sequence
  SiRNA target sequence
gtttcatggttacccatcatt

SEQ ID NO: 48713 - DNA, 21 bp, Artificial sequence
  SiRNA target sequence
tttcatggttacccatcattt

SEQ ID NO: 48714 - DNA, 21 bp, Artificial sequence
  SiRNA target sequence
ttcatggttacccatcatttg

SEQ ID NO: 48715 - DNA, 21 bp, Artificial sequence
  SiRNA target sequence
tcatggttacccatcatttga

SEQ ID NO: 48716 - DNA, 21 bp, Artificial sequence
  SiRNA target sequence
catggttacccatcatttgag

SEQ ID NO: 48717 - DNA, 21 bp, Artificial sequence
  SiRNA target sequence
atggttacccatcatttgagg

SEQ ID NO: 48718 - DNA, 21 bp, Artificial sequence
  SiRNA target sequence
tggttacccatcatttgagga

SEQ ID NO: 48719 - DNA, 21 bp, Artificial sequence
  SiRNA target sequence
ggttacccatcatttgaggaa

SEQ ID NO: 48720 - DNA, 21 bp, Artificial sequence
  SiRNA target sequence
gttacccatcatttgaggaaa

SEQ ID NO: 48721 - DNA, 21 bp, Artificial sequence
  SiRNA target sequence
ttacccatcatttgaggaaat

SEQ ID NO: 48722 - DNA, 21 bp, Artificial sequence
  SiRNA target sequence
tacccatcatttgaggaaatt

SEQ ID NO: 48723 - DNA, 21 bp, Artificial sequence
  SiRNA target sequence
acccatcatttgaggaaattt

SEQ ID NO: 48724 - DNA, 21 bp, Artificial sequence
  SiRNA target sequence
cccatcatttgaggaaatttc

SEQ ID NO: 48725 - DNA, 21 bp, Artificial sequence
  SiRNA target sequence
ccatcatttgaggaaatttcc

SEQ ID NO: 48726 - DNA, 21 bp, Artificial sequence
  SiRNA target sequence
catcatttgaggaaatttcca

SEQ ID NO: 48727 - DNA, 21 bp, Artificial sequence
  SiRNA target sequence
atcatttgaggaaatttccaa

SEQ ID NO: 48728 - DNA, 21 bp, Artificial sequence
  SiRNA target sequence
tcatttgaggaaatttccaat

SEQ ID NO: 48729 - DNA, 21 bp, Artificial sequence
  SiRNA target sequence
catttgaggaaatttccaata

SEQ ID NO: 48730 - DNA, 21 bp, Artificial sequence
  SiRNA target sequence
atttgaggaaatttccaataa

SEQ ID NO: 48731 - DNA, 21 bp, Artificial sequence
  SiRNA target sequence
tttgaggaaatttccaataaa

SEQ ID NO: 48732 - DNA, 21 bp, Artificial sequence
  SiRNA target sequence
ttgaggaaatttccaataaac

SEQ ID NO: 48733 - DNA, 21 bp, Artificial sequence
  SiRNA target sequence
tgaggaaatttccaataaact

SEQ ID NO: 48734 - DNA, 21 bp, Artificial sequence
  SiRNA target sequence
gaggaaatttccaataaactt

SEQ ID NO: 48735 - DNA, 21 bp, Artificial sequence
  SiRNA target sequence
aggaaatttccaataaacttg

SEQ ID NO: 48736 - DNA, 21 bp, Artificial sequence
  SiRNA target sequence
ggaaatttccaataaacttga

SEQ ID NO: 48737 - DNA, 21 bp, Artificial sequence
  SiRNA target sequence
gaaatttccaataaacttgaa

SEQ ID NO: 48738 - DNA, 21 bp, Artificial sequence
  SiRNA target sequence
aaatttccaataaacttgaat

SEQ ID NO: 48739 - DNA, 21 bp, Artificial sequence
  SiRNA target sequence
aatttccaataaacttgaatg

SEQ ID NO: 48740 - DNA, 21 bp, Artificial sequence
  SiRNA target sequence
atttccaataaacttgaatgt

SEQ ID NO: 48741 - DNA, 21 bp, Artificial sequence
  SiRNA target sequence
tttccaataaacttgaatgta

SEQ ID NO: 48742 - DNA, 21 bp, Artificial sequence
  SiRNA target sequence
ttccaataaacttgaatgtaa

SEQ ID NO: 48743 - DNA, 21 bp, Artificial sequence
  SiRNA target sequence
tccaataaacttgaatgtaag

SEQ ID NO: 48744 - DNA, 21 bp, Artificial sequence
  SiRNA target sequence
ccaataaacttgaatgtaagg

SEQ ID NO: 48745 - DNA, 21 bp, Artificial sequence
  SiRNA target sequence
caataaacttgaatgtaaggc

SEQ ID NO: 48746 - DNA, 21 bp, Artificial sequence
  SiRNA target sequence
aataaacttgaatgtaaggct

SEQ ID NO: 48747 - DNA, 21 bp, Artificial sequence
  SiRNA target sequence
ataaacttgaatgtaaggctt

SEQ ID NO: 48748 - DNA, 21 bp, Artificial sequence
  SiRNA target sequence
taaacttgaatgtaaggcttg

SEQ ID NO: 48749 - DNA, 21 bp, Artificial sequence
  SiRNA target sequence
aaacttgaatgtaaggcttga

SEQ ID NO: 48750 - DNA, 21 bp, Artificial sequence
  SiRNA target sequence
aacttgaatgtaaggcttgaa

SEQ ID NO: 48751 - DNA, 21 bp, Artificial sequence
  SiRNA target sequence
acttgaatgtaaggcttgaaa

SEQ ID NO: 48752 - DNA, 21 bp, Artificial sequence
  SiRNA target sequence
cttgaatgtaaggcttgaaac

SEQ ID NO: 48753 - DNA, 21 bp, Artificial sequence
  SiRNA target sequence
ttgaatgtaaggcttgaaaca

SEQ ID NO: 48754 - DNA, 21 bp, Artificial sequence
  SiRNA target sequence
tgaatgtaaggcttgaaacag

SEQ ID NO: 48755 - DNA, 21 bp, Artificial sequence
  SiRNA target sequence
gaatgtaaggcttgaaacagt

SEQ ID NO: 48756 - DNA, 21 bp, Artificial sequence
  SiRNA target sequence
aatgtaaggcttgaaacagtg

SEQ ID NO: 48757 - DNA, 21 bp, Artificial sequence
  SiRNA target sequence
atgtaaggcttgaaacagtgg

SEQ ID NO: 48758 - DNA, 21 bp, Artificial sequence
  SiRNA target sequence
tgtaaggcttgaaacagtggt

SEQ ID NO: 48759 - DNA, 21 bp, Artificial sequence
  SiRNA target sequence
gtaaggcttgaaacagtggtc

SEQ ID NO: 48760 - DNA, 21 bp, Artificial sequence
  SiRNA target sequence
taaggcttgaaacagtggtct

SEQ ID NO: 48761 - DNA, 21 bp, Artificial sequence
  SiRNA target sequence
aaggcttgaaacagtggtcta

SEQ ID NO: 48762 - DNA, 21 bp, Artificial sequence
  SiRNA target sequence
aggcttgaaacagtggtctag

SEQ ID NO: 48763 - DNA, 21 bp, Artificial sequence
  SiRNA target sequence
ggcttgaaacagtggtctagg

SEQ ID NO: 48764 - DNA, 21 bp, Artificial sequence
  SiRNA target sequence
gcttgaaacagtggtctaggt

SEQ ID NO: 48765 - DNA, 21 bp, Artificial sequence
  SiRNA target sequence
cttgaaacagtggtctaggtg

SEQ ID NO: 48766 - DNA, 21 bp, Artificial sequence
  SiRNA target sequence
ttgaaacagtggtctaggtgc

SEQ ID NO: 48767 - DNA, 21 bp, Artificial sequence
  SiRNA target sequence
tgaaacagtggtctaggtgcc

SEQ ID NO: 48768 - DNA, 21 bp, Artificial sequence
  SiRNA target sequence
gaaacagtggtctaggtgccc

SEQ ID NO: 48769 - DNA, 21 bp, Artificial sequence
  SiRNA target sequence
aaacagtggtctaggtgccct

SEQ ID NO: 48770 - DNA, 21 bp, Artificial sequence
  SiRNA target sequence
aacagtggtctaggtgcccta

SEQ ID NO: 48771 - DNA, 21 bp, Artificial sequence
  SiRNA target sequence
acagtggtctaggtgccctat

SEQ ID NO: 48772 - DNA, 21 bp, Artificial sequence
  SiRNA target sequence
cagtggtctaggtgccctatt

SEQ ID NO: 48773 - DNA, 21 bp, Artificial sequence
  SiRNA target sequence
agtggtctaggtgccctattt

SEQ ID NO: 48774 - DNA, 21 bp, Artificial sequence
  SiRNA target sequence
gtggtctaggtgccctattta

SEQ ID NO: 48775 - DNA, 21 bp, Artificial sequence
  SiRNA target sequence
tggtctaggtgccctatttag

SEQ ID NO: 48776 - DNA, 21 bp, Artificial sequence
  SiRNA target sequence
ggtctaggtgccctatttagg

SEQ ID NO: 48777 - DNA, 21 bp, Artificial sequence
  SiRNA target sequence
gtctaggtgccctatttaggg

SEQ ID NO: 48778 - DNA, 21 bp, Artificial sequence
  SiRNA target sequence
tctaggtgccctatttagggt

SEQ ID NO: 48779 - DNA, 21 bp, Artificial sequence
  SiRNA target sequence
ctaggtgccctatttagggtg

SEQ ID NO: 48780 - DNA, 21 bp, Artificial sequence
  SiRNA target sequence
taggtgccctatttagggtga

SEQ ID NO: 48781 - DNA, 21 bp, Artificial sequence
  SiRNA target sequence
aggtgccctatttagggtgag

SEQ ID NO: 48782 - DNA, 21 bp, Artificial sequence
  SiRNA target sequence
ggtgccctatttagggtgagg

SEQ ID NO: 48783 - DNA, 21 bp, Artificial sequence
  SiRNA target sequence
gtgccctatttagggtgagga

SEQ ID NO: 48784 - DNA, 21 bp, Artificial sequence
  SiRNA target sequence
tgccctatttagggtgaggag

SEQ ID NO: 48785 - DNA, 21 bp, Artificial sequence
  SiRNA target sequence
gccctatttagggtgaggagc

SEQ ID NO: 48786 - DNA, 21 bp, Artificial sequence
  SiRNA target sequence
ccctatttagggtgaggagcc

SEQ ID NO: 48787 - DNA, 21 bp, Artificial sequence
  SiRNA target sequence
cctatttagggtgaggagcct

SEQ ID NO: 48788 - DNA, 21 bp, Artificial sequence
  SiRNA target sequence
ctatttagggtgaggagccta

SEQ ID NO: 48789 - DNA, 21 bp, Artificial sequence
  SiRNA target sequence
tatttagggtgaggagcctag

SEQ ID NO: 48790 - DNA, 21 bp, Artificial sequence
  SiRNA target sequence
atttagggtgaggagcctagc

SEQ ID NO: 48791 - DNA, 21 bp, Artificial sequence
  SiRNA target sequence
tttagggtgaggagcctagct

SEQ ID NO: 48792 - DNA, 21 bp, Artificial sequence
  SiRNA target sequence
ttagggtgaggagcctagctg

SEQ ID NO: 48793 - DNA, 21 bp, Artificial sequence
  SiRNA target sequence
tagggtgaggagcctagctgg

SEQ ID NO: 48794 - DNA, 21 bp, Artificial sequence
  SiRNA target sequence
agggtgaggagcctagctggc

SEQ ID NO: 48795 - DNA, 21 bp, Artificial sequence
  SiRNA target sequence
gggtgaggagcctagctggca

SEQ ID NO: 48796 - DNA, 21 bp, Artificial sequence
  SiRNA target sequence
ggtgaggagcctagctggcag

SEQ ID NO: 48797 - DNA, 21 bp, Artificial sequence
  SiRNA target sequence
gtgaggagcctagctggcagc

SEQ ID NO: 48798 - DNA, 21 bp, Artificial sequence
  SiRNA target sequence
tgaggagcctagctggcagcc

SEQ ID NO: 48799 - DNA, 21 bp, Artificial sequence
  SiRNA target sequence
gaggagcctagctggcagccc

SEQ ID NO: 48800 - DNA, 21 bp, Artificial sequence
  SiRNA target sequence
aggagcctagctggcagcccc

SEQ ID NO: 48801 - DNA, 21 bp, Artificial sequence
  SiRNA target sequence
ggagcctagctggcagcccca

SEQ ID NO: 48802 - DNA, 21 bp, Artificial sequence
  SiRNA target sequence
gagcctagctggcagccccag

SEQ ID NO: 48803 - DNA, 21 bp, Artificial sequence
  SiRNA target sequence
agcctagctggcagccccagt

SEQ ID NO: 48804 - DNA, 21 bp, Artificial sequence
  SiRNA target sequence
gcctagctggcagccccagtg

SEQ ID NO: 48805 - DNA, 21 bp, Artificial sequence
  SiRNA target sequence
cctagctggcagccccagtga

SEQ ID NO: 48806 - DNA, 21 bp, Artificial sequence
  SiRNA target sequence
ctagctggcagccccagtgaa

SEQ ID NO: 48807 - DNA, 21 bp, Artificial sequence
  SiRNA target sequence
tagctggcagccccagtgaat

SEQ ID NO: 48808 - DNA, 21 bp, Artificial sequence
  SiRNA target sequence
agctggcagccccagtgaatc

SEQ ID NO: 48809 - DNA, 21 bp, Artificial sequence
  SiRNA target sequence
gctggcagccccagtgaatcc

SEQ ID NO: 48810 - DNA, 21 bp, Artificial sequence
  SiRNA target sequence
ctggcagccccagtgaatcct

SEQ ID NO: 48811 - DNA, 21 bp, Artificial sequence
  SiRNA target sequence
tggcagccccagtgaatcctc

SEQ ID NO: 48812 - DNA, 21 bp, Artificial sequence
  SiRNA target sequence
ggcagccccagtgaatcctct

SEQ ID NO: 48813 - DNA, 21 bp, Artificial sequence
  SiRNA target sequence
gcagccccagtgaatcctcta

SEQ ID NO: 48814 - DNA, 21 bp, Artificial sequence
  SiRNA target sequence
cagccccagtgaatcctctat

SEQ ID NO: 48815 - DNA, 21 bp, Artificial sequence
  SiRNA target sequence
agccccagtgaatcctctatt

SEQ ID NO: 48816 - DNA, 21 bp, Artificial sequence
  SiRNA target sequence
gccccagtgaatcctctattg

SEQ ID NO: 48817 - DNA, 21 bp, Artificial sequence
  SiRNA target sequence
ccccagtgaatcctctattgg

SEQ ID NO: 48818 - DNA, 21 bp, Artificial sequence
  SiRNA target sequence
cccagtgaatcctctattgga

SEQ ID NO: 48819 - DNA, 21 bp, Artificial sequence
  SiRNA target sequence
ccagtgaatcctctattggat

SEQ ID NO: 48820 - DNA, 21 bp, Artificial sequence
  SiRNA target sequence
cagtgaatcctctattggata

SEQ ID NO: 48821 - DNA, 21 bp, Artificial sequence
  SiRNA target sequence
agtgaatcctctattggatag

SEQ ID NO: 48822 - DNA, 21 bp, Artificial sequence
  SiRNA target sequence
gtgaatcctctattggataga

SEQ ID NO: 48823 - DNA, 21 bp, Artificial sequence
  SiRNA target sequence
tgaatcctctattggatagaa

SEQ ID NO: 48824 - DNA, 21 bp, Artificial sequence
  SiRNA target sequence
gaatcctctattggatagaaa

SEQ ID NO: 48825 - DNA, 21 bp, Artificial sequence
  SiRNA target sequence
aatcctctattggatagaaac

SEQ ID NO: 48826 - DNA, 21 bp, Artificial sequence
  SiRNA target sequence
atcctctattggatagaaacc

SEQ ID NO: 48827 - DNA, 21 bp, Artificial sequence
  SiRNA target sequence
tcctctattggatagaaaccg

SEQ ID NO: 48828 - DNA, 21 bp, Artificial sequence
  SiRNA target sequence
cctctattggatagaaaccgc

SEQ ID NO: 48829 - DNA, 21 bp, Artificial sequence
  SiRNA target sequence
ctctattggatagaaaccgct

SEQ ID NO: 48830 - DNA, 21 bp, Artificial sequence
  SiRNA target sequence
tctattggatagaaaccgcta

SEQ ID NO: 48831 - DNA, 21 bp, Artificial sequence
  SiRNA target sequence
ctattggatagaaaccgctat

SEQ ID NO: 48832 - DNA, 21 bp, Artificial sequence
  SiRNA target sequence
tattggatagaaaccgctata

SEQ ID NO: 48833 - DNA, 21 bp, Artificial sequence
  SiRNA target sequence
attggatagaaaccgctatat

SEQ ID NO: 48834 - DNA, 21 bp, Artificial sequence
  SiRNA target sequence
ttggatagaaaccgctatatc

SEQ ID NO: 48835 - DNA, 21 bp, Artificial sequence
  SiRNA target sequence
tggatagaaaccgctatatcg

SEQ ID NO: 48836 - DNA, 21 bp, Artificial sequence
  SiRNA target sequence
ggatagaaaccgctatatcgg

SEQ ID NO: 48837 - DNA, 21 bp, Artificial sequence
  SiRNA target sequence
gatagaaaccgctatatcggg

SEQ ID NO: 48838 - DNA, 21 bp, Artificial sequence
  SiRNA target sequence
atagaaaccgctatatcgggt

SEQ ID NO: 48839 - DNA, 21 bp, Artificial sequence
  SiRNA target sequence
tagaaaccgctatatcgggta

SEQ ID NO: 48840 - DNA, 21 bp, Artificial sequence
  SiRNA target sequence
agaaaccgctatatcgggtag

SEQ ID NO: 48841 - DNA, 21 bp, Artificial sequence
  SiRNA target sequence
gaaaccgctatatcgggtagc

SEQ ID NO: 48842 - DNA, 21 bp, Artificial sequence
  SiRNA target sequence
aaaccgctatatcgggtagct

SEQ ID NO: 48843 - DNA, 21 bp, Artificial sequence
  SiRNA target sequence
aaccgctatatcgggtagcta

SEQ ID NO: 48844 - DNA, 21 bp, Artificial sequence
  SiRNA target sequence
accgctatatcgggtagctat

SEQ ID NO: 48845 - DNA, 21 bp, Artificial sequence
  SiRNA target sequence
ccgctatatcgggtagctata

SEQ ID NO: 48846 - DNA, 21 bp, Artificial sequence
  SiRNA target sequence
cgctatatcgggtagctatag

SEQ ID NO: 48847 - DNA, 21 bp, Artificial sequence
  SiRNA target sequence
gctatatcgggtagctatagc

SEQ ID NO: 48848 - DNA, 21 bp, Artificial sequence
  SiRNA target sequence
ctatatcgggtagctatagca

SEQ ID NO: 48849 - DNA, 21 bp, Artificial sequence
  SiRNA target sequence
tatatcgggtagctatagcag

SEQ ID NO: 48850 - DNA, 21 bp, Artificial sequence
  SiRNA target sequence
atatcgggtagctatagcagt

SEQ ID NO: 48851 - DNA, 21 bp, Artificial sequence
  SiRNA target sequence
tatcgggtagctatagcagtc

SEQ ID NO: 48852 - DNA, 21 bp, Artificial sequence
  SiRNA target sequence
atcgggtagctatagcagtcg

SEQ ID NO: 48853 - DNA, 21 bp, Artificial sequence
  SiRNA target sequence
tcgggtagctatagcagtcgg

SEQ ID NO: 48854 - DNA, 21 bp, Artificial sequence
  SiRNA target sequence
cgggtagctatagcagtcgga

SEQ ID NO: 48855 - DNA, 21 bp, Artificial sequence
  SiRNA target sequence
gggtagctatagcagtcggat

SEQ ID NO: 48856 - DNA, 21 bp, Artificial sequence
  SiRNA target sequence
ggtagctatagcagtcggata

SEQ ID NO: 48857 - DNA, 21 bp, Artificial sequence
  SiRNA target sequence
gtagctatagcagtcggatag

SEQ ID NO: 48858 - DNA, 21 bp, Artificial sequence
  SiRNA target sequence
tagctatagcagtcggatagt

SEQ ID NO: 48859 - DNA, 21 bp, Artificial sequence
  SiRNA target sequence
agctatagcagtcggatagta

SEQ ID NO: 48860 - DNA, 21 bp, Artificial sequence
  SiRNA target sequence
gctatagcagtcggatagtaa

SEQ ID NO: 48861 - DNA, 21 bp, Artificial sequence
  SiRNA target sequence
ctatagcagtcggatagtaat

SEQ ID NO: 48862 - DNA, 21 bp, Artificial sequence
  SiRNA target sequence
tatagcagtcggatagtaata

SEQ ID NO: 48863 - DNA, 21 bp, Artificial sequence
  SiRNA target sequence
atagcagtcggatagtaatat

SEQ ID NO: 48864 - DNA, 21 bp, Artificial sequence
  SiRNA target sequence
tagcagtcggatagtaatata

SEQ ID NO: 48865 - DNA, 21 bp, Artificial sequence
  SiRNA target sequence
agcagtcggatagtaatatat

SEQ ID NO: 48866 - DNA, 21 bp, Artificial sequence
  SiRNA target sequence
gcagtcggatagtaatatatc

SEQ ID NO: 48867 - DNA, 21 bp, Artificial sequence
  SiRNA target sequence
cagtcggatagtaatatatcc

SEQ ID NO: 48868 - DNA, 21 bp, Artificial sequence
  SiRNA target sequence
agtcggatagtaatatatccg

SEQ ID NO: 48869 - DNA, 21 bp, Artificial sequence
  SiRNA target sequence
gtcggatagtaatatatccgg

SEQ ID NO: 48870 - DNA, 21 bp, Artificial sequence
  SiRNA target sequence
tcggatagtaatatatccggc

SEQ ID NO: 48871 - DNA, 21 bp, Artificial sequence
  SiRNA target sequence
cggatagtaatatatccggcg

SEQ ID NO: 48872 - DNA, 21 bp, Artificial sequence
  SiRNA target sequence
ggatagtaatatatccggcgt

SEQ ID NO: 48873 - DNA, 21 bp, Artificial sequence
  SiRNA target sequence
gatagtaatatatccggcgtt

SEQ ID NO: 48874 - DNA, 21 bp, Artificial sequence
  SiRNA target sequence
atagtaatatatccggcgttt

SEQ ID NO: 48875 - DNA, 21 bp, Artificial sequence
  SiRNA target sequence
tagtaatatatccggcgtttc

SEQ ID NO: 48876 - DNA, 21 bp, Artificial sequence
  SiRNA target sequence
agtaatatatccggcgtttcg

SEQ ID NO: 48877 - DNA, 21 bp, Artificial sequence
  SiRNA target sequence
gtaatatatccggcgtttcga

SEQ ID NO: 48878 - DNA, 21 bp, Artificial sequence
  SiRNA target sequence
taatatatccggcgtttcgaa

SEQ ID NO: 48879 - DNA, 21 bp, Artificial sequence
  SiRNA target sequence
aatatatccggcgtttcgaaa

SEQ ID NO: 48880 - DNA, 21 bp, Artificial sequence
  SiRNA target sequence
atatatccggcgtttcgaaat

SEQ ID NO: 48881 - DNA, 21 bp, Artificial sequence
  SiRNA target sequence
tatatccggcgtttcgaaata

SEQ ID NO: 48882 - DNA, 21 bp, Artificial sequence
  SiRNA target sequence
atatccggcgtttcgaaatac

SEQ ID NO: 48883 - DNA, 21 bp, Artificial sequence
  SiRNA target sequence
tatccggcgtttcgaaatacc

SEQ ID NO: 48884 - DNA, 21 bp, Artificial sequence
  SiRNA target sequence
atccggcgtttcgaaatacca

SEQ ID NO: 48885 - DNA, 21 bp, Artificial sequence
  SiRNA target sequence
tccggcgtttcgaaataccat

SEQ ID NO: 48886 - DNA, 21 bp, Artificial sequence
  SiRNA target sequence
ccggcgtttcgaaataccata

SEQ ID NO: 48887 - DNA, 21 bp, Artificial sequence
  SiRNA target sequence
cggcgtttcgaaataccatac

SEQ ID NO: 48888 - DNA, 21 bp, Artificial sequence
  SiRNA target sequence
ggcgtttcgaaataccatacc

SEQ ID NO: 48889 - DNA, 21 bp, Artificial sequence
  SiRNA target sequence
gcgtttcgaaataccatacct

SEQ ID NO: 48890 - DNA, 21 bp, Artificial sequence
  SiRNA target sequence
cgtttcgaaataccatacctg

SEQ ID NO: 48891 - DNA, 21 bp, Artificial sequence
  SiRNA target sequence
gtttcgaaataccatacctgc

SEQ ID NO: 48892 - DNA, 21 bp, Artificial sequence
  SiRNA target sequence
tttcgaaataccatacctgct

SEQ ID NO: 48893 - DNA, 21 bp, Artificial sequence
  SiRNA target sequence
ttcgaaataccatacctgctg

SEQ ID NO: 48894 - DNA, 21 bp, Artificial sequence
  SiRNA target sequence
tcgaaataccatacctgctga

SEQ ID NO: 48895 - DNA, 21 bp, Artificial sequence
  SiRNA target sequence
cgaaataccatacctgctgat

SEQ ID NO: 48896 - DNA, 21 bp, Artificial sequence
  SiRNA target sequence
gaaataccatacctgctgata

SEQ ID NO: 48897 - DNA, 21 bp, Artificial sequence
  SiRNA target sequence
aaataccatacctgctgataa

SEQ ID NO: 48898 - DNA, 21 bp, Artificial sequence
  SiRNA target sequence
aataccatacctgctgataac

SEQ ID NO: 48899 - DNA, 21 bp, Artificial sequence
  SiRNA target sequence
ataccatacctgctgataacc

SEQ ID NO: 48900 - DNA, 21 bp, Artificial sequence
  SiRNA target sequence
taccatacctgctgataacca

SEQ ID NO: 48901 - DNA, 21 bp, Artificial sequence
  SiRNA target sequence
accatacctgctgataaccaa

SEQ ID NO: 48902 - DNA, 21 bp, Artificial sequence
  SiRNA target sequence
ccatacctgctgataaccaag

SEQ ID NO: 48903 - DNA, 21 bp, Artificial sequence
  SiRNA target sequence
catacctgctgataaccaaga

SEQ ID NO: 48904 - DNA, 21 bp, Artificial sequence
  SiRNA target sequence
atacctgctgataaccaagaa

SEQ ID NO: 48905 - DNA, 21 bp, Artificial sequence
  SiRNA target sequence
tacctgctgataaccaagaaa

SEQ ID NO: 48906 - DNA, 21 bp, Artificial sequence
  SiRNA target sequence
acctgctgataaccaagaaaa

SEQ ID NO: 48907 - DNA, 21 bp, Artificial sequence
  SiRNA target sequence
cctgctgataaccaagaaaac

SEQ ID NO: 48908 - DNA, 21 bp, Artificial sequence
  SiRNA target sequence
ctgctgataaccaagaaaacg

SEQ ID NO: 48909 - DNA, 21 bp, Artificial sequence
  SiRNA target sequence
tgctgataaccaagaaaacga

SEQ ID NO: 48910 - DNA, 21 bp, Artificial sequence
  SiRNA target sequence
gctgataaccaagaaaacgat

SEQ ID NO: 48911 - DNA, 21 bp, Artificial sequence
  SiRNA target sequence
ctgataaccaagaaaacgatt

SEQ ID NO: 48912 - DNA, 21 bp, Artificial sequence
  SiRNA target sequence
tgataaccaagaaaacgattc

SEQ ID NO: 48913 - DNA, 21 bp, Artificial sequence
  SiRNA target sequence
gataaccaagaaaacgattct

SEQ ID NO: 48914 - DNA, 21 bp, Artificial sequence
  SiRNA target sequence
ataaccaagaaaacgattcta

SEQ ID NO: 48915 - DNA, 21 bp, Artificial sequence
  SiRNA target sequence
taaccaagaaaacgattctac

SEQ ID NO: 48916 - DNA, 21 bp, Artificial sequence
  SiRNA target sequence
aaccaagaaaacgattctacc

SEQ ID NO: 48917 - DNA, 21 bp, Artificial sequence
  SiRNA target sequence
accaagaaaacgattctacca

SEQ ID NO: 48918 - DNA, 21 bp, Artificial sequence
  SiRNA target sequence
ccaagaaaacgattctaccaa

SEQ ID NO: 48919 - DNA, 21 bp, Artificial sequence
  SiRNA target sequence
caagaaaacgattctaccaat

SEQ ID NO: 48920 - DNA, 21 bp, Artificial sequence
  SiRNA target sequence
aagaaaacgattctaccaatg

SEQ ID NO: 48921 - DNA, 21 bp, Artificial sequence
  SiRNA target sequence
agaaaacgattctaccaatgt

SEQ ID NO: 48922 - DNA, 21 bp, Artificial sequence
  SiRNA target sequence
gaaaacgattctaccaatgta

SEQ ID NO: 48923 - DNA, 21 bp, Artificial sequence
  SiRNA target sequence
aaaacgattctaccaatgtac

SEQ ID NO: 48924 - DNA, 21 bp, Artificial sequence
  SiRNA target sequence
aaacgattctaccaatgtaca

SEQ ID NO: 48925 - DNA, 21 bp, Artificial sequence
  SiRNA target sequence
aacgattctaccaatgtacat

SEQ ID NO: 48926 - DNA, 21 bp, Artificial sequence
  SiRNA target sequence
acgattctaccaatgtacata

SEQ ID NO: 48927 - DNA, 21 bp, Artificial sequence
  SiRNA target sequence
cgattctaccaatgtacataa

SEQ ID NO: 48928 - DNA, 21 bp, Artificial sequence
  SiRNA target sequence
gattctaccaatgtacataac

SEQ ID NO: 48929 - DNA, 21 bp, Artificial sequence
  SiRNA target sequence
attctaccaatgtacataaca

SEQ ID NO: 48930 - DNA, 21 bp, Artificial sequence
  SiRNA target sequence
ttctaccaatgtacataacac

SEQ ID NO: 48931 - DNA, 21 bp, Artificial sequence
  SiRNA target sequence
tctaccaatgtacataacacg

SEQ ID NO: 48932 - DNA, 21 bp, Artificial sequence
  SiRNA target sequence
ctaccaatgtacataacacga

SEQ ID NO: 48933 - DNA, 21 bp, Artificial sequence
  SiRNA target sequence
taccaatgtacataacacgaa

SEQ ID NO: 48934 - DNA, 21 bp, Artificial sequence
  SiRNA target sequence
accaatgtacataacacgaaa

SEQ ID NO: 48935 - DNA, 21 bp, Artificial sequence
  SiRNA target sequence
ccaatgtacataacacgaaac

SEQ ID NO: 48936 - DNA, 21 bp, Artificial sequence
  SiRNA target sequence
caatgtacataacacgaaact

SEQ ID NO: 48937 - DNA, 21 bp, Artificial sequence
  SiRNA target sequence
aatgtacataacacgaaactc

SEQ ID NO: 48938 - DNA, 21 bp, Artificial sequence
  SiRNA target sequence
atgtacataacacgaaactcg

SEQ ID NO: 48939 - DNA, 21 bp, Artificial sequence
  SiRNA target sequence
tgtacataacacgaaactcgc

SEQ ID NO: 48940 - DNA, 21 bp, Artificial sequence
  SiRNA target sequence
gtacataacacgaaactcgcg

SEQ ID NO: 48941 - DNA, 21 bp, Artificial sequence
  SiRNA target sequence
tacataacacgaaactcgcgt

SEQ ID NO: 48942 - DNA, 21 bp, Artificial sequence
  SiRNA target sequence
acataacacgaaactcgcgtc

SEQ ID NO: 48943 - DNA, 21 bp, Artificial sequence
  SiRNA target sequence
cataacacgaaactcgcgtcg

SEQ ID NO: 48944 - DNA, 21 bp, Artificial sequence
  SiRNA target sequence
ataacacgaaactcgcgtcga

SEQ ID NO: 48945 - DNA, 21 bp, Artificial sequence
  SiRNA target sequence
taacacgaaactcgcgtcgac

SEQ ID NO: 48946 - DNA, 21 bp, Artificial sequence
  SiRNA target sequence
aacacgaaactcgcgtcgacc

SEQ ID NO: 48947 - DNA, 21 bp, Artificial sequence
  SiRNA target sequence
acacgaaactcgcgtcgacct

SEQ ID NO: 48948 - DNA, 21 bp, Artificial sequence
  SiRNA target sequence
cacgaaactcgcgtcgacctc

SEQ ID NO: 48949 - DNA, 21 bp, Artificial sequence
  SiRNA target sequence
acgaaactcgcgtcgacctca

SEQ ID NO: 48950 - DNA, 21 bp, Artificial sequence
  SiRNA target sequence
cgaaactcgcgtcgacctcag

SEQ ID NO: 48951 - DNA, 21 bp, Artificial sequence
  SiRNA target sequence
gaaactcgcgtcgacctcagc

SEQ ID NO: 48952 - DNA, 21 bp, Artificial sequence
  SiRNA target sequence
aaactcgcgtcgacctcagcg

SEQ ID NO: 48953 - DNA, 21 bp, Artificial sequence
  SiRNA target sequence
aactcgcgtcgacctcagcgg

SEQ ID NO: 48954 - DNA, 21 bp, Artificial sequence
  SiRNA target sequence
actcgcgtcgacctcagcgga

SEQ ID NO: 48955 - DNA, 21 bp, Artificial sequence
  SiRNA target sequence
ctcgcgtcgacctcagcggag

SEQ ID NO: 48956 - DNA, 21 bp, Artificial sequence
  SiRNA target sequence
tcgcgtcgacctcagcggaga

SEQ ID NO: 48957 - DNA, 21 bp, Artificial sequence
  SiRNA target sequence
cgcgtcgacctcagcggagaa

SEQ ID NO: 48958 - DNA, 21 bp, Artificial sequence
  SiRNA target sequence
gcgtcgacctcagcggagaat

SEQ ID NO: 48959 - DNA, 21 bp, Artificial sequence
  SiRNA target sequence
cgtcgacctcagcggagaatg

SEQ ID NO: 48960 - DNA, 21 bp, Artificial sequence
  SiRNA target sequence
gtcgacctcagcggagaatgc

SEQ ID NO: 48961 - DNA, 21 bp, Artificial sequence
  SiRNA target sequence
tcgacctcagcggagaatgcc

SEQ ID NO: 48962 - DNA, 21 bp, Artificial sequence
  SiRNA target sequence
cgacctcagcggagaatgcca

SEQ ID NO: 48963 - DNA, 21 bp, Artificial sequence
  SiRNA target sequence
gacctcagcggagaatgccat

SEQ ID NO: 48964 - DNA, 21 bp, Artificial sequence
  SiRNA target sequence
acctcagcggagaatgccatt

SEQ ID NO: 48965 - DNA, 21 bp, Artificial sequence
  SiRNA target sequence
cctcagcggagaatgccattg

SEQ ID NO: 48966 - DNA, 21 bp, Artificial sequence
  SiRNA target sequence
ctcagcggagaatgccattga

SEQ ID NO: 48967 - DNA, 21 bp, Artificial sequence
  SiRNA target sequence
tcagcggagaatgccattgag

SEQ ID NO: 48968 - DNA, 21 bp, Artificial sequence
  SiRNA target sequence
cagcggagaatgccattgaga

SEQ ID NO: 48969 - DNA, 21 bp, Artificial sequence
  SiRNA target sequence
agcggagaatgccattgagaa

SEQ ID NO: 48970 - DNA, 21 bp, Artificial sequence
  SiRNA target sequence
gcggagaatgccattgagaag

SEQ ID NO: 48971 - DNA, 21 bp, Artificial sequence
  SiRNA target sequence
cggagaatgccattgagaagg

SEQ ID NO: 48972 - DNA, 21 bp, Artificial sequence
  SiRNA target sequence
ggagaatgccattgagaagga

SEQ ID NO: 48973 - DNA, 21 bp, Artificial sequence
  SiRNA target sequence
gagaatgccattgagaaggaa

SEQ ID NO: 48974 - DNA, 21 bp, Artificial sequence
  SiRNA target sequence
agaatgccattgagaaggaac

SEQ ID NO: 48975 - DNA, 21 bp, Artificial sequence
  SiRNA target sequence
gaatgccattgagaaggaaca

SEQ ID NO: 48976 - DNA, 21 bp, Artificial sequence
  SiRNA target sequence
aatgccattgagaaggaacaa

SEQ ID NO: 48977 - DNA, 21 bp, Artificial sequence
  SiRNA target sequence
atgccattgagaaggaacaaa

SEQ ID NO: 48978 - DNA, 21 bp, Artificial sequence
  SiRNA target sequence
tgccattgagaaggaacaaat

SEQ ID NO: 48979 - DNA, 21 bp, Artificial sequence
  SiRNA target sequence
gccattgagaaggaacaaatc

SEQ ID NO: 48980 - DNA, 21 bp, Artificial sequence
  SiRNA target sequence
ccattgagaaggaacaaatca

SEQ ID NO: 48981 - DNA, 21 bp, Artificial sequence
  SiRNA target sequence
cattgagaaggaacaaatcac

SEQ ID NO: 48982 - DNA, 21 bp, Artificial sequence
  SiRNA target sequence
attgagaaggaacaaatcacc

SEQ ID NO: 48983 - DNA, 21 bp, Artificial sequence
  SiRNA target sequence
ttgagaaggaacaaatcacca

SEQ ID NO: 48984 - DNA, 21 bp, Artificial sequence
  SiRNA target sequence
tgagaaggaacaaatcaccac

SEQ ID NO: 48985 - DNA, 21 bp, Artificial sequence
  SiRNA target sequence
gagaaggaacaaatcaccacc

SEQ ID NO: 48986 - DNA, 21 bp, Artificial sequence
  SiRNA target sequence
agaaggaacaaatcaccacct

SEQ ID NO: 48987 - DNA, 21 bp, Artificial sequence
  SiRNA target sequence
gaaggaacaaatcaccacctt

SEQ ID NO: 48988 - DNA, 21 bp, Artificial sequence
  SiRNA target sequence
aaggaacaaatcaccaccttt

SEQ ID NO: 48989 - DNA, 21 bp, Artificial sequence
  SiRNA target sequence
aggaacaaatcaccacctttc

SEQ ID NO: 48990 - DNA, 21 bp, Artificial sequence
  SiRNA target sequence
ggaacaaatcaccacctttca

SEQ ID NO: 48991 - DNA, 21 bp, Artificial sequence
  SiRNA target sequence
gaacaaatcaccacctttcat

SEQ ID NO: 48992 - DNA, 21 bp, Artificial sequence
  SiRNA target sequence
aacaaatcaccacctttcatg

SEQ ID NO: 48993 - DNA, 21 bp, Artificial sequence
  SiRNA target sequence
acaaatcaccacctttcatga

SEQ ID NO: 48994 - DNA, 21 bp, Artificial sequence
  SiRNA target sequence
caaatcaccacctttcatgat

SEQ ID NO: 48995 - DNA, 21 bp, Artificial sequence
  SiRNA target sequence
aaatcaccacctttcatgatg

SEQ ID NO: 48996 - DNA, 21 bp, Artificial sequence
  SiRNA target sequence
aatcaccacctttcatgatgt

SEQ ID NO: 48997 - DNA, 21 bp, Artificial sequence
  SiRNA target sequence
atcaccacctttcatgatgtg

SEQ ID NO: 48998 - DNA, 21 bp, Artificial sequence
  SiRNA target sequence
tcaccacctttcatgatgtgg

SEQ ID NO: 48999 - DNA, 21 bp, Artificial sequence
  SiRNA target sequence
caccacctttcatgatgtgga

SEQ ID NO: 49000 - DNA, 21 bp, Artificial sequence
  SiRNA target sequence
accacctttcatgatgtggaa

SEQ ID NO: 49001 - DNA, 21 bp, Artificial sequence
  SiRNA target sequence
ccacctttcatgatgtggaaa

SEQ ID NO: 49002 - DNA, 21 bp, Artificial sequence
  SiRNA target sequence
cacctttcatgatgtggaaac

SEQ ID NO: 49003 - DNA, 21 bp, Artificial sequence
  SiRNA target sequence
acctttcatgatgtggaaact

SEQ ID NO: 49004 - DNA, 21 bp, Artificial sequence
  SiRNA target sequence
cctttcatgatgtggaaactc

SEQ ID NO: 49005 - DNA, 21 bp, Artificial sequence
  SiRNA target sequence
ctttcatgatgtggaaactcc

SEQ ID NO: 49006 - DNA, 21 bp, Artificial sequence
  SiRNA target sequence
tttcatgatgtggaaactcca

SEQ ID NO: 49007 - DNA, 21 bp, Artificial sequence
  SiRNA target sequence
ttcatgatgtggaaactccaa

SEQ ID NO: 49008 - DNA, 21 bp, Artificial sequence
  SiRNA target sequence
tcatgatgtggaaactccaaa

SEQ ID NO: 49009 - DNA, 21 bp, Artificial sequence
  SiRNA target sequence
catgatgtggaaactccaaat

SEQ ID NO: 49010 - DNA, 21 bp, Artificial sequence
  SiRNA target sequence
atgatgtggaaactccaaata

SEQ ID NO: 49011 - DNA, 21 bp, Artificial sequence
  SiRNA target sequence
tgatgtggaaactccaaatag

SEQ ID NO: 49012 - DNA, 21 bp, Artificial sequence
  SiRNA target sequence
gatgtggaaactccaaatagg

SEQ ID NO: 49013 - DNA, 21 bp, Artificial sequence
  SiRNA target sequence
atgtggaaactccaaatagga

SEQ ID NO: 49014 - DNA, 21 bp, Artificial sequence
  SiRNA target sequence
tgtggaaactccaaataggat

SEQ ID NO: 49015 - DNA, 21 bp, Artificial sequence
  SiRNA target sequence
gtggaaactccaaataggatc

SEQ ID NO: 49016 - DNA, 21 bp, Artificial sequence
  SiRNA target sequence
tggaaactccaaataggatcg

SEQ ID NO: 49017 - DNA, 21 bp, Artificial sequence
  SiRNA target sequence
ggaaactccaaataggatcga

SEQ ID NO: 49018 - DNA, 21 bp, Artificial sequence
  SiRNA target sequence
gaaactccaaataggatcgat

SEQ ID NO: 49019 - DNA, 21 bp, Artificial sequence
  SiRNA target sequence
aaactccaaataggatcgata

SEQ ID NO: 49020 - DNA, 21 bp, Artificial sequence
  SiRNA target sequence
aactccaaataggatcgatac

SEQ ID NO: 49021 - DNA, 21 bp, Artificial sequence
  SiRNA target sequence
actccaaataggatcgatacc

SEQ ID NO: 49022 - DNA, 21 bp, Artificial sequence
  SiRNA target sequence
ctccaaataggatcgataccc

SEQ ID NO: 49023 - DNA, 21 bp, Artificial sequence
  SiRNA target sequence
tccaaataggatcgatacccc

SEQ ID NO: 49024 - DNA, 21 bp, Artificial sequence
  SiRNA target sequence
ccaaataggatcgataccccc

SEQ ID NO: 49025 - DNA, 21 bp, Artificial sequence
  SiRNA target sequence
caaataggatcgataccccca

SEQ ID NO: 49026 - DNA, 21 bp, Artificial sequence
  SiRNA target sequence
aaataggatcgatacccccat

SEQ ID NO: 49027 - DNA, 21 bp, Artificial sequence
  SiRNA target sequence
aataggatcgatacccccatg

SEQ ID NO: 49028 - DNA, 21 bp, Artificial sequence
  SiRNA target sequence
ataggatcgatacccccatgg

SEQ ID NO: 49029 - DNA, 21 bp, Artificial sequence
  SiRNA target sequence
taggatcgatacccccatggc

SEQ ID NO: 49030 - DNA, 21 bp, Artificial sequence
  SiRNA target sequence
aggatcgatacccccatggct

SEQ ID NO: 49031 - DNA, 21 bp, Artificial sequence
  SiRNA target sequence
ggatcgatacccccatggctc

SEQ ID NO: 49032 - DNA, 21 bp, Artificial sequence
  SiRNA target sequence
gatcgatacccccatggctca

SEQ ID NO: 49033 - DNA, 21 bp, Artificial sequence
  SiRNA target sequence
atcgatacccccatggctcag

SEQ ID NO: 49034 - DNA, 21 bp, Artificial sequence
  SiRNA target sequence
tcgatacccccatggctcagg

SEQ ID NO: 49035 - DNA, 21 bp, Artificial sequence
  SiRNA target sequence
cgatacccccatggctcagga

SEQ ID NO: 49036 - DNA, 21 bp, Artificial sequence
  SiRNA target sequence
gatacccccatggctcaggat

SEQ ID NO: 49037 - DNA, 21 bp, Artificial sequence
  SiRNA target sequence
atacccccatggctcaggata

SEQ ID NO: 49038 - DNA, 21 bp, Artificial sequence
  SiRNA target sequence
tacccccatggctcaggatac

SEQ ID NO: 49039 - DNA, 21 bp, Artificial sequence
  SiRNA target sequence
acccccatggctcaggatact

SEQ ID NO: 49040 - DNA, 21 bp, Artificial sequence
  SiRNA target sequence
cccccatggctcaggatactt

SEQ ID NO: 49041 - DNA, 21 bp, Artificial sequence
  SiRNA target sequence
ccccatggctcaggatacttc

SEQ ID NO: 49042 - DNA, 21 bp, Artificial sequence
  SiRNA target sequence
cccatggctcaggatacttca

SEQ ID NO: 49043 - DNA, 21 bp, Artificial sequence
  SiRNA target sequence
ccatggctcaggatacttcat

SEQ ID NO: 49044 - DNA, 21 bp, Artificial sequence
  SiRNA target sequence
catggctcaggatacttcatc

SEQ ID NO: 49045 - DNA, 21 bp, Artificial sequence
  SiRNA target sequence
atggctcaggatacttcatcg

SEQ ID NO: 49046 - DNA, 21 bp, Artificial sequence
  SiRNA target sequence
tggctcaggatacttcatcgg

SEQ ID NO: 49047 - DNA, 21 bp, Artificial sequence
  SiRNA target sequence
ggctcaggatacttcatcggc

SEQ ID NO: 49048 - DNA, 21 bp, Artificial sequence
  SiRNA target sequence
gctcaggatacttcatcggct

SEQ ID NO: 49049 - DNA, 21 bp, Artificial sequence
  SiRNA target sequence
ctcaggatacttcatcggcta

SEQ ID NO: 49050 - DNA, 21 bp, Artificial sequence
  SiRNA target sequence
tcaggatacttcatcggctag

SEQ ID NO: 49051 - DNA, 21 bp, Artificial sequence
  SiRNA target sequence
caggatacttcatcggctagg

SEQ ID NO: 49052 - DNA, 21 bp, Artificial sequence
  SiRNA target sequence
aggatacttcatcggctagga

SEQ ID NO: 49053 - DNA, 21 bp, Artificial sequence
  SiRNA target sequence
ggatacttcatcggctaggag

SEQ ID NO: 49054 - DNA, 21 bp, Artificial sequence
  SiRNA target sequence
gatacttcatcggctaggagc

SEQ ID NO: 49055 - DNA, 21 bp, Artificial sequence
  SiRNA target sequence
atacttcatcggctaggagca

SEQ ID NO: 49056 - DNA, 21 bp, Artificial sequence
  SiRNA target sequence
tacttcatcggctaggagcat

SEQ ID NO: 49057 - DNA, 21 bp, Artificial sequence
  SiRNA target sequence
acttcatcggctaggagcatg

SEQ ID NO: 49058 - DNA, 21 bp, Artificial sequence
  SiRNA target sequence
cttcatcggctaggagcatgg

SEQ ID NO: 49059 - DNA, 21 bp, Artificial sequence
  SiRNA target sequence
ttcatcggctaggagcatgga

SEQ ID NO: 49060 - DNA, 21 bp, Artificial sequence
  SiRNA target sequence
tcatcggctaggagcatggat

SEQ ID NO: 49061 - DNA, 21 bp, Artificial sequence
  SiRNA target sequence
catcggctaggagcatggatg

SEQ ID NO: 49062 - DNA, 21 bp, Artificial sequence
  SiRNA target sequence
atcggctaggagcatggatga

SEQ ID NO: 49063 - DNA, 21 bp, Artificial sequence
  SiRNA target sequence
tcggctaggagcatggatgat

SEQ ID NO: 49064 - DNA, 21 bp, Artificial sequence
  SiRNA target sequence
cggctaggagcatggatgata

SEQ ID NO: 49065 - DNA, 21 bp, Artificial sequence
  SiRNA target sequence
ggctaggagcatggatgatac

SEQ ID NO: 49066 - DNA, 21 bp, Artificial sequence
  SiRNA target sequence
gctaggagcatggatgatacg

SEQ ID NO: 49067 - DNA, 21 bp, Artificial sequence
  SiRNA target sequence
ctaggagcatggatgatacgc

SEQ ID NO: 49068 - DNA, 21 bp, Artificial sequence
  SiRNA target sequence
taggagcatggatgatacgca

SEQ ID NO: 49069 - DNA, 21 bp, Artificial sequence
  SiRNA target sequence
aggagcatggatgatacgcac

SEQ ID NO: 49070 - DNA, 21 bp, Artificial sequence
  SiRNA target sequence
ggagcatggatgatacgcaca

SEQ ID NO: 49071 - DNA, 21 bp, Artificial sequence
  SiRNA target sequence
gagcatggatgatacgcacag

SEQ ID NO: 49072 - DNA, 21 bp, Artificial sequence
  SiRNA target sequence
agcatggatgatacgcacagt

SEQ ID NO: 49073 - DNA, 21 bp, Artificial sequence
  SiRNA target sequence
gcatggatgatacgcacagta

SEQ ID NO: 49074 - DNA, 21 bp, Artificial sequence
  SiRNA target sequence
catggatgatacgcacagtat

SEQ ID NO: 49075 - DNA, 21 bp, Artificial sequence
  SiRNA target sequence
atggatgatacgcacagtatt

SEQ ID NO: 49076 - DNA, 21 bp, Artificial sequence
  SiRNA target sequence
tggatgatacgcacagtatta

SEQ ID NO: 49077 - DNA, 21 bp, Artificial sequence
  SiRNA target sequence
ggatgatacgcacagtattat

SEQ ID NO: 49078 - DNA, 21 bp, Artificial sequence
  SiRNA target sequence
gatgatacgcacagtattatt

SEQ ID NO: 49079 - DNA, 21 bp, Artificial sequence
  SiRNA target sequence
atgatacgcacagtattattc

SEQ ID NO: 49080 - DNA, 21 bp, Artificial sequence
  SiRNA target sequence
tgatacgcacagtattattca

SEQ ID NO: 49081 - DNA, 21 bp, Artificial sequence
  SiRNA target sequence
gatacgcacagtattattcag

SEQ ID NO: 49082 - DNA, 21 bp, Artificial sequence
  SiRNA target sequence
atacgcacagtattattcagt

SEQ ID NO: 49083 - DNA, 21 bp, Artificial sequence
  SiRNA target sequence
tacgcacagtattattcagtt

SEQ ID NO: 49084 - DNA, 21 bp, Artificial sequence
  SiRNA target sequence
acgcacagtattattcagttt

SEQ ID NO: 49085 - DNA, 21 bp, Artificial sequence
  SiRNA target sequence
cgcacagtattattcagtttc

SEQ ID NO: 49086 - DNA, 21 bp, Artificial sequence
  SiRNA target sequence
gcacagtattattcagtttct

SEQ ID NO: 49087 - DNA, 21 bp, Artificial sequence
  SiRNA target sequence
cacagtattattcagtttcta

SEQ ID NO: 49088 - DNA, 21 bp, Artificial sequence
  SiRNA target sequence
acagtattattcagtttctac

SEQ ID NO: 49089 - DNA, 21 bp, Artificial sequence
  SiRNA target sequence
cagtattattcagtttctaca

SEQ ID NO: 49090 - DNA, 21 bp, Artificial sequence
  SiRNA target sequence
agtattattcagtttctacaa

SEQ ID NO: 49091 - DNA, 21 bp, Artificial sequence
  SiRNA target sequence
gtattattcagtttctacaac

SEQ ID NO: 49092 - DNA, 21 bp, Artificial sequence
  SiRNA target sequence
tattattcagtttctacaacg

SEQ ID NO: 49093 - DNA, 21 bp, Artificial sequence
  SiRNA target sequence
attattcagtttctacaacgc

SEQ ID NO: 49094 - DNA, 21 bp, Artificial sequence
  SiRNA target sequence
ttattcagtttctacaacgcc

SEQ ID NO: 49095 - DNA, 21 bp, Artificial sequence
  SiRNA target sequence
tattcagtttctacaacgccc

SEQ ID NO: 49096 - DNA, 21 bp, Artificial sequence
  SiRNA target sequence
attcagtttctacaacgcccc

SEQ ID NO: 49097 - DNA, 21 bp, Artificial sequence
  SiRNA target sequence
ttcagtttctacaacgccccg

SEQ ID NO: 49098 - DNA, 21 bp, Artificial sequence
  SiRNA target sequence
tcagtttctacaacgccccgt

SEQ ID NO: 49099 - DNA, 21 bp, Artificial sequence
  SiRNA target sequence
cagtttctacaacgccccgtt

SEQ ID NO: 49100 - DNA, 21 bp, Artificial sequence
  SiRNA target sequence
agtttctacaacgccccgttc

SEQ ID NO: 49101 - DNA, 21 bp, Artificial sequence
  SiRNA target sequence
gtttctacaacgccccgttct

SEQ ID NO: 49102 - DNA, 21 bp, Artificial sequence
  SiRNA target sequence
tttctacaacgccccgttctc

SEQ ID NO: 49103 - DNA, 21 bp, Artificial sequence
  SiRNA target sequence
ttctacaacgccccgttctca

SEQ ID NO: 49104 - DNA, 21 bp, Artificial sequence
  SiRNA target sequence
tctacaacgccccgttctcat

SEQ ID NO: 49105 - DNA, 21 bp, Artificial sequence
  SiRNA target sequence
ctacaacgccccgttctcatt

SEQ ID NO: 49106 - DNA, 21 bp, Artificial sequence
  SiRNA target sequence
tacaacgccccgttctcattg

SEQ ID NO: 49107 - DNA, 21 bp, Artificial sequence
  SiRNA target sequence
acaacgccccgttctcattga

SEQ ID NO: 49108 - DNA, 21 bp, Artificial sequence
  SiRNA target sequence
caacgccccgttctcattgac

SEQ ID NO: 49109 - DNA, 21 bp, Artificial sequence
  SiRNA target sequence
aacgccccgttctcattgaca

SEQ ID NO: 49110 - DNA, 21 bp, Artificial sequence
  SiRNA target sequence
acgccccgttctcattgacaa

SEQ ID NO: 49111 - DNA, 21 bp, Artificial sequence
  SiRNA target sequence
cgccccgttctcattgacaac

SEQ ID NO: 49112 - DNA, 21 bp, Artificial sequence
  SiRNA target sequence
gccccgttctcattgacaaca

SEQ ID NO: 49113 - DNA, 21 bp, Artificial sequence
  SiRNA target sequence
ccccgttctcattgacaacat

SEQ ID NO: 49114 - DNA, 21 bp, Artificial sequence
  SiRNA target sequence
cccgttctcattgacaacatt

SEQ ID NO: 49115 - DNA, 21 bp, Artificial sequence
  SiRNA target sequence
ccgttctcattgacaacattg

SEQ ID NO: 49116 - DNA, 21 bp, Artificial sequence
  SiRNA target sequence
cgttctcattgacaacattga

SEQ ID NO: 49117 - DNA, 21 bp, Artificial sequence
  SiRNA target sequence
gttctcattgacaacattgag

SEQ ID NO: 49118 - DNA, 21 bp, Artificial sequence
  SiRNA target sequence
ttctcattgacaacattgaga

SEQ ID NO: 49119 - DNA, 21 bp, Artificial sequence
  SiRNA target sequence
tctcattgacaacattgagat

SEQ ID NO: 49120 - DNA, 21 bp, Artificial sequence
  SiRNA target sequence
ctcattgacaacattgagatt

SEQ ID NO: 49121 - DNA, 21 bp, Artificial sequence
  SiRNA target sequence
tcattgacaacattgagattg

SEQ ID NO: 49122 - DNA, 21 bp, Artificial sequence
  SiRNA target sequence
cattgacaacattgagattgt

SEQ ID NO: 49123 - DNA, 21 bp, Artificial sequence
  SiRNA target sequence
attgacaacattgagattgtt

SEQ ID NO: 49124 - DNA, 21 bp, Artificial sequence
  SiRNA target sequence
ttgacaacattgagattgttg

SEQ ID NO: 49125 - DNA, 21 bp, Artificial sequence
  SiRNA target sequence
tgacaacattgagattgttgc

SEQ ID NO: 49126 - DNA, 21 bp, Artificial sequence
  SiRNA target sequence
gacaacattgagattgttgca

SEQ ID NO: 49127 - DNA, 21 bp, Artificial sequence
  SiRNA target sequence
acaacattgagattgttgcag

SEQ ID NO: 49128 - DNA, 21 bp, Artificial sequence
  SiRNA target sequence
caacattgagattgttgcagg

SEQ ID NO: 49129 - DNA, 21 bp, Artificial sequence
  SiRNA target sequence
aacattgagattgttgcagga

SEQ ID NO: 49130 - DNA, 21 bp, Artificial sequence
  SiRNA target sequence
acattgagattgttgcaggaa

SEQ ID NO: 49131 - DNA, 21 bp, Artificial sequence
  SiRNA target sequence
cattgagattgttgcaggaac

SEQ ID NO: 49132 - DNA, 21 bp, Artificial sequence
  SiRNA target sequence
attgagattgttgcaggaaca

SEQ ID NO: 49133 - DNA, 21 bp, Artificial sequence
  SiRNA target sequence
ttgagattgttgcaggaacaa

SEQ ID NO: 49134 - DNA, 21 bp, Artificial sequence
  SiRNA target sequence
tgagattgttgcaggaacaac

SEQ ID NO: 49135 - DNA, 21 bp, Artificial sequence
  SiRNA target sequence
gagattgttgcaggaacaact

SEQ ID NO: 49136 - DNA, 21 bp, Artificial sequence
  SiRNA target sequence
agattgttgcaggaacaactg

SEQ ID NO: 49137 - DNA, 21 bp, Artificial sequence
  SiRNA target sequence
gattgttgcaggaacaactgc

SEQ ID NO: 49138 - DNA, 21 bp, Artificial sequence
  SiRNA target sequence
attgttgcaggaacaactgcc

SEQ ID NO: 49139 - DNA, 21 bp, Artificial sequence
  SiRNA target sequence
ttgttgcaggaacaactgccg

SEQ ID NO: 49140 - DNA, 21 bp, Artificial sequence
  SiRNA target sequence
tgttgcaggaacaactgccga

SEQ ID NO: 49141 - DNA, 21 bp, Artificial sequence
  SiRNA target sequence
gttgcaggaacaactgccgat

SEQ ID NO: 49142 - DNA, 21 bp, Artificial sequence
  SiRNA target sequence
ttgcaggaacaactgccgata

SEQ ID NO: 49143 - DNA, 21 bp, Artificial sequence
  SiRNA target sequence
tgcaggaacaactgccgataa

SEQ ID NO: 49144 - DNA, 21 bp, Artificial sequence
  SiRNA target sequence
gcaggaacaactgccgataac

SEQ ID NO: 49145 - DNA, 21 bp, Artificial sequence
  SiRNA target sequence
caggaacaactgccgataaca

SEQ ID NO: 49146 - DNA, 21 bp, Artificial sequence
  SiRNA target sequence
aggaacaactgccgataacaa

SEQ ID NO: 49147 - DNA, 21 bp, Artificial sequence
  SiRNA target sequence
ggaacaactgccgataacaac

SEQ ID NO: 49148 - DNA, 21 bp, Artificial sequence
  SiRNA target sequence
gaacaactgccgataacaaca

SEQ ID NO: 49149 - DNA, 21 bp, Artificial sequence
  SiRNA target sequence
aacaactgccgataacaacac

SEQ ID NO: 49150 - DNA, 21 bp, Artificial sequence
  SiRNA target sequence
acaactgccgataacaacaca

SEQ ID NO: 49151 - DNA, 21 bp, Artificial sequence
  SiRNA target sequence
caactgccgataacaacacag

SEQ ID NO: 49152 - DNA, 21 bp, Artificial sequence
  SiRNA target sequence
aactgccgataacaacacagc

SEQ ID NO: 49153 - DNA, 21 bp, Artificial sequence
  SiRNA target sequence
actgccgataacaacacagca

SEQ ID NO: 49154 - DNA, 21 bp, Artificial sequence
  SiRNA target sequence
ctgccgataacaacacagcac

SEQ ID NO: 49155 - DNA, 21 bp, Artificial sequence
  SiRNA target sequence
tgccgataacaacacagcact

SEQ ID NO: 49156 - DNA, 21 bp, Artificial sequence
  SiRNA target sequence
gccgataacaacacagcactc

SEQ ID NO: 49157 - DNA, 21 bp, Artificial sequence
  SiRNA target sequence
ccgataacaacacagcactca

SEQ ID NO: 49158 - DNA, 21 bp, Artificial sequence
  SiRNA target sequence
cgataacaacacagcactcag

SEQ ID NO: 49159 - DNA, 21 bp, Artificial sequence
  SiRNA target sequence
gataacaacacagcactcagt

SEQ ID NO: 49160 - DNA, 21 bp, Artificial sequence
  SiRNA target sequence
ataacaacacagcactcagta

SEQ ID NO: 49161 - DNA, 21 bp, Artificial sequence
  SiRNA target sequence
taacaacacagcactcagtag

SEQ ID NO: 49162 - DNA, 21 bp, Artificial sequence
  SiRNA target sequence
aacaacacagcactcagtaga

SEQ ID NO: 49163 - DNA, 21 bp, Artificial sequence
  SiRNA target sequence
acaacacagcactcagtagat

SEQ ID NO: 49164 - DNA, 21 bp, Artificial sequence
  SiRNA target sequence
caacacagcactcagtagata

SEQ ID NO: 49165 - DNA, 21 bp, Artificial sequence
  SiRNA target sequence
aacacagcactcagtagatat

SEQ ID NO: 49166 - DNA, 21 bp, Artificial sequence
  SiRNA target sequence
acacagcactcagtagatatg

SEQ ID NO: 49167 - DNA, 21 bp, Artificial sequence
  SiRNA target sequence
cacagcactcagtagatatgt

SEQ ID NO: 49168 - DNA, 21 bp, Artificial sequence
  SiRNA target sequence
acagcactcagtagatatgtg

SEQ ID NO: 49169 - DNA, 21 bp, Artificial sequence
  SiRNA target sequence
cagcactcagtagatatgtgc

SEQ ID NO: 49170 - DNA, 21 bp, Artificial sequence
  SiRNA target sequence
agcactcagtagatatgtgct

SEQ ID NO: 49171 - DNA, 21 bp, Artificial sequence
  SiRNA target sequence
gcactcagtagatatgtgcta

SEQ ID NO: 49172 - DNA, 21 bp, Artificial sequence
  SiRNA target sequence
cactcagtagatatgtgctag

SEQ ID NO: 49173 - DNA, 21 bp, Artificial sequence
  SiRNA target sequence
actcagtagatatgtgctaga

SEQ ID NO: 49174 - DNA, 21 bp, Artificial sequence
  SiRNA target sequence
ctcagtagatatgtgctagat

SEQ ID NO: 49175 - DNA, 21 bp, Artificial sequence
  SiRNA target sequence
tcagtagatatgtgctagata

SEQ ID NO: 49176 - DNA, 21 bp, Artificial sequence
  SiRNA target sequence
cagtagatatgtgctagatag

SEQ ID NO: 49177 - DNA, 21 bp, Artificial sequence
  SiRNA target sequence
agtagatatgtgctagataga

SEQ ID NO: 49178 - DNA, 21 bp, Artificial sequence
  SiRNA target sequence
gtagatatgtgctagatagaa

SEQ ID NO: 49179 - DNA, 21 bp, Artificial sequence
  SiRNA target sequence
tagatatgtgctagatagaac

SEQ ID NO: 49180 - DNA, 21 bp, Artificial sequence
  SiRNA target sequence
agatatgtgctagatagaaca

SEQ ID NO: 49181 - DNA, 21 bp, Artificial sequence
  SiRNA target sequence
gatatgtgctagatagaacaa

SEQ ID NO: 49182 - DNA, 21 bp, Artificial sequence
  SiRNA target sequence
atatgtgctagatagaacaaa

SEQ ID NO: 49183 - DNA, 21 bp, Artificial sequence
  SiRNA target sequence
tatgtgctagatagaacaaac

SEQ ID NO: 49184 - DNA, 21 bp, Artificial sequence
  SiRNA target sequence
atgtgctagatagaacaaacc

SEQ ID NO: 49185 - DNA, 21 bp, Artificial sequence
  SiRNA target sequence
tgtgctagatagaacaaaccc

SEQ ID NO: 49186 - DNA, 21 bp, Artificial sequence
  SiRNA target sequence
gtgctagatagaacaaacccg

SEQ ID NO: 49187 - DNA, 21 bp, Artificial sequence
  SiRNA target sequence
tgctagatagaacaaacccgc

SEQ ID NO: 49188 - DNA, 21 bp, Artificial sequence
  SiRNA target sequence
gctagatagaacaaacccgca

SEQ ID NO: 49189 - DNA, 21 bp, Artificial sequence
  SiRNA target sequence
ctagatagaacaaacccgcaa

SEQ ID NO: 49190 - DNA, 21 bp, Artificial sequence
  SiRNA target sequence
tagatagaacaaacccgcaaa

SEQ ID NO: 49191 - DNA, 21 bp, Artificial sequence
  SiRNA target sequence
agatagaacaaacccgcaaaa

SEQ ID NO: 49192 - DNA, 21 bp, Artificial sequence
  SiRNA target sequence
gatagaacaaacccgcaaaaa

SEQ ID NO: 49193 - DNA, 21 bp, Artificial sequence
  SiRNA target sequence
atagaacaaacccgcaaaaat

SEQ ID NO: 49194 - DNA, 21 bp, Artificial sequence
  SiRNA target sequence
tagaacaaacccgcaaaaata

SEQ ID NO: 49195 - DNA, 21 bp, Artificial sequence
  SiRNA target sequence
agaacaaacccgcaaaaatac

SEQ ID NO: 49196 - DNA, 21 bp, Artificial sequence
  SiRNA target sequence
gaacaaacccgcaaaaataca

SEQ ID NO: 49197 - DNA, 21 bp, Artificial sequence
  SiRNA target sequence
aacaaacccgcaaaaatacat

SEQ ID NO: 49198 - DNA, 21 bp, Artificial sequence
  SiRNA target sequence
acaaacccgcaaaaatacatt

SEQ ID NO: 49199 - DNA, 21 bp, Artificial sequence
  SiRNA target sequence
caaacccgcaaaaatacatta

SEQ ID NO: 49200 - DNA, 21 bp, Artificial sequence
  SiRNA target sequence
aaacccgcaaaaatacattaa

SEQ ID NO: 49201 - DNA, 21 bp, Artificial sequence
  SiRNA target sequence
aacccgcaaaaatacattaaa

SEQ ID NO: 49202 - DNA, 21 bp, Artificial sequence
  SiRNA target sequence
acccgcaaaaatacattaaac

SEQ ID NO: 49203 - DNA, 21 bp, Artificial sequence
  SiRNA target sequence
cccgcaaaaatacattaaaca

SEQ ID NO: 49204 - DNA, 21 bp, Artificial sequence
  SiRNA target sequence
ccgcaaaaatacattaaacaa

SEQ ID NO: 49205 - DNA, 21 bp, Artificial sequence
  SiRNA target sequence
cgcaaaaatacattaaacaat

SEQ ID NO: 49206 - DNA, 21 bp, Artificial sequence
  SiRNA target sequence
gcaaaaatacattaaacaatg

SEQ ID NO: 49207 - DNA, 21 bp, Artificial sequence
  SiRNA target sequence
caaaaatacattaaacaatgg

SEQ ID NO: 49208 - DNA, 21 bp, Artificial sequence
  SiRNA target sequence
aaaaatacattaaacaatgga

SEQ ID NO: 49209 - DNA, 21 bp, Artificial sequence
  SiRNA target sequence
aaaatacattaaacaatggac

SEQ ID NO: 49210 - DNA, 21 bp, Artificial sequence
  SiRNA target sequence
aaatacattaaacaatggaca

SEQ ID NO: 49211 - DNA, 21 bp, Artificial sequence
  SiRNA target sequence
aatacattaaacaatggacat

SEQ ID NO: 49212 - DNA, 21 bp, Artificial sequence
  SiRNA target sequence
atacattaaacaatggacatt

SEQ ID NO: 49213 - DNA, 21 bp, Artificial sequence
  SiRNA target sequence
tacattaaacaatggacatta

SEQ ID NO: 49214 - DNA, 21 bp, Artificial sequence
  SiRNA target sequence
acattaaacaatggacattac

SEQ ID NO: 49215 - DNA, 21 bp, Artificial sequence
  SiRNA target sequence
cattaaacaatggacattacc

SEQ ID NO: 49216 - DNA, 21 bp, Artificial sequence
  SiRNA target sequence
attaaacaatggacattacca

SEQ ID NO: 49217 - DNA, 21 bp, Artificial sequence
  SiRNA target sequence
ttaaacaatggacattaccat

SEQ ID NO: 49218 - DNA, 21 bp, Artificial sequence
  SiRNA target sequence
taaacaatggacattaccatc

SEQ ID NO: 49219 - DNA, 21 bp, Artificial sequence
  SiRNA target sequence
aaacaatggacattaccatca

SEQ ID NO: 49220 - DNA, 21 bp, Artificial sequence
  SiRNA target sequence
aacaatggacattaccatcaa

SEQ ID NO: 49221 - DNA, 21 bp, Artificial sequence
  SiRNA target sequence
acaatggacattaccatcaac

SEQ ID NO: 49222 - DNA, 21 bp, Artificial sequence
  SiRNA target sequence
caatggacattaccatcaaca

SEQ ID NO: 49223 - DNA, 21 bp, Artificial sequence
  SiRNA target sequence
aatggacattaccatcaacag

SEQ ID NO: 49224 - DNA, 21 bp, Artificial sequence
  SiRNA target sequence
atggacattaccatcaacagt

SEQ ID NO: 49225 - DNA, 21 bp, Artificial sequence
  SiRNA target sequence
tggacattaccatcaacagtg

SEQ ID NO: 49226 - DNA, 21 bp, Artificial sequence
  SiRNA target sequence
ggacattaccatcaacagtgt

SEQ ID NO: 49227 - DNA, 21 bp, Artificial sequence
  SiRNA target sequence
gacattaccatcaacagtgtt

SEQ ID NO: 49228 - DNA, 21 bp, Artificial sequence
  SiRNA target sequence
acattaccatcaacagtgttg

SEQ ID NO: 49229 - DNA, 21 bp, Artificial sequence
  SiRNA target sequence
cattaccatcaacagtgttga

SEQ ID NO: 49230 - DNA, 21 bp, Artificial sequence
  SiRNA target sequence
attaccatcaacagtgttgaa

SEQ ID NO: 49231 - DNA, 21 bp, Artificial sequence
  SiRNA target sequence
ttaccatcaacagtgttgaaa

SEQ ID NO: 49232 - DNA, 21 bp, Artificial sequence
  SiRNA target sequence
taccatcaacagtgttgaaag

SEQ ID NO: 49233 - DNA, 21 bp, Artificial sequence
  SiRNA target sequence
accatcaacagtgttgaaagc

SEQ ID NO: 49234 - DNA, 21 bp, Artificial sequence
  SiRNA target sequence
ccatcaacagtgttgaaagct

SEQ ID NO: 49235 - DNA, 21 bp, Artificial sequence
  SiRNA target sequence
catcaacagtgttgaaagctg

SEQ ID NO: 49236 - DNA, 21 bp, Artificial sequence
  SiRNA target sequence
atcaacagtgttgaaagctgg

SEQ ID NO: 49237 - DNA, 21 bp, Artificial sequence
  SiRNA target sequence
tcaacagtgttgaaagctggt

SEQ ID NO: 49238 - DNA, 21 bp, Artificial sequence
  SiRNA target sequence
caacagtgttgaaagctggtg

SEQ ID NO: 49239 - DNA, 21 bp, Artificial sequence
  SiRNA target sequence
aacagtgttgaaagctggtgg

SEQ ID NO: 49240 - DNA, 21 bp, Artificial sequence
  SiRNA target sequence
acagtgttgaaagctggtgga

SEQ ID NO: 49241 - DNA, 21 bp, Artificial sequence
  SiRNA target sequence
cagtgttgaaagctggtggaa

SEQ ID NO: 49242 - DNA, 21 bp, Artificial sequence
  SiRNA target sequence
agtgttgaaagctggtggaaa

SEQ ID NO: 49243 - DNA, 21 bp, Artificial sequence
  SiRNA target sequence
gtgttgaaagctggtggaaaa

SEQ ID NO: 49244 - DNA, 21 bp, Artificial sequence
  SiRNA target sequence
tgttgaaagctggtggaaaag

SEQ ID NO: 49245 - DNA, 21 bp, Artificial sequence
  SiRNA target sequence
gttgaaagctggtggaaaagc

SEQ ID NO: 49246 - DNA, 21 bp, Artificial sequence
  SiRNA target sequence
ttgaaagctggtggaaaagcc

SEQ ID NO: 49247 - DNA, 21 bp, Artificial sequence
  SiRNA target sequence
tgaaagctggtggaaaagccc

SEQ ID NO: 49248 - DNA, 21 bp, Artificial sequence
  SiRNA target sequence
gaaagctggtggaaaagccca

SEQ ID NO: 49249 - DNA, 21 bp, Artificial sequence
  SiRNA target sequence
aaagctggtggaaaagcccaa

SEQ ID NO: 49250 - DNA, 21 bp, Artificial sequence
  SiRNA target sequence
aagctggtggaaaagcccaaa

SEQ ID NO: 49251 - DNA, 21 bp, Artificial sequence
  SiRNA target sequence
agctggtggaaaagcccaaaa

SEQ ID NO: 49252 - DNA, 21 bp, Artificial sequence
  SiRNA target sequence
gctggtggaaaagcccaaaag

SEQ ID NO: 49253 - DNA, 21 bp, Artificial sequence
  SiRNA target sequence
ctggtggaaaagcccaaaagc

SEQ ID NO: 49254 - DNA, 21 bp, Artificial sequence
  SiRNA target sequence
tggtggaaaagcccaaaagct

SEQ ID NO: 49255 - DNA, 21 bp, Artificial sequence
  SiRNA target sequence
ggtggaaaagcccaaaagctt

SEQ ID NO: 49256 - DNA, 21 bp, Artificial sequence
  SiRNA target sequence
gtggaaaagcccaaaagcttg

SEQ ID NO: 49257 - DNA, 21 bp, Artificial sequence
  SiRNA target sequence
tggaaaagcccaaaagcttgc

SEQ ID NO: 49258 - DNA, 21 bp, Artificial sequence
  SiRNA target sequence
ggaaaagcccaaaagcttgcc

SEQ ID NO: 49259 - DNA, 21 bp, Artificial sequence
  SiRNA target sequence
gaaaagcccaaaagcttgcca

SEQ ID NO: 49260 - DNA, 21 bp, Artificial sequence
  SiRNA target sequence
aaaagcccaaaagcttgccaa

SEQ ID NO: 49261 - DNA, 21 bp, Artificial sequence
  SiRNA target sequence
aaagcccaaaagcttgccaac

SEQ ID NO: 49262 - DNA, 21 bp, Artificial sequence
  SiRNA target sequence
aagcccaaaagcttgccaact

SEQ ID NO: 49263 - DNA, 21 bp, Artificial sequence
  SiRNA target sequence
agcccaaaagcttgccaactt

SEQ ID NO: 49264 - DNA, 21 bp, Artificial sequence
  SiRNA target sequence
gcccaaaagcttgccaacttt

SEQ ID NO: 49265 - DNA, 21 bp, Artificial sequence
  SiRNA target sequence
cccaaaagcttgccaacttta

SEQ ID NO: 49266 - DNA, 21 bp, Artificial sequence
  SiRNA target sequence
ccaaaagcttgccaactttaa

SEQ ID NO: 49267 - DNA, 21 bp, Artificial sequence
  SiRNA target sequence
caaaagcttgccaactttaaa

SEQ ID NO: 49268 - DNA, 21 bp, Artificial sequence
  SiRNA target sequence
aaaagcttgccaactttaaat

SEQ ID NO: 49269 - DNA, 21 bp, Artificial sequence
  SiRNA target sequence
aaagcttgccaactttaaata

SEQ ID NO: 49270 - DNA, 21 bp, Artificial sequence
  SiRNA target sequence
aagcttgccaactttaaatat

SEQ ID NO: 49271 - DNA, 21 bp, Artificial sequence
  SiRNA target sequence
agcttgccaactttaaatatt

SEQ ID NO: 49272 - DNA, 21 bp, Artificial sequence
  SiRNA target sequence
gcttgccaactttaaatattt

SEQ ID NO: 49273 - DNA, 21 bp, Artificial sequence
  SiRNA target sequence
cttgccaactttaaatatttg

SEQ ID NO: 49274 - DNA, 21 bp, Artificial sequence
  SiRNA target sequence
ttgccaactttaaatatttgc

SEQ ID NO: 49275 - DNA, 21 bp, Artificial sequence
  SiRNA target sequence
tgccaactttaaatatttgcg

SEQ ID NO: 49276 - DNA, 21 bp, Artificial sequence
  SiRNA target sequence
gccaactttaaatatttgcga

SEQ ID NO: 49277 - DNA, 21 bp, Artificial sequence
  SiRNA target sequence
ccaactttaaatatttgcgat

SEQ ID NO: 49278 - DNA, 21 bp, Artificial sequence
  SiRNA target sequence
caactttaaatatttgcgatg

SEQ ID NO: 49279 - DNA, 21 bp, Artificial sequence
  SiRNA target sequence
aactttaaatatttgcgatgt

SEQ ID NO: 49280 - DNA, 21 bp, Artificial sequence
  SiRNA target sequence
actttaaatatttgcgatgtg

SEQ ID NO: 49281 - DNA, 21 bp, Artificial sequence
  SiRNA target sequence
ctttaaatatttgcgatgtga

SEQ ID NO: 49282 - DNA, 21 bp, Artificial sequence
  SiRNA target sequence
tttaaatatttgcgatgtgat

SEQ ID NO: 49283 - DNA, 21 bp, Artificial sequence
  SiRNA target sequence
ttaaatatttgcgatgtgatg

SEQ ID NO: 49284 - DNA, 21 bp, Artificial sequence
  SiRNA target sequence
taaatatttgcgatgtgatgt

SEQ ID NO: 49285 - DNA, 21 bp, Artificial sequence
  SiRNA target sequence
aaatatttgcgatgtgatgta

SEQ ID NO: 49286 - DNA, 21 bp, Artificial sequence
  SiRNA target sequence
aatatttgcgatgtgatgtac

SEQ ID NO: 49287 - DNA, 21 bp, Artificial sequence
  SiRNA target sequence
atatttgcgatgtgatgtaca

SEQ ID NO: 49288 - DNA, 21 bp, Artificial sequence
  SiRNA target sequence
tatttgcgatgtgatgtacaa

SEQ ID NO: 49289 - DNA, 21 bp, Artificial sequence
  SiRNA target sequence
atttgcgatgtgatgtacaag

SEQ ID NO: 49290 - DNA, 21 bp, Artificial sequence
  SiRNA target sequence
tttgcgatgtgatgtacaagt

SEQ ID NO: 49291 - DNA, 21 bp, Artificial sequence
  SiRNA target sequence
ttgcgatgtgatgtacaagtg

SEQ ID NO: 49292 - DNA, 21 bp, Artificial sequence
  SiRNA target sequence
tgcgatgtgatgtacaagtga

SEQ ID NO: 49293 - DNA, 21 bp, Artificial sequence
  SiRNA target sequence
gcgatgtgatgtacaagtgaa

SEQ ID NO: 49294 - DNA, 21 bp, Artificial sequence
  SiRNA target sequence
cgatgtgatgtacaagtgaaa

SEQ ID NO: 49295 - DNA, 21 bp, Artificial sequence
  SiRNA target sequence
gatgtgatgtacaagtgaaaa

SEQ ID NO: 49296 - DNA, 21 bp, Artificial sequence
  SiRNA target sequence
atgtgatgtacaagtgaaaat

SEQ ID NO: 49297 - DNA, 21 bp, Artificial sequence
  SiRNA target sequence
tgtgatgtacaagtgaaaatt

SEQ ID NO: 49298 - DNA, 21 bp, Artificial sequence
  SiRNA target sequence
gtgatgtacaagtgaaaattg

SEQ ID NO: 49299 - DNA, 21 bp, Artificial sequence
  SiRNA target sequence
tgatgtacaagtgaaaattgt

SEQ ID NO: 49300 - DNA, 21 bp, Artificial sequence
  SiRNA target sequence
gatgtacaagtgaaaattgta

SEQ ID NO: 49301 - DNA, 21 bp, Artificial sequence
  SiRNA target sequence
atgtacaagtgaaaattgtat

SEQ ID NO: 49302 - DNA, 21 bp, Artificial sequence
  SiRNA target sequence
tgtacaagtgaaaattgtatt

SEQ ID NO: 49303 - DNA, 21 bp, Artificial sequence
  SiRNA target sequence
gtacaagtgaaaattgtattg

SEQ ID NO: 49304 - DNA, 21 bp, Artificial sequence
  SiRNA target sequence
tacaagtgaaaattgtattga

SEQ ID NO: 49305 - DNA, 21 bp, Artificial sequence
  SiRNA target sequence
acaagtgaaaattgtattgaa

SEQ ID NO: 49306 - DNA, 21 bp, Artificial sequence
  SiRNA target sequence
caagtgaaaattgtattgaat

SEQ ID NO: 49307 - DNA, 21 bp, Artificial sequence
  SiRNA target sequence
aagtgaaaattgtattgaatg

SEQ ID NO: 49308 - DNA, 21 bp, Artificial sequence
  SiRNA target sequence
agtgaaaattgtattgaatgc

SEQ ID NO: 49309 - DNA, 21 bp, Artificial sequence
  SiRNA target sequence
gtgaaaattgtattgaatgct

SEQ ID NO: 49310 - DNA, 21 bp, Artificial sequence
  SiRNA target sequence
tgaaaattgtattgaatgcta

SEQ ID NO: 49311 - DNA, 21 bp, Artificial sequence
  SiRNA target sequence
gaaaattgtattgaatgctaa

SEQ ID NO: 49312 - DNA, 21 bp, Artificial sequence
  SiRNA target sequence
aaaattgtattgaatgctaat

SEQ ID NO: 49313 - DNA, 21 bp, Artificial sequence
  SiRNA target sequence
aaattgtattgaatgctaatc

SEQ ID NO: 49314 - DNA, 21 bp, Artificial sequence
  SiRNA target sequence
aattgtattgaatgctaatcc

SEQ ID NO: 49315 - DNA, 21 bp, Artificial sequence
  SiRNA target sequence
attgtattgaatgctaatcca

SEQ ID NO: 49316 - DNA, 21 bp, Artificial sequence
  SiRNA target sequence
ttgtattgaatgctaatccat

SEQ ID NO: 49317 - DNA, 21 bp, Artificial sequence
  SiRNA target sequence
tgtattgaatgctaatccatt

SEQ ID NO: 49318 - DNA, 21 bp, Artificial sequence
  SiRNA target sequence
gtattgaatgctaatccattc

SEQ ID NO: 49319 - DNA, 21 bp, Artificial sequence
  SiRNA target sequence
tattgaatgctaatccattca

SEQ ID NO: 49320 - DNA, 21 bp, Artificial sequence
  SiRNA target sequence
attgaatgctaatccattcat

SEQ ID NO: 49321 - DNA, 21 bp, Artificial sequence
  SiRNA target sequence
ttgaatgctaatccattcatt

SEQ ID NO: 49322 - DNA, 21 bp, Artificial sequence
  SiRNA target sequence
tgaatgctaatccattcattg

SEQ ID NO: 49323 - DNA, 21 bp, Artificial sequence
  SiRNA target sequence
gaatgctaatccattcattgc

SEQ ID NO: 49324 - DNA, 21 bp, Artificial sequence
  SiRNA target sequence
aatgctaatccattcattgct

SEQ ID NO: 49325 - DNA, 21 bp, Artificial sequence
  SiRNA target sequence
atgctaatccattcattgctg

SEQ ID NO: 49326 - DNA, 21 bp, Artificial sequence
  SiRNA target sequence
tgctaatccattcattgctgg

SEQ ID NO: 49327 - DNA, 21 bp, Artificial sequence
  SiRNA target sequence
gctaatccattcattgctggt

SEQ ID NO: 49328 - DNA, 21 bp, Artificial sequence
  SiRNA target sequence
ctaatccattcattgctggta

SEQ ID NO: 49329 - DNA, 21 bp, Artificial sequence
  SiRNA target sequence
taatccattcattgctggtag

SEQ ID NO: 49330 - DNA, 21 bp, Artificial sequence
  SiRNA target sequence
aatccattcattgctggtagg

SEQ ID NO: 49331 - DNA, 21 bp, Artificial sequence
  SiRNA target sequence
atccattcattgctggtaggt

SEQ ID NO: 49332 - DNA, 21 bp, Artificial sequence
  SiRNA target sequence
tccattcattgctggtaggtt

SEQ ID NO: 49333 - DNA, 21 bp, Artificial sequence
  SiRNA target sequence
ccattcattgctggtaggtta

SEQ ID NO: 49334 - DNA, 21 bp, Artificial sequence
  SiRNA target sequence
cattcattgctggtaggttat

SEQ ID NO: 49335 - DNA, 21 bp, Artificial sequence
  SiRNA target sequence
attcattgctggtaggttata

SEQ ID NO: 49336 - DNA, 21 bp, Artificial sequence
  SiRNA target sequence
ttcattgctggtaggttatac

SEQ ID NO: 49337 - DNA, 21 bp, Artificial sequence
  SiRNA target sequence
tcattgctggtaggttatacc

SEQ ID NO: 49338 - DNA, 21 bp, Artificial sequence
  SiRNA target sequence
cattgctggtaggttatacct

SEQ ID NO: 49339 - DNA, 21 bp, Artificial sequence
  SiRNA target sequence
attgctggtaggttataccta

SEQ ID NO: 49340 - DNA, 21 bp, Artificial sequence
  SiRNA target sequence
ttgctggtaggttatacctag

SEQ ID NO: 49341 - DNA, 21 bp, Artificial sequence
  SiRNA target sequence
tgctggtaggttatacctagc

SEQ ID NO: 49342 - DNA, 21 bp, Artificial sequence
  SiRNA target sequence
gctggtaggttatacctagca

SEQ ID NO: 49343 - DNA, 21 bp, Artificial sequence
  SiRNA target sequence
ctggtaggttatacctagcat

SEQ ID NO: 49344 - DNA, 21 bp, Artificial sequence
  SiRNA target sequence
tggtaggttatacctagcata

SEQ ID NO: 49345 - DNA, 21 bp, Artificial sequence
  SiRNA target sequence
ggtaggttatacctagcatat

SEQ ID NO: 49346 - DNA, 21 bp, Artificial sequence
  SiRNA target sequence
gtaggttatacctagcatatt

SEQ ID NO: 49347 - DNA, 21 bp, Artificial sequence
  SiRNA target sequence
taggttatacctagcatattc

SEQ ID NO: 49348 - DNA, 21 bp, Artificial sequence
  SiRNA target sequence
aggttatacctagcatattca

SEQ ID NO: 49349 - DNA, 21 bp, Artificial sequence
  SiRNA target sequence
ggttatacctagcatattcac

SEQ ID NO: 49350 - DNA, 21 bp, Artificial sequence
  SiRNA target sequence
gttatacctagcatattcacc

SEQ ID NO: 49351 - DNA, 21 bp, Artificial sequence
  SiRNA target sequence
ttatacctagcatattcacct

SEQ ID NO: 49352 - DNA, 21 bp, Artificial sequence
  SiRNA target sequence
tatacctagcatattcacctt

SEQ ID NO: 49353 - DNA, 21 bp, Artificial sequence
  SiRNA target sequence
atacctagcatattcacctta

SEQ ID NO: 49354 - DNA, 21 bp, Artificial sequence
  SiRNA target sequence
tacctagcatattcaccttat

SEQ ID NO: 49355 - DNA, 21 bp, Artificial sequence
  SiRNA target sequence
acctagcatattcaccttatg

SEQ ID NO: 49356 - DNA, 21 bp, Artificial sequence
  SiRNA target sequence
cctagcatattcaccttatga

SEQ ID NO: 49357 - DNA, 21 bp, Artificial sequence
  SiRNA target sequence
ctagcatattcaccttatgac

SEQ ID NO: 49358 - DNA, 21 bp, Artificial sequence
  SiRNA target sequence
tagcatattcaccttatgacg

SEQ ID NO: 49359 - DNA, 21 bp, Artificial sequence
  SiRNA target sequence
agcatattcaccttatgacga

SEQ ID NO: 49360 - DNA, 21 bp, Artificial sequence
  SiRNA target sequence
gcatattcaccttatgacgac

SEQ ID NO: 49361 - DNA, 21 bp, Artificial sequence
  SiRNA target sequence
catattcaccttatgacgaca

SEQ ID NO: 49362 - DNA, 21 bp, Artificial sequence
  SiRNA target sequence
atattcaccttatgacgacaa

SEQ ID NO: 49363 - DNA, 21 bp, Artificial sequence
  SiRNA target sequence
tattcaccttatgacgacaaa

SEQ ID NO: 49364 - DNA, 21 bp, Artificial sequence
  SiRNA target sequence
attcaccttatgacgacaaag

SEQ ID NO: 49365 - DNA, 21 bp, Artificial sequence
  SiRNA target sequence
ttcaccttatgacgacaaagt

SEQ ID NO: 49366 - DNA, 21 bp, Artificial sequence
  SiRNA target sequence
tcaccttatgacgacaaagta

SEQ ID NO: 49367 - DNA, 21 bp, Artificial sequence
  SiRNA target sequence
caccttatgacgacaaagtag

SEQ ID NO: 49368 - DNA, 21 bp, Artificial sequence
  SiRNA target sequence
accttatgacgacaaagtagc

SEQ ID NO: 49369 - DNA, 21 bp, Artificial sequence
  SiRNA target sequence
ccttatgacgacaaagtagca

SEQ ID NO: 49370 - DNA, 21 bp, Artificial sequence
  SiRNA target sequence
cttatgacgacaaagtagcac

SEQ ID NO: 49371 - DNA, 21 bp, Artificial sequence
  SiRNA target sequence
ttatgacgacaaagtagcacc

SEQ ID NO: 49372 - DNA, 21 bp, Artificial sequence
  SiRNA target sequence
tatgacgacaaagtagcacct

SEQ ID NO: 49373 - DNA, 21 bp, Artificial sequence
  SiRNA target sequence
atgacgacaaagtagcacctg

SEQ ID NO: 49374 - DNA, 21 bp, Artificial sequence
  SiRNA target sequence
tgacgacaaagtagcacctga

SEQ ID NO: 49375 - DNA, 21 bp, Artificial sequence
  SiRNA target sequence
gacgacaaagtagcacctgaa

SEQ ID NO: 49376 - DNA, 21 bp, Artificial sequence
  SiRNA target sequence
acgacaaagtagcacctgaac

SEQ ID NO: 49377 - DNA, 21 bp, Artificial sequence
  SiRNA target sequence
cgacaaagtagcacctgaacg

SEQ ID NO: 49378 - DNA, 21 bp, Artificial sequence
  SiRNA target sequence
gacaaagtagcacctgaacgt

SEQ ID NO: 49379 - DNA, 21 bp, Artificial sequence
  SiRNA target sequence
acaaagtagcacctgaacgta

SEQ ID NO: 49380 - DNA, 21 bp, Artificial sequence
  SiRNA target sequence
caaagtagcacctgaacgtag

SEQ ID NO: 49381 - DNA, 21 bp, Artificial sequence
  SiRNA target sequence
aaagtagcacctgaacgtaga

SEQ ID NO: 49382 - DNA, 21 bp, Artificial sequence
  SiRNA target sequence
aagtagcacctgaacgtagaa

SEQ ID NO: 49383 - DNA, 21 bp, Artificial sequence
  SiRNA target sequence
agtagcacctgaacgtagaat

SEQ ID NO: 49384 - DNA, 21 bp, Artificial sequence
  SiRNA target sequence
gtagcacctgaacgtagaatt

SEQ ID NO: 49385 - DNA, 21 bp, Artificial sequence
  SiRNA target sequence
tagcacctgaacgtagaatta

SEQ ID NO: 49386 - DNA, 21 bp, Artificial sequence
  SiRNA target sequence
agcacctgaacgtagaattat

SEQ ID NO: 49387 - DNA, 21 bp, Artificial sequence
  SiRNA target sequence
gcacctgaacgtagaattatt

SEQ ID NO: 49388 - DNA, 21 bp, Artificial sequence
  SiRNA target sequence
cacctgaacgtagaattattt

SEQ ID NO: 49389 - DNA, 21 bp, Artificial sequence
  SiRNA target sequence
acctgaacgtagaattattta

SEQ ID NO: 49390 - DNA, 21 bp, Artificial sequence
  SiRNA target sequence
cctgaacgtagaattatttat

SEQ ID NO: 49391 - DNA, 21 bp, Artificial sequence
  SiRNA target sequence
ctgaacgtagaattatttata

SEQ ID NO: 49392 - DNA, 21 bp, Artificial sequence
  SiRNA target sequence
tgaacgtagaattatttatac

SEQ ID NO: 49393 - DNA, 21 bp, Artificial sequence
  SiRNA target sequence
gaacgtagaattatttatact

SEQ ID NO: 49394 - DNA, 21 bp, Artificial sequence
  SiRNA target sequence
aacgtagaattatttatactt

SEQ ID NO: 49395 - DNA, 21 bp, Artificial sequence
  SiRNA target sequence
acgtagaattatttatacttc

SEQ ID NO: 49396 - DNA, 21 bp, Artificial sequence
  SiRNA target sequence
cgtagaattatttatacttcc

SEQ ID NO: 49397 - DNA, 21 bp, Artificial sequence
  SiRNA target sequence
gtagaattatttatacttccc

SEQ ID NO: 49398 - DNA, 21 bp, Artificial sequence
  SiRNA target sequence
tagaattatttatacttcccg

SEQ ID NO: 49399 - DNA, 21 bp, Artificial sequence
  SiRNA target sequence
agaattatttatacttcccgt

SEQ ID NO: 49400 - DNA, 21 bp, Artificial sequence
  SiRNA target sequence
gaattatttatacttcccgtg

SEQ ID NO: 49401 - DNA, 21 bp, Artificial sequence
  SiRNA target sequence
aattatttatacttcccgtgc

SEQ ID NO: 49402 - DNA, 21 bp, Artificial sequence
  SiRNA target sequence
attatttatacttcccgtgca

SEQ ID NO: 49403 - DNA, 21 bp, Artificial sequence
  SiRNA target sequence
ttatttatacttcccgtgcag

SEQ ID NO: 49404 - DNA, 21 bp, Artificial sequence
  SiRNA target sequence
tatttatacttcccgtgcagg

SEQ ID NO: 49405 - DNA, 21 bp, Artificial sequence
  SiRNA target sequence
atttatacttcccgtgcaggt

SEQ ID NO: 49406 - DNA, 21 bp, Artificial sequence
  SiRNA target sequence
tttatacttcccgtgcaggtg

SEQ ID NO: 49407 - DNA, 21 bp, Artificial sequence
  SiRNA target sequence
ttatacttcccgtgcaggtgt

SEQ ID NO: 49408 - DNA, 21 bp, Artificial sequence
  SiRNA target sequence
tatacttcccgtgcaggtgtt

SEQ ID NO: 49409 - DNA, 21 bp, Artificial sequence
  SiRNA target sequence
atacttcccgtgcaggtgtta

SEQ ID NO: 49410 - DNA, 21 bp, Artificial sequence
  SiRNA target sequence
tacttcccgtgcaggtgttac

SEQ ID NO: 49411 - DNA, 21 bp, Artificial sequence
  SiRNA target sequence
acttcccgtgcaggtgttaca

SEQ ID NO: 49412 - DNA, 21 bp, Artificial sequence
  SiRNA target sequence
cttcccgtgcaggtgttacag

SEQ ID NO: 49413 - DNA, 21 bp, Artificial sequence
  SiRNA target sequence
ttcccgtgcaggtgttacagg

SEQ ID NO: 49414 - DNA, 21 bp, Artificial sequence
  SiRNA target sequence
tcccgtgcaggtgttacaggt

SEQ ID NO: 49415 - DNA, 21 bp, Artificial sequence
  SiRNA target sequence
cccgtgcaggtgttacaggtt

SEQ ID NO: 49416 - DNA, 21 bp, Artificial sequence
  SiRNA target sequence
ccgtgcaggtgttacaggtta

SEQ ID NO: 49417 - DNA, 21 bp, Artificial sequence
  SiRNA target sequence
cgtgcaggtgttacaggttat

SEQ ID NO: 49418 - DNA, 21 bp, Artificial sequence
  SiRNA target sequence
gtgcaggtgttacaggttatc

SEQ ID NO: 49419 - DNA, 21 bp, Artificial sequence
  SiRNA target sequence
tgcaggtgttacaggttatcc

SEQ ID NO: 49420 - DNA, 21 bp, Artificial sequence
  SiRNA target sequence
gcaggtgttacaggttatccg

SEQ ID NO: 49421 - DNA, 21 bp, Artificial sequence
  SiRNA target sequence
caggtgttacaggttatccgg

SEQ ID NO: 49422 - DNA, 21 bp, Artificial sequence
  SiRNA target sequence
aggtgttacaggttatccggg

SEQ ID NO: 49423 - DNA, 21 bp, Artificial sequence
  SiRNA target sequence
ggtgttacaggttatccggga

SEQ ID NO: 49424 - DNA, 21 bp, Artificial sequence
  SiRNA target sequence
gtgttacaggttatccgggag

SEQ ID NO: 49425 - DNA, 21 bp, Artificial sequence
  SiRNA target sequence
tgttacaggttatccgggagt

SEQ ID NO: 49426 - DNA, 21 bp, Artificial sequence
  SiRNA target sequence
gttacaggttatccgggagtc

SEQ ID NO: 49427 - DNA, 21 bp, Artificial sequence
  SiRNA target sequence
ttacaggttatccgggagtcg

SEQ ID NO: 49428 - DNA, 21 bp, Artificial sequence
  SiRNA target sequence
tacaggttatccgggagtcga

SEQ ID NO: 49429 - DNA, 21 bp, Artificial sequence
  SiRNA target sequence
acaggttatccgggagtcgaa

SEQ ID NO: 49430 - DNA, 21 bp, Artificial sequence
  SiRNA target sequence
caggttatccgggagtcgaac

SEQ ID NO: 49431 - DNA, 21 bp, Artificial sequence
  SiRNA target sequence
aggttatccgggagtcgaact

SEQ ID NO: 49432 - DNA, 21 bp, Artificial sequence
  SiRNA target sequence
ggttatccgggagtcgaacta

SEQ ID NO: 49433 - DNA, 21 bp, Artificial sequence
  SiRNA target sequence
gttatccgggagtcgaactag

SEQ ID NO: 49434 - DNA, 21 bp, Artificial sequence
  SiRNA target sequence
ttatccgggagtcgaactaga

SEQ ID NO: 49435 - DNA, 21 bp, Artificial sequence
  SiRNA target sequence
tatccgggagtcgaactagat

SEQ ID NO: 49436 - DNA, 21 bp, Artificial sequence
  SiRNA target sequence
atccgggagtcgaactagatt

SEQ ID NO: 49437 - DNA, 21 bp, Artificial sequence
  SiRNA target sequence
tccgggagtcgaactagattt

SEQ ID NO: 49438 - DNA, 21 bp, Artificial sequence
  SiRNA target sequence
ccgggagtcgaactagatttc

SEQ ID NO: 49439 - DNA, 21 bp, Artificial sequence
  SiRNA target sequence
cgggagtcgaactagatttcc

SEQ ID NO: 49440 - DNA, 21 bp, Artificial sequence
  SiRNA target sequence
gggagtcgaactagatttcca

SEQ ID NO: 49441 - DNA, 21 bp, Artificial sequence
  SiRNA target sequence
ggagtcgaactagatttccaa

SEQ ID NO: 49442 - DNA, 21 bp, Artificial sequence
  SiRNA target sequence
gagtcgaactagatttccaat

SEQ ID NO: 49443 - DNA, 21 bp, Artificial sequence
  SiRNA target sequence
agtcgaactagatttccaatt

SEQ ID NO: 49444 - DNA, 21 bp, Artificial sequence
  SiRNA target sequence
gtcgaactagatttccaatta

SEQ ID NO: 49445 - DNA, 21 bp, Artificial sequence
  SiRNA target sequence
tcgaactagatttccaattag

SEQ ID NO: 49446 - DNA, 21 bp, Artificial sequence
  SiRNA target sequence
cgaactagatttccaattaga

SEQ ID NO: 49447 - DNA, 21 bp, Artificial sequence
  SiRNA target sequence
gaactagatttccaattagac

SEQ ID NO: 49448 - DNA, 21 bp, Artificial sequence
  SiRNA target sequence
aactagatttccaattagaca

SEQ ID NO: 49449 - DNA, 21 bp, Artificial sequence
  SiRNA target sequence
actagatttccaattagacaa

SEQ ID NO: 49450 - DNA, 21 bp, Artificial sequence
  SiRNA target sequence
ctagatttccaattagacaat

SEQ ID NO: 49451 - DNA, 21 bp, Artificial sequence
  SiRNA target sequence
tagatttccaattagacaatt

SEQ ID NO: 49452 - DNA, 21 bp, Artificial sequence
  SiRNA target sequence
agatttccaattagacaattc

SEQ ID NO: 49453 - DNA, 21 bp, Artificial sequence
  SiRNA target sequence
gatttccaattagacaattca

SEQ ID NO: 49454 - DNA, 21 bp, Artificial sequence
  SiRNA target sequence
atttccaattagacaattcag

SEQ ID NO: 49455 - DNA, 21 bp, Artificial sequence
  SiRNA target sequence
tttccaattagacaattcagt

SEQ ID NO: 49456 - DNA, 21 bp, Artificial sequence
  SiRNA target sequence
ttccaattagacaattcagtt

SEQ ID NO: 49457 - DNA, 21 bp, Artificial sequence
  SiRNA target sequence
tccaattagacaattcagttg

SEQ ID NO: 49458 - DNA, 21 bp, Artificial sequence
  SiRNA target sequence
ccaattagacaattcagttga

SEQ ID NO: 49459 - DNA, 21 bp, Artificial sequence
  SiRNA target sequence
caattagacaattcagttgag

SEQ ID NO: 49460 - DNA, 21 bp, Artificial sequence
  SiRNA target sequence
aattagacaattcagttgaga

SEQ ID NO: 49461 - DNA, 21 bp, Artificial sequence
  SiRNA target sequence
attagacaattcagttgagat

SEQ ID NO: 49462 - DNA, 21 bp, Artificial sequence
  SiRNA target sequence
ttagacaattcagttgagatg

SEQ ID NO: 49463 - DNA, 21 bp, Artificial sequence
  SiRNA target sequence
tagacaattcagttgagatga

SEQ ID NO: 49464 - DNA, 21 bp, Artificial sequence
  SiRNA target sequence
agacaattcagttgagatgac

SEQ ID NO: 49465 - DNA, 21 bp, Artificial sequence
  SiRNA target sequence
gacaattcagttgagatgact

SEQ ID NO: 49466 - DNA, 21 bp, Artificial sequence
  SiRNA target sequence
acaattcagttgagatgacta

SEQ ID NO: 49467 - DNA, 21 bp, Artificial sequence
  SiRNA target sequence
caattcagttgagatgactat

SEQ ID NO: 49468 - DNA, 21 bp, Artificial sequence
  SiRNA target sequence
aattcagttgagatgactatt

SEQ ID NO: 49469 - DNA, 21 bp, Artificial sequence
  SiRNA target sequence
attcagttgagatgactattc

SEQ ID NO: 49470 - DNA, 21 bp, Artificial sequence
  SiRNA target sequence
ttcagttgagatgactattcc

SEQ ID NO: 49471 - DNA, 21 bp, Artificial sequence
  SiRNA target sequence
tcagttgagatgactattcca

SEQ ID NO: 49472 - DNA, 21 bp, Artificial sequence
  SiRNA target sequence
cagttgagatgactattccat

SEQ ID NO: 49473 - DNA, 21 bp, Artificial sequence
  SiRNA target sequence
agttgagatgactattccata

SEQ ID NO: 49474 - DNA, 21 bp, Artificial sequence
  SiRNA target sequence
gttgagatgactattccatat

SEQ ID NO: 49475 - DNA, 21 bp, Artificial sequence
  SiRNA target sequence
ttgagatgactattccatatg

SEQ ID NO: 49476 - DNA, 21 bp, Artificial sequence
  SiRNA target sequence
tgagatgactattccatatgc

SEQ ID NO: 49477 - DNA, 21 bp, Artificial sequence
  SiRNA target sequence
gagatgactattccatatgca

SEQ ID NO: 49478 - DNA, 21 bp, Artificial sequence
  SiRNA target sequence
agatgactattccatatgcat

SEQ ID NO: 49479 - DNA, 21 bp, Artificial sequence
  SiRNA target sequence
gatgactattccatatgcatc

SEQ ID NO: 49480 - DNA, 21 bp, Artificial sequence
  SiRNA target sequence
atgactattccatatgcatct

SEQ ID NO: 49481 - DNA, 21 bp, Artificial sequence
  SiRNA target sequence
tgactattccatatgcatctt

SEQ ID NO: 49482 - DNA, 21 bp, Artificial sequence
  SiRNA target sequence
gactattccatatgcatcttt

SEQ ID NO: 49483 - DNA, 21 bp, Artificial sequence
  SiRNA target sequence
actattccatatgcatctttt

SEQ ID NO: 49484 - DNA, 21 bp, Artificial sequence
  SiRNA target sequence
ctattccatatgcatcttttc

SEQ ID NO: 49485 - DNA, 21 bp, Artificial sequence
  SiRNA target sequence
tattccatatgcatcttttca

SEQ ID NO: 49486 - DNA, 21 bp, Artificial sequence
  SiRNA target sequence
attccatatgcatcttttcaa

SEQ ID NO: 49487 - DNA, 21 bp, Artificial sequence
  SiRNA target sequence
ttccatatgcatcttttcaag

SEQ ID NO: 49488 - DNA, 21 bp, Artificial sequence
  SiRNA target sequence
tccatatgcatcttttcaaga

SEQ ID NO: 49489 - DNA, 21 bp, Artificial sequence
  SiRNA target sequence
ccatatgcatcttttcaagaa

SEQ ID NO: 49490 - DNA, 21 bp, Artificial sequence
  SiRNA target sequence
catatgcatcttttcaagaag

SEQ ID NO: 49491 - DNA, 21 bp, Artificial sequence
  SiRNA target sequence
atatgcatcttttcaagaagc

SEQ ID NO: 49492 - DNA, 21 bp, Artificial sequence
  SiRNA target sequence
tatgcatcttttcaagaagca

SEQ ID NO: 49493 - DNA, 21 bp, Artificial sequence
  SiRNA target sequence
atgcatcttttcaagaagcat

SEQ ID NO: 49494 - DNA, 21 bp, Artificial sequence
  SiRNA target sequence
tgcatcttttcaagaagcata

SEQ ID NO: 49495 - DNA, 21 bp, Artificial sequence
  SiRNA target sequence
gcatcttttcaagaagcatat

SEQ ID NO: 49496 - DNA, 21 bp, Artificial sequence
  SiRNA target sequence
catcttttcaagaagcatatg

SEQ ID NO: 49497 - DNA, 21 bp, Artificial sequence
  SiRNA target sequence
atcttttcaagaagcatatga

SEQ ID NO: 49498 - DNA, 21 bp, Artificial sequence
  SiRNA target sequence
tcttttcaagaagcatatgat

SEQ ID NO: 49499 - DNA, 21 bp, Artificial sequence
  SiRNA target sequence
cttttcaagaagcatatgatt

SEQ ID NO: 49500 - DNA, 21 bp, Artificial sequence
  SiRNA target sequence
ttttcaagaagcatatgattt

SEQ ID NO: 49501 - DNA, 21 bp, Artificial sequence
  SiRNA target sequence
tttcaagaagcatatgattta

SEQ ID NO: 49502 - DNA, 21 bp, Artificial sequence
  SiRNA target sequence
ttcaagaagcatatgatttag

SEQ ID NO: 49503 - DNA, 21 bp, Artificial sequence
  SiRNA target sequence
tcaagaagcatatgatttagt

SEQ ID NO: 49504 - DNA, 21 bp, Artificial sequence
  SiRNA target sequence
caagaagcatatgatttagtt

SEQ ID NO: 49505 - DNA, 21 bp, Artificial sequence
  SiRNA target sequence
aagaagcatatgatttagtta

SEQ ID NO: 49506 - DNA, 21 bp, Artificial sequence
  SiRNA target sequence
agaagcatatgatttagttag

SEQ ID NO: 49507 - DNA, 21 bp, Artificial sequence
  SiRNA target sequence
gaagcatatgatttagttagt

SEQ ID NO: 49508 - DNA, 21 bp, Artificial sequence
  SiRNA target sequence
aagcatatgatttagttagtg

SEQ ID NO: 49509 - DNA, 21 bp, Artificial sequence
  SiRNA target sequence
agcatatgatttagttagtgg

SEQ ID NO: 49510 - DNA, 21 bp, Artificial sequence
  SiRNA target sequence
gcatatgatttagttagtggg

SEQ ID NO: 49511 - DNA, 21 bp, Artificial sequence
  SiRNA target sequence
catatgatttagttagtggga

SEQ ID NO: 49512 - DNA, 21 bp, Artificial sequence
  SiRNA target sequence
atatgatttagttagtgggaa

SEQ ID NO: 49513 - DNA, 21 bp, Artificial sequence
  SiRNA target sequence
tatgatttagttagtgggaat

SEQ ID NO: 49514 - DNA, 21 bp, Artificial sequence
  SiRNA target sequence
atgatttagttagtgggaatg

SEQ ID NO: 49515 - DNA, 21 bp, Artificial sequence
  SiRNA target sequence
tgatttagttagtgggaatga

SEQ ID NO: 49516 - DNA, 21 bp, Artificial sequence
  SiRNA target sequence
gatttagttagtgggaatgaa

SEQ ID NO: 49517 - DNA, 21 bp, Artificial sequence
  SiRNA target sequence
atttagttagtgggaatgaag

SEQ ID NO: 49518 - DNA, 21 bp, Artificial sequence
  SiRNA target sequence
tttagttagtgggaatgaaga

SEQ ID NO: 49519 - DNA, 21 bp, Artificial sequence
  SiRNA target sequence
ttagttagtgggaatgaagat

SEQ ID NO: 49520 - DNA, 21 bp, Artificial sequence
  SiRNA target sequence
tagttagtgggaatgaagatt

SEQ ID NO: 49521 - DNA, 21 bp, Artificial sequence
  SiRNA target sequence
agttagtgggaatgaagattt

SEQ ID NO: 49522 - DNA, 21 bp, Artificial sequence
  SiRNA target sequence
gttagtgggaatgaagatttt

SEQ ID NO: 49523 - DNA, 21 bp, Artificial sequence
  SiRNA target sequence
ttagtgggaatgaagattttg

SEQ ID NO: 49524 - DNA, 21 bp, Artificial sequence
  SiRNA target sequence
tagtgggaatgaagattttgt

SEQ ID NO: 49525 - DNA, 21 bp, Artificial sequence
  SiRNA target sequence
agtgggaatgaagattttgtg

SEQ ID NO: 49526 - DNA, 21 bp, Artificial sequence
  SiRNA target sequence
gtgggaatgaagattttgtgc

SEQ ID NO: 49527 - DNA, 21 bp, Artificial sequence
  SiRNA target sequence
tgggaatgaagattttgtgca

SEQ ID NO: 49528 - DNA, 21 bp, Artificial sequence
  SiRNA target sequence
gggaatgaagattttgtgcag

SEQ ID NO: 49529 - DNA, 21 bp, Artificial sequence
  SiRNA target sequence
ggaatgaagattttgtgcagt

SEQ ID NO: 49530 - DNA, 21 bp, Artificial sequence
  SiRNA target sequence
gaatgaagattttgtgcagtt

SEQ ID NO: 49531 - DNA, 21 bp, Artificial sequence
  SiRNA target sequence
aatgaagattttgtgcagttg

SEQ ID NO: 49532 - DNA, 21 bp, Artificial sequence
  SiRNA target sequence
atgaagattttgtgcagttgt

SEQ ID NO: 49533 - DNA, 21 bp, Artificial sequence
  SiRNA target sequence
tgaagattttgtgcagttgta

SEQ ID NO: 49534 - DNA, 21 bp, Artificial sequence
  SiRNA target sequence
gaagattttgtgcagttgtac

SEQ ID NO: 49535 - DNA, 21 bp, Artificial sequence
  SiRNA target sequence
aagattttgtgcagttgtacc

SEQ ID NO: 49536 - DNA, 21 bp, Artificial sequence
  SiRNA target sequence
agattttgtgcagttgtacct

SEQ ID NO: 49537 - DNA, 21 bp, Artificial sequence
  SiRNA target sequence
gattttgtgcagttgtacctt

SEQ ID NO: 49538 - DNA, 21 bp, Artificial sequence
  SiRNA target sequence
attttgtgcagttgtaccttt

SEQ ID NO: 49539 - DNA, 21 bp, Artificial sequence
  SiRNA target sequence
ttttgtgcagttgtacctttt

SEQ ID NO: 49540 - DNA, 21 bp, Artificial sequence
  SiRNA target sequence
tttgtgcagttgtaccttttt

SEQ ID NO: 49541 - DNA, 21 bp, Artificial sequence
  SiRNA target sequence
ttgtgcagttgtaccttttta

SEQ ID NO: 49542 - DNA, 21 bp, Artificial sequence
  SiRNA target sequence
tgtgcagttgtacctttttac

SEQ ID NO: 49543 - DNA, 21 bp, Artificial sequence
  SiRNA target sequence
gtgcagttgtacctttttaca

SEQ ID NO: 49544 - DNA, 21 bp, Artificial sequence
  SiRNA target sequence
tgcagttgtacctttttacaa

SEQ ID NO: 49545 - DNA, 21 bp, Artificial sequence
  SiRNA target sequence
gcagttgtacctttttacaat

SEQ ID NO: 49546 - DNA, 21 bp, Artificial sequence
  SiRNA target sequence
cagttgtacctttttacaatt

SEQ ID NO: 49547 - DNA, 21 bp, Artificial sequence
  SiRNA target sequence
agttgtacctttttacaattg

SEQ ID NO: 49548 - DNA, 21 bp, Artificial sequence
  SiRNA target sequence
gttgtacctttttacaattgc

SEQ ID NO: 49549 - DNA, 21 bp, Artificial sequence
  SiRNA target sequence
ttgtacctttttacaattgca

SEQ ID NO: 49550 - DNA, 21 bp, Artificial sequence
  SiRNA target sequence
tgtacctttttacaattgcac

SEQ ID NO: 49551 - DNA, 21 bp, Artificial sequence
  SiRNA target sequence
gtacctttttacaattgcacc

SEQ ID NO: 49552 - DNA, 21 bp, Artificial sequence
  SiRNA target sequence
tacctttttacaattgcaccg

SEQ ID NO: 49553 - DNA, 21 bp, Artificial sequence
  SiRNA target sequence
acctttttacaattgcaccgg

SEQ ID NO: 49554 - DNA, 21 bp, Artificial sequence
  SiRNA target sequence
cctttttacaattgcaccggt

SEQ ID NO: 49555 - DNA, 21 bp, Artificial sequence
  SiRNA target sequence
ctttttacaattgcaccggtt

SEQ ID NO: 49556 - DNA, 21 bp, Artificial sequence
  SiRNA target sequence
tttttacaattgcaccggttt

SEQ ID NO: 49557 - DNA, 21 bp, Artificial sequence
  SiRNA target sequence
ttttacaattgcaccggtttt

SEQ ID NO: 49558 - DNA, 21 bp, Artificial sequence
  SiRNA target sequence
tttacaattgcaccggttttg

SEQ ID NO: 49559 - DNA, 21 bp, Artificial sequence
  SiRNA target sequence
ttacaattgcaccggttttgg

SEQ ID NO: 49560 - DNA, 21 bp, Artificial sequence
  SiRNA target sequence
tacaattgcaccggttttggg

SEQ ID NO: 49561 - DNA, 21 bp, Artificial sequence
  SiRNA target sequence
acaattgcaccggttttggga

SEQ ID NO: 49562 - DNA, 21 bp, Artificial sequence
  SiRNA target sequence
caattgcaccggttttgggac

SEQ ID NO: 49563 - DNA, 21 bp, Artificial sequence
  SiRNA target sequence
aattgcaccggttttgggacc

SEQ ID NO: 49564 - DNA, 21 bp, Artificial sequence
  SiRNA target sequence
attgcaccggttttgggacct

SEQ ID NO: 49565 - DNA, 21 bp, Artificial sequence
  SiRNA target sequence
ttgcaccggttttgggacctt

SEQ ID NO: 49566 - DNA, 21 bp, Artificial sequence
  SiRNA target sequence
tgcaccggttttgggaccttc

SEQ ID NO: 49567 - DNA, 21 bp, Artificial sequence
  SiRNA target sequence
gcaccggttttgggaccttca

SEQ ID NO: 49568 - DNA, 21 bp, Artificial sequence
  SiRNA target sequence
caccggttttgggaccttcag

SEQ ID NO: 49569 - DNA, 21 bp, Artificial sequence
  SiRNA target sequence
accggttttgggaccttcagc

SEQ ID NO: 49570 - DNA, 21 bp, Artificial sequence
  SiRNA target sequence
ccggttttgggaccttcagct

SEQ ID NO: 49571 - DNA, 21 bp, Artificial sequence
  SiRNA target sequence
cggttttgggaccttcagctg

SEQ ID NO: 49572 - DNA, 21 bp, Artificial sequence
  SiRNA target sequence
ggttttgggaccttcagctga

SEQ ID NO: 49573 - DNA, 21 bp, Artificial sequence
  SiRNA target sequence
gttttgggaccttcagctgaa

SEQ ID NO: 49574 - DNA, 21 bp, Artificial sequence
  SiRNA target sequence
ttttgggaccttcagctgaat

SEQ ID NO: 49575 - DNA, 21 bp, Artificial sequence
  SiRNA target sequence
tttgggaccttcagctgaatc

SEQ ID NO: 49576 - DNA, 21 bp, Artificial sequence
  SiRNA target sequence
ttgggaccttcagctgaatca

SEQ ID NO: 49577 - DNA, 21 bp, Artificial sequence
  SiRNA target sequence
tgggaccttcagctgaatcag

SEQ ID NO: 49578 - DNA, 21 bp, Artificial sequence
  SiRNA target sequence
gggaccttcagctgaatcagc

SEQ ID NO: 49579 - DNA, 21 bp, Artificial sequence
  SiRNA target sequence
ggaccttcagctgaatcagcg

SEQ ID NO: 49580 - DNA, 21 bp, Artificial sequence
  SiRNA target sequence
gaccttcagctgaatcagcga

SEQ ID NO: 49581 - DNA, 21 bp, Artificial sequence
  SiRNA target sequence
accttcagctgaatcagcgaa

SEQ ID NO: 49582 - DNA, 21 bp, Artificial sequence
  SiRNA target sequence
ccttcagctgaatcagcgaat

SEQ ID NO: 49583 - DNA, 21 bp, Artificial sequence
  SiRNA target sequence
cttcagctgaatcagcgaatt

SEQ ID NO: 49584 - DNA, 21 bp, Artificial sequence
  SiRNA target sequence
ttcagctgaatcagcgaattc

SEQ ID NO: 49585 - DNA, 21 bp, Artificial sequence
  SiRNA target sequence
tcagctgaatcagcgaattca

SEQ ID NO: 49586 - DNA, 21 bp, Artificial sequence
  SiRNA target sequence
cagctgaatcagcgaattcaa

SEQ ID NO: 49587 - DNA, 21 bp, Artificial sequence
  SiRNA target sequence
agctgaatcagcgaattcaaa

SEQ ID NO: 49588 - DNA, 21 bp, Artificial sequence
  SiRNA target sequence
gctgaatcagcgaattcaaaa

SEQ ID NO: 49589 - DNA, 21 bp, Artificial sequence
  SiRNA target sequence
ctgaatcagcgaattcaaaag

SEQ ID NO: 49590 - DNA, 21 bp, Artificial sequence
  SiRNA target sequence
tgaatcagcgaattcaaaagt

SEQ ID NO: 49591 - DNA, 21 bp, Artificial sequence
  SiRNA target sequence
gaatcagcgaattcaaaagta

SEQ ID NO: 49592 - DNA, 21 bp, Artificial sequence
  SiRNA target sequence
aatcagcgaattcaaaagtag

SEQ ID NO: 49593 - DNA, 21 bp, Artificial sequence
  SiRNA target sequence
atcagcgaattcaaaagtaga

SEQ ID NO: 49594 - DNA, 21 bp, Artificial sequence
  SiRNA target sequence
tcagcgaattcaaaagtagac

SEQ ID NO: 49595 - DNA, 21 bp, Artificial sequence
  SiRNA target sequence
cagcgaattcaaaagtagacc

SEQ ID NO: 49596 - DNA, 21 bp, Artificial sequence
  SiRNA target sequence
agcgaattcaaaagtagacct

SEQ ID NO: 49597 - DNA, 21 bp, Artificial sequence
  SiRNA target sequence
gcgaattcaaaagtagacctt

SEQ ID NO: 49598 - DNA, 21 bp, Artificial sequence
  SiRNA target sequence
cgaattcaaaagtagaccttt

SEQ ID NO: 49599 - DNA, 21 bp, Artificial sequence
  SiRNA target sequence
gaattcaaaagtagacctttc

SEQ ID NO: 49600 - DNA, 21 bp, Artificial sequence
  SiRNA target sequence
aattcaaaagtagacctttca

SEQ ID NO: 49601 - DNA, 21 bp, Artificial sequence
  SiRNA target sequence
attcaaaagtagacctttcag

SEQ ID NO: 49602 - DNA, 21 bp, Artificial sequence
  SiRNA target sequence
ttcaaaagtagacctttcagt

SEQ ID NO: 49603 - DNA, 21 bp, Artificial sequence
  SiRNA target sequence
tcaaaagtagacctttcagtc

SEQ ID NO: 49604 - DNA, 21 bp, Artificial sequence
  SiRNA target sequence
caaaagtagacctttcagtct

SEQ ID NO: 49605 - DNA, 21 bp, Artificial sequence
  SiRNA target sequence
aaaagtagacctttcagtcta

SEQ ID NO: 49606 - DNA, 21 bp, Artificial sequence
  SiRNA target sequence
aaagtagacctttcagtctat

SEQ ID NO: 49607 - DNA, 21 bp, Artificial sequence
  SiRNA target sequence
aagtagacctttcagtctata

SEQ ID NO: 49608 - DNA, 21 bp, Artificial sequence
  SiRNA target sequence
agtagacctttcagtctatat

SEQ ID NO: 49609 - DNA, 21 bp, Artificial sequence
  SiRNA target sequence
gtagacctttcagtctatatg

SEQ ID NO: 49610 - DNA, 21 bp, Artificial sequence
  SiRNA target sequence
tagacctttcagtctatatgt

SEQ ID NO: 49611 - DNA, 21 bp, Artificial sequence
  SiRNA target sequence
agacctttcagtctatatgtg

SEQ ID NO: 49612 - DNA, 21 bp, Artificial sequence
  SiRNA target sequence
gacctttcagtctatatgtgg

SEQ ID NO: 49613 - DNA, 21 bp, Artificial sequence
  SiRNA target sequence
acctttcagtctatatgtggt

SEQ ID NO: 49614 - DNA, 21 bp, Artificial sequence
  SiRNA target sequence
cctttcagtctatatgtggtt

SEQ ID NO: 49615 - DNA, 21 bp, Artificial sequence
  SiRNA target sequence
ctttcagtctatatgtggtta

SEQ ID NO: 49616 - DNA, 21 bp, Artificial sequence
  SiRNA target sequence
tttcagtctatatgtggttag

SEQ ID NO: 49617 - DNA, 21 bp, Artificial sequence
  SiRNA target sequence
ttcagtctatatgtggttaga

SEQ ID NO: 49618 - DNA, 21 bp, Artificial sequence
  SiRNA target sequence
tcagtctatatgtggttagat

SEQ ID NO: 49619 - DNA, 21 bp, Artificial sequence
  SiRNA target sequence
cagtctatatgtggttagata

SEQ ID NO: 49620 - DNA, 21 bp, Artificial sequence
  SiRNA target sequence
agtctatatgtggttagataa

SEQ ID NO: 49621 - DNA, 21 bp, Artificial sequence
  SiRNA target sequence
gtctatatgtggttagataac

SEQ ID NO: 49622 - DNA, 21 bp, Artificial sequence
  SiRNA target sequence
tctatatgtggttagataaca

SEQ ID NO: 49623 - DNA, 21 bp, Artificial sequence
  SiRNA target sequence
ctatatgtggttagataacat

SEQ ID NO: 49624 - DNA, 21 bp, Artificial sequence
  SiRNA target sequence
tatatgtggttagataacata

SEQ ID NO: 49625 - DNA, 21 bp, Artificial sequence
  SiRNA target sequence
atatgtggttagataacatat

SEQ ID NO: 49626 - DNA, 21 bp, Artificial sequence
  SiRNA target sequence
tatgtggttagataacatatc

SEQ ID NO: 49627 - DNA, 21 bp, Artificial sequence
  SiRNA target sequence
atgtggttagataacatatct

SEQ ID NO: 49628 - DNA, 21 bp, Artificial sequence
  SiRNA target sequence
tgtggttagataacatatctc

SEQ ID NO: 49629 - DNA, 21 bp, Artificial sequence
  SiRNA target sequence
gtggttagataacatatctct

SEQ ID NO: 49630 - DNA, 21 bp, Artificial sequence
  SiRNA target sequence
tggttagataacatatctctc

SEQ ID NO: 49631 - DNA, 21 bp, Artificial sequence
  SiRNA target sequence
ggttagataacatatctctcg

SEQ ID NO: 49632 - DNA, 21 bp, Artificial sequence
  SiRNA target sequence
gttagataacatatctctcgt

SEQ ID NO: 49633 - DNA, 21 bp, Artificial sequence
  SiRNA target sequence
ttagataacatatctctcgtt

SEQ ID NO: 49634 - DNA, 21 bp, Artificial sequence
  SiRNA target sequence
tagataacatatctctcgtta

SEQ ID NO: 49635 - DNA, 21 bp, Artificial sequence
  SiRNA target sequence
agataacatatctctcgttat

SEQ ID NO: 49636 - DNA, 21 bp, Artificial sequence
  SiRNA target sequence
gataacatatctctcgttatc

SEQ ID NO: 49637 - DNA, 21 bp, Artificial sequence
  SiRNA target sequence
ataacatatctctcgttatcc

SEQ ID NO: 49638 - DNA, 21 bp, Artificial sequence
  SiRNA target sequence
taacatatctctcgttatccc

SEQ ID NO: 49639 - DNA, 21 bp, Artificial sequence
  SiRNA target sequence
aacatatctctcgttatcccc

SEQ ID NO: 49640 - DNA, 21 bp, Artificial sequence
  SiRNA target sequence
acatatctctcgttatcccca

SEQ ID NO: 49641 - DNA, 21 bp, Artificial sequence
  SiRNA target sequence
catatctctcgttatccccac

SEQ ID NO: 49642 - DNA, 21 bp, Artificial sequence
  SiRNA target sequence
atatctctcgttatccccaca

SEQ ID NO: 49643 - DNA, 21 bp, Artificial sequence
  SiRNA target sequence
tatctctcgttatccccacat

SEQ ID NO: 49644 - DNA, 21 bp, Artificial sequence
  SiRNA target sequence
atctctcgttatccccacata

SEQ ID NO: 49645 - DNA, 21 bp, Artificial sequence
  SiRNA target sequence
tctctcgttatccccacatat

SEQ ID NO: 49646 - DNA, 21 bp, Artificial sequence
  SiRNA target sequence
ctctcgttatccccacatata

SEQ ID NO: 49647 - DNA, 21 bp, Artificial sequence
  SiRNA target sequence
tctcgttatccccacatatag

SEQ ID NO: 49648 - DNA, 21 bp, Artificial sequence
  SiRNA target sequence
ctcgttatccccacatataga

SEQ ID NO: 49649 - DNA, 21 bp, Artificial sequence
  SiRNA target sequence
tcgttatccccacatatagat

SEQ ID NO: 49650 - DNA, 21 bp, Artificial sequence
  SiRNA target sequence
cgttatccccacatatagatt

SEQ ID NO: 49651 - DNA, 21 bp, Artificial sequence
  SiRNA target sequence
gttatccccacatatagattg

SEQ ID NO: 49652 - DNA, 21 bp, Artificial sequence
  SiRNA target sequence
ttatccccacatatagattga

SEQ ID NO: 49653 - DNA, 21 bp, Artificial sequence
  SiRNA target sequence
tatccccacatatagattgaa

SEQ ID NO: 49654 - DNA, 21 bp, Artificial sequence
  SiRNA target sequence
atccccacatatagattgaat

SEQ ID NO: 49655 - DNA, 21 bp, Artificial sequence
  SiRNA target sequence
tccccacatatagattgaatc

SEQ ID NO: 49656 - DNA, 21 bp, Artificial sequence
  SiRNA target sequence
ccccacatatagattgaatcc

SEQ ID NO: 49657 - DNA, 21 bp, Artificial sequence
  SiRNA target sequence
cccacatatagattgaatcca

SEQ ID NO: 49658 - DNA, 21 bp, Artificial sequence
  SiRNA target sequence
ccacatatagattgaatccaa

SEQ ID NO: 49659 - DNA, 21 bp, Artificial sequence
  SiRNA target sequence
cacatatagattgaatccaaa

SEQ ID NO: 49660 - DNA, 21 bp, Artificial sequence
  SiRNA target sequence
acatatagattgaatccaaat

SEQ ID NO: 49661 - DNA, 21 bp, Artificial sequence
  SiRNA target sequence
catatagattgaatccaaatc

SEQ ID NO: 49662 - DNA, 21 bp, Artificial sequence
  SiRNA target sequence
atatagattgaatccaaatct

SEQ ID NO: 49663 - DNA, 21 bp, Artificial sequence
  SiRNA target sequence
tatagattgaatccaaatctt

SEQ ID NO: 49664 - DNA, 21 bp, Artificial sequence
  SiRNA target sequence
atagattgaatccaaatcttc

SEQ ID NO: 49665 - DNA, 21 bp, Artificial sequence
  SiRNA target sequence
tagattgaatccaaatcttcc

SEQ ID NO: 49666 - DNA, 21 bp, Artificial sequence
  SiRNA target sequence
agattgaatccaaatcttcca

SEQ ID NO: 49667 - DNA, 21 bp, Artificial sequence
  SiRNA target sequence
gattgaatccaaatcttccaa

SEQ ID NO: 49668 - DNA, 21 bp, Artificial sequence
  SiRNA target sequence
attgaatccaaatcttccaac

SEQ ID NO: 49669 - DNA, 21 bp, Artificial sequence
  SiRNA target sequence
ttgaatccaaatcttccaacc

SEQ ID NO: 49670 - DNA, 21 bp, Artificial sequence
  SiRNA target sequence
tgaatccaaatcttccaaccg

SEQ ID NO: 49671 - DNA, 21 bp, Artificial sequence
  SiRNA target sequence
gaatccaaatcttccaaccgg

SEQ ID NO: 49672 - DNA, 21 bp, Artificial sequence
  SiRNA target sequence
aatccaaatcttccaaccgga

SEQ ID NO: 49673 - DNA, 21 bp, Artificial sequence
  SiRNA target sequence
atccaaatcttccaaccggac

SEQ ID NO: 49674 - DNA, 21 bp, Artificial sequence
  SiRNA target sequence
tccaaatcttccaaccggaca

SEQ ID NO: 49675 - DNA, 21 bp, Artificial sequence
  SiRNA target sequence
ccaaatcttccaaccggacaa

SEQ ID NO: 49676 - DNA, 21 bp, Artificial sequence
  SiRNA target sequence
caaatcttccaaccggacaaa

SEQ ID NO: 49677 - DNA, 21 bp, Artificial sequence
  SiRNA target sequence
aaatcttccaaccggacaaac

SEQ ID NO: 49678 - DNA, 21 bp, Artificial sequence
  SiRNA target sequence
aatcttccaaccggacaaact

SEQ ID NO: 49679 - DNA, 21 bp, Artificial sequence
  SiRNA target sequence
atcttccaaccggacaaactc

SEQ ID NO: 49680 - DNA, 21 bp, Artificial sequence
  SiRNA target sequence
tcttccaaccggacaaactct

SEQ ID NO: 49681 - DNA, 21 bp, Artificial sequence
  SiRNA target sequence
cttccaaccggacaaactcta

SEQ ID NO: 49682 - DNA, 21 bp, Artificial sequence
  SiRNA target sequence
ttccaaccggacaaactctaa

SEQ ID NO: 49683 - DNA, 21 bp, Artificial sequence
  SiRNA target sequence
tccaaccggacaaactctaac

SEQ ID NO: 49684 - DNA, 21 bp, Artificial sequence
  SiRNA target sequence
ccaaccggacaaactctaacc

SEQ ID NO: 49685 - DNA, 21 bp, Artificial sequence
  SiRNA target sequence
caaccggacaaactctaaccc

SEQ ID NO: 49686 - DNA, 21 bp, Artificial sequence
  SiRNA target sequence
aaccggacaaactctaacccg

SEQ ID NO: 49687 - DNA, 21 bp, Artificial sequence
  SiRNA target sequence
accggacaaactctaacccgc

SEQ ID NO: 49688 - DNA, 21 bp, Artificial sequence
  SiRNA target sequence
ccggacaaactctaacccgca

SEQ ID NO: 49689 - DNA, 21 bp, Artificial sequence
  SiRNA target sequence
cggacaaactctaacccgcat

SEQ ID NO: 49690 - DNA, 21 bp, Artificial sequence
  SiRNA target sequence
ggacaaactctaacccgcata

SEQ ID NO: 49691 - DNA, 21 bp, Artificial sequence
  SiRNA target sequence
gacaaactctaacccgcatag

SEQ ID NO: 49692 - DNA, 21 bp, Artificial sequence
  SiRNA target sequence
acaaactctaacccgcatagt

SEQ ID NO: 49693 - DNA, 21 bp, Artificial sequence
  SiRNA target sequence
caaactctaacccgcatagtt

SEQ ID NO: 49694 - DNA, 21 bp, Artificial sequence
  SiRNA target sequence
aaactctaacccgcatagttc

SEQ ID NO: 49695 - DNA, 21 bp, Artificial sequence
  SiRNA target sequence
aactctaacccgcatagttca

SEQ ID NO: 49696 - DNA, 21 bp, Artificial sequence
  SiRNA target sequence
actctaacccgcatagttcag

SEQ ID NO: 49697 - DNA, 21 bp, Artificial sequence
  SiRNA target sequence
ctctaacccgcatagttcaga

SEQ ID NO: 49698 - DNA, 21 bp, Artificial sequence
  SiRNA target sequence
tctaacccgcatagttcagaa

SEQ ID NO: 49699 - DNA, 21 bp, Artificial sequence
  SiRNA target sequence
ctaacccgcatagttcagaat

SEQ ID NO: 49700 - DNA, 21 bp, Artificial sequence
  SiRNA target sequence
taacccgcatagttcagaatt

SEQ ID NO: 49701 - DNA, 21 bp, Artificial sequence
  SiRNA target sequence
aacccgcatagttcagaattc

SEQ ID NO: 49702 - DNA, 21 bp, Artificial sequence
  SiRNA target sequence
acccgcatagttcagaattcc

SEQ ID NO: 49703 - DNA, 21 bp, Artificial sequence
  SiRNA target sequence
cccgcatagttcagaattccg

SEQ ID NO: 49704 - DNA, 21 bp, Artificial sequence
  SiRNA target sequence
ccgcatagttcagaattccga

SEQ ID NO: 49705 - DNA, 21 bp, Artificial sequence
  SiRNA target sequence
cgcatagttcagaattccgat

SEQ ID NO: 49706 - DNA, 21 bp, Artificial sequence
  SiRNA target sequence
gcatagttcagaattccgatt

SEQ ID NO: 49707 - DNA, 21 bp, Artificial sequence
  SiRNA target sequence
catagttcagaattccgattc

SEQ ID NO: 49708 - DNA, 21 bp, Artificial sequence
  SiRNA target sequence
atagttcagaattccgattct

SEQ ID NO: 49709 - DNA, 21 bp, Artificial sequence
  SiRNA target sequence
tagttcagaattccgattctg

SEQ ID NO: 49710 - DNA, 21 bp, Artificial sequence
  SiRNA target sequence
agttcagaattccgattctga

SEQ ID NO: 49711 - DNA, 21 bp, Artificial sequence
  SiRNA target sequence
gttcagaattccgattctgat

SEQ ID NO: 49712 - DNA, 21 bp, Artificial sequence
  SiRNA target sequence
ttcagaattccgattctgata

SEQ ID NO: 49713 - DNA, 21 bp, Artificial sequence
  SiRNA target sequence
tcagaattccgattctgataa

SEQ ID NO: 49714 - DNA, 21 bp, Artificial sequence
  SiRNA target sequence
cagaattccgattctgataaa

SEQ ID NO: 49715 - DNA, 21 bp, Artificial sequence
  SiRNA target sequence
agaattccgattctgataaac

SEQ ID NO: 49716 - DNA, 21 bp, Artificial sequence
  SiRNA target sequence
gaattccgattctgataaact

SEQ ID NO: 49717 - DNA, 21 bp, Artificial sequence
  SiRNA target sequence
aattccgattctgataaactc

SEQ ID NO: 49718 - DNA, 21 bp, Artificial sequence
  SiRNA target sequence
attccgattctgataaactca

SEQ ID NO: 49719 - DNA, 21 bp, Artificial sequence
  SiRNA target sequence
ttccgattctgataaactcaa

SEQ ID NO: 49720 - DNA, 21 bp, Artificial sequence
  SiRNA target sequence
tccgattctgataaactcaaa

SEQ ID NO: 49721 - DNA, 21 bp, Artificial sequence
  SiRNA target sequence
ccgattctgataaactcaaag

SEQ ID NO: 49722 - DNA, 21 bp, Artificial sequence
  SiRNA target sequence
cgattctgataaactcaaaga

SEQ ID NO: 49723 - DNA, 21 bp, Artificial sequence
  SiRNA target sequence
gattctgataaactcaaagaa

SEQ ID NO: 49724 - DNA, 21 bp, Artificial sequence
  SiRNA target sequence
attctgataaactcaaagaag

SEQ ID NO: 49725 - DNA, 21 bp, Artificial sequence
  SiRNA target sequence
ttctgataaactcaaagaagc

SEQ ID NO: 49726 - DNA, 21 bp, Artificial sequence
  SiRNA target sequence
tctgataaactcaaagaagca

SEQ ID NO: 49727 - DNA, 21 bp, Artificial sequence
  SiRNA target sequence
ctgataaactcaaagaagcac

SEQ ID NO: 49728 - DNA, 21 bp, Artificial sequence
  SiRNA target sequence
tgataaactcaaagaagcact

SEQ ID NO: 49729 - DNA, 21 bp, Artificial sequence
  SiRNA target sequence
gataaactcaaagaagcactt

SEQ ID NO: 49730 - DNA, 21 bp, Artificial sequence
  SiRNA target sequence
ataaactcaaagaagcactta

SEQ ID NO: 49731 - DNA, 21 bp, Artificial sequence
  SiRNA target sequence
taaactcaaagaagcacttaa

SEQ ID NO: 49732 - DNA, 21 bp, Artificial sequence
  SiRNA target sequence
aaactcaaagaagcacttaag

SEQ ID NO: 49733 - DNA, 21 bp, Artificial sequence
  SiRNA target sequence
aactcaaagaagcacttaaga

SEQ ID NO: 49734 - DNA, 21 bp, Artificial sequence
  SiRNA target sequence
actcaaagaagcacttaagat

SEQ ID NO: 49735 - DNA, 21 bp, Artificial sequence
  SiRNA target sequence
ctcaaagaagcacttaagatt

SEQ ID NO: 49736 - DNA, 21 bp, Artificial sequence
  SiRNA target sequence
tcaaagaagcacttaagattg

SEQ ID NO: 49737 - DNA, 21 bp, Artificial sequence
  SiRNA target sequence
caaagaagcacttaagattgc

SEQ ID NO: 49738 - DNA, 21 bp, Artificial sequence
  SiRNA target sequence
aaagaagcacttaagattgct

SEQ ID NO: 49739 - DNA, 21 bp, Artificial sequence
  SiRNA target sequence
aagaagcacttaagattgcta

SEQ ID NO: 49740 - DNA, 21 bp, Artificial sequence
  SiRNA target sequence
agaagcacttaagattgctaa

SEQ ID NO: 49741 - DNA, 21 bp, Artificial sequence
  SiRNA target sequence
gaagcacttaagattgctaag

SEQ ID NO: 49742 - DNA, 21 bp, Artificial sequence
  SiRNA target sequence
aagcacttaagattgctaagt

SEQ ID NO: 49743 - DNA, 21 bp, Artificial sequence
  SiRNA target sequence
agcacttaagattgctaagtc

SEQ ID NO: 49744 - DNA, 21 bp, Artificial sequence
  SiRNA target sequence
gcacttaagattgctaagtct

SEQ ID NO: 49745 - DNA, 21 bp, Artificial sequence
  SiRNA target sequence
cacttaagattgctaagtcta

SEQ ID NO: 49746 - DNA, 21 bp, Artificial sequence
  SiRNA target sequence
acttaagattgctaagtctaa

SEQ ID NO: 49747 - DNA, 21 bp, Artificial sequence
  SiRNA target sequence
cttaagattgctaagtctaag

SEQ ID NO: 49748 - DNA, 21 bp, Artificial sequence
  SiRNA target sequence
ttaagattgctaagtctaaga

SEQ ID NO: 49749 - DNA, 21 bp, Artificial sequence
  SiRNA target sequence
taagattgctaagtctaagaa

SEQ ID NO: 49750 - DNA, 21 bp, Artificial sequence
  SiRNA target sequence
aagattgctaagtctaagaac

SEQ ID NO: 49751 - DNA, 21 bp, Artificial sequence
  SiRNA target sequence
agattgctaagtctaagaacc

SEQ ID NO: 49752 - DNA, 21 bp, Artificial sequence
  SiRNA target sequence
gattgctaagtctaagaaccc

SEQ ID NO: 49753 - DNA, 21 bp, Artificial sequence
  SiRNA target sequence
attgctaagtctaagaaccct

SEQ ID NO: 49754 - DNA, 21 bp, Artificial sequence
  SiRNA target sequence
ttgctaagtctaagaaccctt

SEQ ID NO: 49755 - DNA, 21 bp, Artificial sequence
  SiRNA target sequence
tgctaagtctaagaacccttc

SEQ ID NO: 49756 - DNA, 21 bp, Artificial sequence
  SiRNA target sequence
gctaagtctaagaacccttca

SEQ ID NO: 49757 - DNA, 21 bp, Artificial sequence
  SiRNA target sequence
ctaagtctaagaacccttcag

SEQ ID NO: 49758 - DNA, 21 bp, Artificial sequence
  SiRNA target sequence
taagtctaagaacccttcagg

SEQ ID NO: 49759 - DNA, 21 bp, Artificial sequence
  SiRNA target sequence
aagtctaagaacccttcagga

SEQ ID NO: 49760 - DNA, 21 bp, Artificial sequence
  SiRNA target sequence
agtctaagaacccttcaggat

SEQ ID NO: 49761 - DNA, 21 bp, Artificial sequence
  SiRNA target sequence
gtctaagaacccttcaggata

SEQ ID NO: 49762 - DNA, 21 bp, Artificial sequence
  SiRNA target sequence
tctaagaacccttcaggatat

SEQ ID NO: 49763 - DNA, 21 bp, Artificial sequence
  SiRNA target sequence
ctaagaacccttcaggatata

SEQ ID NO: 49764 - DNA, 21 bp, Artificial sequence
  SiRNA target sequence
taagaacccttcaggatataa

SEQ ID NO: 49765 - DNA, 21 bp, Artificial sequence
  SiRNA target sequence
aagaacccttcaggatataaa

SEQ ID NO: 49766 - DNA, 21 bp, Artificial sequence
  SiRNA target sequence
agaacccttcaggatataaat

SEQ ID NO: 49767 - DNA, 21 bp, Artificial sequence
  SiRNA target sequence
gaacccttcaggatataaata

SEQ ID NO: 49768 - DNA, 21 bp, Artificial sequence
  SiRNA target sequence
aacccttcaggatataaatat

SEQ ID NO: 49769 - DNA, 21 bp, Artificial sequence
  SiRNA target sequence
acccttcaggatataaatata

SEQ ID NO: 49770 - DNA, 21 bp, Artificial sequence
  SiRNA target sequence
cccttcaggatataaatatat

SEQ ID NO: 49771 - DNA, 21 bp, Artificial sequence
  SiRNA target sequence
ccttcaggatataaatatatc

SEQ ID NO: 49772 - DNA, 21 bp, Artificial sequence
  SiRNA target sequence
cttcaggatataaatatatca

SEQ ID NO: 49773 - DNA, 21 bp, Artificial sequence
  SiRNA target sequence
ttcaggatataaatatatcat

SEQ ID NO: 49774 - DNA, 21 bp, Artificial sequence
  SiRNA target sequence
tcaggatataaatatatcatg

SEQ ID NO: 49775 - DNA, 21 bp, Artificial sequence
  SiRNA target sequence
caggatataaatatatcatgg

SEQ ID NO: 49776 - DNA, 21 bp, Artificial sequence
  SiRNA target sequence
aggatataaatatatcatggg

SEQ ID NO: 49777 - DNA, 21 bp, Artificial sequence
  SiRNA target sequence
ggatataaatatatcatggga

SEQ ID NO: 49778 - DNA, 21 bp, Artificial sequence
  SiRNA target sequence
gatataaatatatcatgggag

SEQ ID NO: 49779 - DNA, 21 bp, Artificial sequence
  SiRNA target sequence
atataaatatatcatgggagt

SEQ ID NO: 49780 - DNA, 21 bp, Artificial sequence
  SiRNA target sequence
tataaatatatcatgggagtt

SEQ ID NO: 49781 - DNA, 21 bp, Artificial sequence
  SiRNA target sequence
ataaatatatcatgggagttc

SEQ ID NO: 49782 - DNA, 21 bp, Artificial sequence
  SiRNA target sequence
taaatatatcatgggagttct

SEQ ID NO: 49783 - DNA, 21 bp, Artificial sequence
  SiRNA target sequence
aaatatatcatgggagttctt

SEQ ID NO: 49784 - DNA, 21 bp, Artificial sequence
  SiRNA target sequence
aatatatcatgggagttcttg

SEQ ID NO: 49785 - DNA, 21 bp, Artificial sequence
  SiRNA target sequence
atatatcatgggagttcttga

SEQ ID NO: 49786 - DNA, 21 bp, Artificial sequence
  SiRNA target sequence
tatatcatgggagttcttgaa

SEQ ID NO: 49787 - DNA, 21 bp, Artificial sequence
  SiRNA target sequence
atatcatgggagttcttgaac

SEQ ID NO: 49788 - DNA, 21 bp, Artificial sequence
  SiRNA target sequence
tatcatgggagttcttgaaca

SEQ ID NO: 49789 - DNA, 21 bp, Artificial sequence
  SiRNA target sequence
atcatgggagttcttgaacaa

SEQ ID NO: 49790 - DNA, 21 bp, Artificial sequence
  SiRNA target sequence
tcatgggagttcttgaacaat

SEQ ID NO: 49791 - DNA, 21 bp, Artificial sequence
  SiRNA target sequence
catgggagttcttgaacaata

SEQ ID NO: 49792 - DNA, 21 bp, Artificial sequence
  SiRNA target sequence
atgggagttcttgaacaatac

SEQ ID NO: 49793 - DNA, 21 bp, Artificial sequence
  SiRNA target sequence
tgggagttcttgaacaataca

SEQ ID NO: 49794 - DNA, 21 bp, Artificial sequence
  SiRNA target sequence
gggagttcttgaacaatacaa

SEQ ID NO: 49795 - DNA, 21 bp, Artificial sequence
  SiRNA target sequence
ggagttcttgaacaatacaat

SEQ ID NO: 49796 - DNA, 21 bp, Artificial sequence
  SiRNA target sequence
gagttcttgaacaatacaatc

SEQ ID NO: 49797 - DNA, 21 bp, Artificial sequence
  SiRNA target sequence
agttcttgaacaatacaatcc

SEQ ID NO: 49798 - DNA, 21 bp, Artificial sequence
  SiRNA target sequence
gttcttgaacaatacaatcca

SEQ ID NO: 49799 - DNA, 21 bp, Artificial sequence
  SiRNA target sequence
ttcttgaacaatacaatccaa

SEQ ID NO: 49800 - DNA, 21 bp, Artificial sequence
  SiRNA target sequence
tcttgaacaatacaatccaag

SEQ ID NO: 49801 - DNA, 21 bp, Artificial sequence
  SiRNA target sequence
cttgaacaatacaatccaagt

SEQ ID NO: 49802 - DNA, 21 bp, Artificial sequence
  SiRNA target sequence
ttgaacaatacaatccaagtg

SEQ ID NO: 49803 - DNA, 21 bp, Artificial sequence
  SiRNA target sequence
tgaacaatacaatccaagtgt

SEQ ID NO: 49804 - DNA, 21 bp, Artificial sequence
  SiRNA target sequence
gaacaatacaatccaagtgtg

SEQ ID NO: 49805 - DNA, 21 bp, Artificial sequence
  SiRNA target sequence
aacaatacaatccaagtgtga

SEQ ID NO: 49806 - DNA, 21 bp, Artificial sequence
  SiRNA target sequence
acaatacaatccaagtgtgaa

SEQ ID NO: 49807 - DNA, 21 bp, Artificial sequence
  SiRNA target sequence
caatacaatccaagtgtgaaa

SEQ ID NO: 49808 - DNA, 21 bp, Artificial sequence
  SiRNA target sequence
aatacaatccaagtgtgaaac

SEQ ID NO: 49809 - DNA, 21 bp, Artificial sequence
  SiRNA target sequence
atacaatccaagtgtgaaaca

SEQ ID NO: 49810 - DNA, 21 bp, Artificial sequence
  SiRNA target sequence
tacaatccaagtgtgaaacaa

SEQ ID NO: 49811 - DNA, 21 bp, Artificial sequence
  SiRNA target sequence
acaatccaagtgtgaaacaag

SEQ ID NO: 49812 - DNA, 21 bp, Artificial sequence
  SiRNA target sequence
caatccaagtgtgaaacaagt

SEQ ID NO: 49813 - DNA, 21 bp, Artificial sequence
  SiRNA target sequence
aatccaagtgtgaaacaagtt

SEQ ID NO: 49814 - DNA, 21 bp, Artificial sequence
  SiRNA target sequence
atccaagtgtgaaacaagttt

SEQ ID NO: 49815 - DNA, 21 bp, Artificial sequence
  SiRNA target sequence
tccaagtgtgaaacaagtttc

SEQ ID NO: 49816 - DNA, 21 bp, Artificial sequence
  SiRNA target sequence
ccaagtgtgaaacaagtttct

SEQ ID NO: 49817 - DNA, 21 bp, Artificial sequence
  SiRNA target sequence
caagtgtgaaacaagtttcta

SEQ ID NO: 49818 - DNA, 21 bp, Artificial sequence
  SiRNA target sequence
aagtgtgaaacaagtttctat

SEQ ID NO: 49819 - DNA, 21 bp, Artificial sequence
  SiRNA target sequence
agtgtgaaacaagtttctatg

SEQ ID NO: 49820 - DNA, 21 bp, Artificial sequence
  SiRNA target sequence
gtgtgaaacaagtttctatgc

SEQ ID NO: 49821 - DNA, 21 bp, Artificial sequence
  SiRNA target sequence
tgtgaaacaagtttctatgca

SEQ ID NO: 49822 - DNA, 21 bp, Artificial sequence
  SiRNA target sequence
gtgaaacaagtttctatgcaa

SEQ ID NO: 49823 - DNA, 21 bp, Artificial sequence
  SiRNA target sequence
tgaaacaagtttctatgcaaa

SEQ ID NO: 49824 - DNA, 21 bp, Artificial sequence
  SiRNA target sequence
gaaacaagtttctatgcaaat

SEQ ID NO: 49825 - DNA, 21 bp, Artificial sequence
  SiRNA target sequence
aaacaagtttctatgcaaatc

SEQ ID NO: 49826 - DNA, 21 bp, Artificial sequence
  SiRNA target sequence
aacaagtttctatgcaaatcg

SEQ ID NO: 49827 - DNA, 21 bp, Artificial sequence
  SiRNA target sequence
acaagtttctatgcaaatcgc

SEQ ID NO: 49828 - DNA, 21 bp, Artificial sequence
  SiRNA target sequence
caagtttctatgcaaatcgca

SEQ ID NO: 49829 - DNA, 21 bp, Artificial sequence
  SiRNA target sequence
aagtttctatgcaaatcgcaa

SEQ ID NO: 49830 - DNA, 21 bp, Artificial sequence
  SiRNA target sequence
agtttctatgcaaatcgcaac

SEQ ID NO: 49831 - DNA, 21 bp, Artificial sequence
  SiRNA target sequence
gtttctatgcaaatcgcaaca

SEQ ID NO: 49832 - DNA, 21 bp, Artificial sequence
  SiRNA target sequence
tttctatgcaaatcgcaacac

SEQ ID NO: 49833 - DNA, 21 bp, Artificial sequence
  SiRNA target sequence
ttctatgcaaatcgcaacacc

SEQ ID NO: 49834 - DNA, 21 bp, Artificial sequence
  SiRNA target sequence
tctatgcaaatcgcaacacct

SEQ ID NO: 49835 - DNA, 21 bp, Artificial sequence
  SiRNA target sequence
ctatgcaaatcgcaacaccta

SEQ ID NO: 49836 - DNA, 21 bp, Artificial sequence
  SiRNA target sequence
tatgcaaatcgcaacacctaa

SEQ ID NO: 49837 - DNA, 21 bp, Artificial sequence
  SiRNA target sequence
atgcaaatcgcaacacctaac

SEQ ID NO: 49838 - DNA, 21 bp, Artificial sequence
  SiRNA target sequence
tgcaaatcgcaacacctaaca

SEQ ID NO: 49839 - DNA, 21 bp, Artificial sequence
  SiRNA target sequence
gcaaatcgcaacacctaacaa

SEQ ID NO: 49840 - DNA, 21 bp, Artificial sequence
  SiRNA target sequence
caaatcgcaacacctaacaaa

SEQ ID NO: 49841 - DNA, 21 bp, Artificial sequence
  SiRNA target sequence
aaatcgcaacacctaacaaat

SEQ ID NO: 49842 - DNA, 21 bp, Artificial sequence
  SiRNA target sequence
aatcgcaacacctaacaaatc

SEQ ID NO: 49843 - DNA, 21 bp, Artificial sequence
  SiRNA target sequence
atcgcaacacctaacaaatca

SEQ ID NO: 49844 - DNA, 21 bp, Artificial sequence
  SiRNA target sequence
tcgcaacacctaacaaatcaa

SEQ ID NO: 49845 - DNA, 21 bp, Artificial sequence
  SiRNA target sequence
cgcaacacctaacaaatcaaa

SEQ ID NO: 49846 - DNA, 21 bp, Artificial sequence
  SiRNA target sequence
gcaacacctaacaaatcaaaa

SEQ ID NO: 49847 - DNA, 21 bp, Artificial sequence
  SiRNA target sequence
caacacctaacaaatcaaaat

SEQ ID NO: 49848 - DNA, 21 bp, Artificial sequence
  SiRNA target sequence
aacacctaacaaatcaaaatc

SEQ ID NO: 49849 - DNA, 21 bp, Artificial sequence
  SiRNA target sequence
acacctaacaaatcaaaatca

SEQ ID NO: 49850 - DNA, 21 bp, Artificial sequence
  SiRNA target sequence
cacctaacaaatcaaaatcaa

SEQ ID NO: 49851 - DNA, 21 bp, Artificial sequence
  SiRNA target sequence
acctaacaaatcaaaatcaac

SEQ ID NO: 49852 - DNA, 21 bp, Artificial sequence
  SiRNA target sequence
cctaacaaatcaaaatcaaca

SEQ ID NO: 49853 - DNA, 21 bp, Artificial sequence
  SiRNA target sequence
ctaacaaatcaaaatcaacaa

SEQ ID NO: 49854 - DNA, 21 bp, Artificial sequence
  SiRNA target sequence
taacaaatcaaaatcaacaaa

SEQ ID NO: 49855 - DNA, 21 bp, Artificial sequence
  SiRNA target sequence
aacaaatcaaaatcaacaaaa

SEQ ID NO: 49856 - DNA, 21 bp, Artificial sequence
  SiRNA target sequence
acaaatcaaaatcaacaaaac

SEQ ID NO: 49857 - DNA, 21 bp, Artificial sequence
  SiRNA target sequence
caaatcaaaatcaacaaaacc

SEQ ID NO: 49858 - DNA, 21 bp, Artificial sequence
  SiRNA target sequence
aaatcaaaatcaacaaaacca

SEQ ID NO: 49859 - DNA, 21 bp, Artificial sequence
  SiRNA target sequence
aatcaaaatcaacaaaaccaa

SEQ ID NO: 49860 - DNA, 21 bp, Artificial sequence
  SiRNA target sequence
atcaaaatcaacaaaaccaac

SEQ ID NO: 49861 - DNA, 21 bp, Artificial sequence
  SiRNA target sequence
tcaaaatcaacaaaaccaaca

SEQ ID NO: 49862 - DNA, 21 bp, Artificial sequence
  SiRNA target sequence
caaaatcaacaaaaccaacat

SEQ ID NO: 49863 - DNA, 21 bp, Artificial sequence
  SiRNA target sequence
aaaatcaacaaaaccaacatc

SEQ ID NO: 49864 - DNA, 21 bp, Artificial sequence
  SiRNA target sequence
aaatcaacaaaaccaacatcc

SEQ ID NO: 49865 - DNA, 21 bp, Artificial sequence
  SiRNA target sequence
aatcaacaaaaccaacatccg

SEQ ID NO: 49866 - DNA, 21 bp, Artificial sequence
  SiRNA target sequence
atcaacaaaaccaacatccga

SEQ ID NO: 49867 - DNA, 21 bp, Artificial sequence
  SiRNA target sequence
tcaacaaaaccaacatccgaa

SEQ ID NO: 49868 - DNA, 21 bp, Artificial sequence
  SiRNA target sequence
caacaaaaccaacatccgaaa

SEQ ID NO: 49869 - DNA, 21 bp, Artificial sequence
  SiRNA target sequence
aacaaaaccaacatccgaaaa

SEQ ID NO: 49870 - DNA, 21 bp, Artificial sequence
  SiRNA target sequence
acaaaaccaacatccgaaaac

SEQ ID NO: 49871 - DNA, 21 bp, Artificial sequence
  SiRNA target sequence
caaaaccaacatccgaaaacc

SEQ ID NO: 49872 - DNA, 21 bp, Artificial sequence
  SiRNA target sequence
aaaaccaacatccgaaaaccc

SEQ ID NO: 49873 - DNA, 21 bp, Artificial sequence
  SiRNA target sequence
aaaccaacatccgaaaaccca

SEQ ID NO: 49874 - DNA, 21 bp, Artificial sequence
  SiRNA target sequence
aaccaacatccgaaaacccaa

SEQ ID NO: 49875 - DNA, 21 bp, Artificial sequence
  SiRNA target sequence
accaacatccgaaaacccaaa

SEQ ID NO: 49876 - DNA, 21 bp, Artificial sequence
  SiRNA target sequence
ccaacatccgaaaacccaaaa

SEQ ID NO: 49877 - DNA, 21 bp, Artificial sequence
  SiRNA target sequence
caacatccgaaaacccaaaaa

SEQ ID NO: 49878 - DNA, 21 bp, Artificial sequence
  SiRNA target sequence
aacatccgaaaacccaaaaat

SEQ ID NO: 49879 - DNA, 21 bp, Artificial sequence
  SiRNA target sequence
acatccgaaaacccaaaaatt

SEQ ID NO: 49880 - DNA, 21 bp, Artificial sequence
  SiRNA target sequence
catccgaaaacccaaaaattg

SEQ ID NO: 49881 - DNA, 21 bp, Artificial sequence
  SiRNA target sequence
atccgaaaacccaaaaattgg

SEQ ID NO: 49882 - DNA, 21 bp, Artificial sequence
  SiRNA target sequence
tccgaaaacccaaaaattgga

SEQ ID NO: 49883 - DNA, 21 bp, Artificial sequence
  SiRNA target sequence
ccgaaaacccaaaaattggac

SEQ ID NO: 49884 - DNA, 21 bp, Artificial sequence
  SiRNA target sequence
cgaaaacccaaaaattggacc

SEQ ID NO: 49885 - DNA, 21 bp, Artificial sequence
  SiRNA target sequence
gaaaacccaaaaattggacca

SEQ ID NO: 49886 - DNA, 21 bp, Artificial sequence
  SiRNA target sequence
aaaacccaaaaattggaccaa

SEQ ID NO: 49887 - DNA, 21 bp, Artificial sequence
  SiRNA target sequence
aaacccaaaaattggaccaat

SEQ ID NO: 49888 - DNA, 21 bp, Artificial sequence
  SiRNA target sequence
aacccaaaaattggaccaatt

SEQ ID NO: 49889 - DNA, 21 bp, Artificial sequence
  SiRNA target sequence
acccaaaaattggaccaattt

SEQ ID NO: 49890 - DNA, 21 bp, Artificial sequence
  SiRNA target sequence
cccaaaaattggaccaatttc

SEQ ID NO: 49891 - DNA, 21 bp, Artificial sequence
  SiRNA target sequence
ccaaaaattggaccaatttcc

SEQ ID NO: 49892 - DNA, 21 bp, Artificial sequence
  SiRNA target sequence
caaaaattggaccaatttccg

SEQ ID NO: 49893 - DNA, 21 bp, Artificial sequence
  SiRNA target sequence
aaaaattggaccaatttccga

SEQ ID NO: 49894 - DNA, 21 bp, Artificial sequence
  SiRNA target sequence
aaaattggaccaatttccgaa

SEQ ID NO: 49895 - DNA, 21 bp, Artificial sequence
  SiRNA target sequence
aaattggaccaatttccgaag

SEQ ID NO: 49896 - DNA, 21 bp, Artificial sequence
  SiRNA target sequence
aattggaccaatttccgaagt

SEQ ID NO: 49897 - DNA, 21 bp, Artificial sequence
  SiRNA target sequence
attggaccaatttccgaagtg

SEQ ID NO: 49898 - DNA, 21 bp, Artificial sequence
  SiRNA target sequence
ttggaccaatttccgaagtgg

SEQ ID NO: 49899 - DNA, 21 bp, Artificial sequence
  SiRNA target sequence
tggaccaatttccgaagtggc

SEQ ID NO: 49900 - DNA, 21 bp, Artificial sequence
  SiRNA target sequence
ggaccaatttccgaagtggct

SEQ ID NO: 49901 - DNA, 21 bp, Artificial sequence
  SiRNA target sequence
gaccaatttccgaagtggctt

SEQ ID NO: 49902 - DNA, 21 bp, Artificial sequence
  SiRNA target sequence
accaatttccgaagtggcttc

SEQ ID NO: 49903 - DNA, 21 bp, Artificial sequence
  SiRNA target sequence
ccaatttccgaagtggcttca

SEQ ID NO: 49904 - DNA, 21 bp, Artificial sequence
  SiRNA target sequence
caatttccgaagtggcttcag

SEQ ID NO: 49905 - DNA, 21 bp, Artificial sequence
  SiRNA target sequence
aatttccgaagtggcttcagg

SEQ ID NO: 49906 - DNA, 21 bp, Artificial sequence
  SiRNA target sequence
atttccgaagtggcttcagga

SEQ ID NO: 49907 - DNA, 21 bp, Artificial sequence
  SiRNA target sequence
tttccgaagtggcttcaggag

SEQ ID NO: 49908 - DNA, 21 bp, Artificial sequence
  SiRNA target sequence
ttccgaagtggcttcaggagt

SEQ ID NO: 49909 - DNA, 21 bp, Artificial sequence
  SiRNA target sequence
tccgaagtggcttcaggagtt

SEQ ID NO: 49910 - DNA, 21 bp, Artificial sequence
  SiRNA target sequence
ccgaagtggcttcaggagtta

SEQ ID NO: 49911 - DNA, 21 bp, Artificial sequence
  SiRNA target sequence
cgaagtggcttcaggagttaa

SEQ ID NO: 49912 - DNA, 21 bp, Artificial sequence
  SiRNA target sequence
gaagtggcttcaggagttaag

SEQ ID NO: 49913 - DNA, 21 bp, Artificial sequence
  SiRNA target sequence
aagtggcttcaggagttaaga

SEQ ID NO: 49914 - DNA, 21 bp, Artificial sequence
  SiRNA target sequence
agtggcttcaggagttaagac

SEQ ID NO: 49915 - DNA, 21 bp, Artificial sequence
  SiRNA target sequence
gtggcttcaggagttaagaca

SEQ ID NO: 49916 - DNA, 21 bp, Artificial sequence
  SiRNA target sequence
tggcttcaggagttaagacag

SEQ ID NO: 49917 - DNA, 21 bp, Artificial sequence
  SiRNA target sequence
ggcttcaggagttaagacagc

SEQ ID NO: 49918 - DNA, 21 bp, Artificial sequence
  SiRNA target sequence
gcttcaggagttaagacagct

SEQ ID NO: 49919 - DNA, 21 bp, Artificial sequence
  SiRNA target sequence
cttcaggagttaagacagctg

SEQ ID NO: 49920 - DNA, 21 bp, Artificial sequence
  SiRNA target sequence
ttcaggagttaagacagctgc

SEQ ID NO: 49921 - DNA, 21 bp, Artificial sequence
  SiRNA target sequence
tcaggagttaagacagctgca

SEQ ID NO: 49922 - DNA, 21 bp, Artificial sequence
  SiRNA target sequence
caggagttaagacagctgcaa

SEQ ID NO: 49923 - DNA, 21 bp, Artificial sequence
  SiRNA target sequence
aggagttaagacagctgcaaa

SEQ ID NO: 49924 - DNA, 21 bp, Artificial sequence
  SiRNA target sequence
ggagttaagacagctgcaaat

SEQ ID NO: 49925 - DNA, 21 bp, Artificial sequence
  SiRNA target sequence
gagttaagacagctgcaaatg

SEQ ID NO: 49926 - DNA, 21 bp, Artificial sequence
  SiRNA target sequence
agttaagacagctgcaaatgg

SEQ ID NO: 49927 - DNA, 21 bp, Artificial sequence
  SiRNA target sequence
gttaagacagctgcaaatggc

SEQ ID NO: 49928 - DNA, 21 bp, Artificial sequence
  SiRNA target sequence
ttaagacagctgcaaatggca

SEQ ID NO: 49929 - DNA, 21 bp, Artificial sequence
  SiRNA target sequence
taagacagctgcaaatggcat

SEQ ID NO: 49930 - DNA, 21 bp, Artificial sequence
  SiRNA target sequence
aagacagctgcaaatggcatc

SEQ ID NO: 49931 - DNA, 21 bp, Artificial sequence
  SiRNA target sequence
agacagctgcaaatggcatcg

SEQ ID NO: 49932 - DNA, 21 bp, Artificial sequence
  SiRNA target sequence
gacagctgcaaatggcatcga

SEQ ID NO: 49933 - DNA, 21 bp, Artificial sequence
  SiRNA target sequence
acagctgcaaatggcatcgag

SEQ ID NO: 49934 - DNA, 21 bp, Artificial sequence
  SiRNA target sequence
cagctgcaaatggcatcgagc

SEQ ID NO: 49935 - DNA, 21 bp, Artificial sequence
  SiRNA target sequence
agctgcaaatggcatcgagcg

SEQ ID NO: 49936 - DNA, 21 bp, Artificial sequence
  SiRNA target sequence
gctgcaaatggcatcgagcgc

SEQ ID NO: 49937 - DNA, 21 bp, Artificial sequence
  SiRNA target sequence
ctgcaaatggcatcgagcgca

SEQ ID NO: 49938 - DNA, 21 bp, Artificial sequence
  SiRNA target sequence
tgcaaatggcatcgagcgcat

SEQ ID NO: 49939 - DNA, 21 bp, Artificial sequence
  SiRNA target sequence
gcaaatggcatcgagcgcatt

SEQ ID NO: 49940 - DNA, 21 bp, Artificial sequence
  SiRNA target sequence
caaatggcatcgagcgcattc

SEQ ID NO: 49941 - DNA, 21 bp, Artificial sequence
  SiRNA target sequence
aaatggcatcgagcgcattcc

SEQ ID NO: 49942 - DNA, 21 bp, Artificial sequence
  SiRNA target sequence
aatggcatcgagcgcattcca

SEQ ID NO: 49943 - DNA, 21 bp, Artificial sequence
  SiRNA target sequence
atggcatcgagcgcattccag

SEQ ID NO: 49944 - DNA, 21 bp, Artificial sequence
  SiRNA target sequence
tggcatcgagcgcattccagt

SEQ ID NO: 49945 - DNA, 21 bp, Artificial sequence
  SiRNA target sequence
ggcatcgagcgcattccagtg

SEQ ID NO: 49946 - DNA, 21 bp, Artificial sequence
  SiRNA target sequence
gcatcgagcgcattccagtgc

SEQ ID NO: 49947 - DNA, 21 bp, Artificial sequence
  SiRNA target sequence
catcgagcgcattccagtgct

SEQ ID NO: 49948 - DNA, 21 bp, Artificial sequence
  SiRNA target sequence
atcgagcgcattccagtgcta

SEQ ID NO: 49949 - DNA, 21 bp, Artificial sequence
  SiRNA target sequence
tcgagcgcattccagtgctag

SEQ ID NO: 49950 - DNA, 21 bp, Artificial sequence
  SiRNA target sequence
cgagcgcattccagtgctagg

SEQ ID NO: 49951 - DNA, 21 bp, Artificial sequence
  SiRNA target sequence
gagcgcattccagtgctaggt

SEQ ID NO: 49952 - DNA, 21 bp, Artificial sequence
  SiRNA target sequence
agcgcattccagtgctaggtg

SEQ ID NO: 49953 - DNA, 21 bp, Artificial sequence
  SiRNA target sequence
gcgcattccagtgctaggtga

SEQ ID NO: 49954 - DNA, 21 bp, Artificial sequence
  SiRNA target sequence
cgcattccagtgctaggtgaa

SEQ ID NO: 49955 - DNA, 21 bp, Artificial sequence
  SiRNA target sequence
gcattccagtgctaggtgaaa

SEQ ID NO: 49956 - DNA, 21 bp, Artificial sequence
  SiRNA target sequence
cattccagtgctaggtgaaat

SEQ ID NO: 49957 - DNA, 21 bp, Artificial sequence
  SiRNA target sequence
attccagtgctaggtgaaatt

SEQ ID NO: 49958 - DNA, 21 bp, Artificial sequence
  SiRNA target sequence
ttccagtgctaggtgaaattg

SEQ ID NO: 49959 - DNA, 21 bp, Artificial sequence
  SiRNA target sequence
tccagtgctaggtgaaattgc

SEQ ID NO: 49960 - DNA, 21 bp, Artificial sequence
  SiRNA target sequence
ccagtgctaggtgaaattgca

SEQ ID NO: 49961 - DNA, 21 bp, Artificial sequence
  SiRNA target sequence
cagtgctaggtgaaattgcaa

SEQ ID NO: 49962 - DNA, 21 bp, Artificial sequence
  SiRNA target sequence
agtgctaggtgaaattgcaaa

SEQ ID NO: 49963 - DNA, 21 bp, Artificial sequence
  SiRNA target sequence
gtgctaggtgaaattgcaaag

SEQ ID NO: 49964 - DNA, 21 bp, Artificial sequence
  SiRNA target sequence
tgctaggtgaaattgcaaagc

SEQ ID NO: 49965 - DNA, 21 bp, Artificial sequence
  SiRNA target sequence
gctaggtgaaattgcaaagcc

SEQ ID NO: 49966 - DNA, 21 bp, Artificial sequence
  SiRNA target sequence
ctaggtgaaattgcaaagccg

SEQ ID NO: 49967 - DNA, 21 bp, Artificial sequence
  SiRNA target sequence
taggtgaaattgcaaagccgg

SEQ ID NO: 49968 - DNA, 21 bp, Artificial sequence
  SiRNA target sequence
aggtgaaattgcaaagccggt

SEQ ID NO: 49969 - DNA, 21 bp, Artificial sequence
  SiRNA target sequence
ggtgaaattgcaaagccggta

SEQ ID NO: 49970 - DNA, 21 bp, Artificial sequence
  SiRNA target sequence
gtgaaattgcaaagccggtaa

SEQ ID NO: 49971 - DNA, 21 bp, Artificial sequence
  SiRNA target sequence
tgaaattgcaaagccggtaac

SEQ ID NO: 49972 - DNA, 21 bp, Artificial sequence
  SiRNA target sequence
gaaattgcaaagccggtaact

SEQ ID NO: 49973 - DNA, 21 bp, Artificial sequence
  SiRNA target sequence
aaattgcaaagccggtaactg

SEQ ID NO: 49974 - DNA, 21 bp, Artificial sequence
  SiRNA target sequence
aattgcaaagccggtaactgc

SEQ ID NO: 49975 - DNA, 21 bp, Artificial sequence
  SiRNA target sequence
attgcaaagccggtaactgct

SEQ ID NO: 49976 - DNA, 21 bp, Artificial sequence
  SiRNA target sequence
ttgcaaagccggtaactgctg

SEQ ID NO: 49977 - DNA, 21 bp, Artificial sequence
  SiRNA target sequence
tgcaaagccggtaactgctgc

SEQ ID NO: 49978 - DNA, 21 bp, Artificial sequence
  SiRNA target sequence
gcaaagccggtaactgctgca

SEQ ID NO: 49979 - DNA, 21 bp, Artificial sequence
  SiRNA target sequence
caaagccggtaactgctgcag

SEQ ID NO: 49980 - DNA, 21 bp, Artificial sequence
  SiRNA target sequence
aaagccggtaactgctgcagt

SEQ ID NO: 49981 - DNA, 21 bp, Artificial sequence
  SiRNA target sequence
aagccggtaactgctgcagtt

SEQ ID NO: 49982 - DNA, 21 bp, Artificial sequence
  SiRNA target sequence
agccggtaactgctgcagtta

SEQ ID NO: 49983 - DNA, 21 bp, Artificial sequence
  SiRNA target sequence
gccggtaactgctgcagttaa

SEQ ID NO: 49984 - DNA, 21 bp, Artificial sequence
  SiRNA target sequence
ccggtaactgctgcagttaaa

SEQ ID NO: 49985 - DNA, 21 bp, Artificial sequence
  SiRNA target sequence
cggtaactgctgcagttaaat

SEQ ID NO: 49986 - DNA, 21 bp, Artificial sequence
  SiRNA target sequence
ggtaactgctgcagttaaatg

SEQ ID NO: 49987 - DNA, 21 bp, Artificial sequence
  SiRNA target sequence
gtaactgctgcagttaaatgg

SEQ ID NO: 49988 - DNA, 21 bp, Artificial sequence
  SiRNA target sequence
taactgctgcagttaaatggt

SEQ ID NO: 49989 - DNA, 21 bp, Artificial sequence
  SiRNA target sequence
aactgctgcagttaaatggtt

SEQ ID NO: 49990 - DNA, 21 bp, Artificial sequence
  SiRNA target sequence
actgctgcagttaaatggttt

SEQ ID NO: 49991 - DNA, 21 bp, Artificial sequence
  SiRNA target sequence
ctgctgcagttaaatggtttg

SEQ ID NO: 49992 - DNA, 21 bp, Artificial sequence
  SiRNA target sequence
tgctgcagttaaatggtttgc

SEQ ID NO: 49993 - DNA, 21 bp, Artificial sequence
  SiRNA target sequence
gctgcagttaaatggtttgct

SEQ ID NO: 49994 - DNA, 21 bp, Artificial sequence
  SiRNA target sequence
ctgcagttaaatggtttgctg

SEQ ID NO: 49995 - DNA, 21 bp, Artificial sequence
  SiRNA target sequence
tgcagttaaatggtttgctga

SEQ ID NO: 49996 - DNA, 21 bp, Artificial sequence
  SiRNA target sequence
gcagttaaatggtttgctgat

SEQ ID NO: 49997 - DNA, 21 bp, Artificial sequence
  SiRNA target sequence
cagttaaatggtttgctgata

SEQ ID NO: 49998 - DNA, 21 bp, Artificial sequence
  SiRNA target sequence
agttaaatggtttgctgatat

SEQ ID NO: 49999 - DNA, 21 bp, Artificial sequence
  SiRNA target sequence
gttaaatggtttgctgatatt

SEQ ID NO: 50000 - DNA, 21 bp, Artificial sequence
  SiRNA target sequence
ttaaatggtttgctgatattg

SEQ ID NO: 50001 - DNA, 21 bp, Artificial sequence
  SiRNA target sequence
taaatggtttgctgatattgt

SEQ ID NO: 50002 - DNA, 21 bp, Artificial sequence
  SiRNA target sequence
aaatggtttgctgatattgta

SEQ ID NO: 50003 - DNA, 21 bp, Artificial sequence
  SiRNA target sequence
aatggtttgctgatattgtag

SEQ ID NO: 50004 - DNA, 21 bp, Artificial sequence
  SiRNA target sequence
atggtttgctgatattgtagg

SEQ ID NO: 50005 - DNA, 21 bp, Artificial sequence
  SiRNA target sequence
tggtttgctgatattgtagga

SEQ ID NO: 50006 - DNA, 21 bp, Artificial sequence
  SiRNA target sequence
ggtttgctgatattgtaggag

SEQ ID NO: 50007 - DNA, 21 bp, Artificial sequence
  SiRNA target sequence
gtttgctgatattgtaggagg

SEQ ID NO: 50008 - DNA, 21 bp, Artificial sequence
  SiRNA target sequence
tttgctgatattgtaggaggt

SEQ ID NO: 50009 - DNA, 21 bp, Artificial sequence
  SiRNA target sequence
ttgctgatattgtaggaggtg

SEQ ID NO: 50010 - DNA, 21 bp, Artificial sequence
  SiRNA target sequence
tgctgatattgtaggaggtgt

SEQ ID NO: 50011 - DNA, 21 bp, Artificial sequence
  SiRNA target sequence
gctgatattgtaggaggtgta

SEQ ID NO: 50012 - DNA, 21 bp, Artificial sequence
  SiRNA target sequence
ctgatattgtaggaggtgtag

SEQ ID NO: 50013 - DNA, 21 bp, Artificial sequence
  SiRNA target sequence
tgatattgtaggaggtgtagc

SEQ ID NO: 50014 - DNA, 21 bp, Artificial sequence
  SiRNA target sequence
gatattgtaggaggtgtagca

SEQ ID NO: 50015 - DNA, 21 bp, Artificial sequence
  SiRNA target sequence
atattgtaggaggtgtagcag

SEQ ID NO: 50016 - DNA, 21 bp, Artificial sequence
  SiRNA target sequence
tattgtaggaggtgtagcagc

SEQ ID NO: 50017 - DNA, 21 bp, Artificial sequence
  SiRNA target sequence
attgtaggaggtgtagcagcc

SEQ ID NO: 50018 - DNA, 21 bp, Artificial sequence
  SiRNA target sequence
ttgtaggaggtgtagcagcca

SEQ ID NO: 50019 - DNA, 21 bp, Artificial sequence
  SiRNA target sequence
tgtaggaggtgtagcagccat

SEQ ID NO: 50020 - DNA, 21 bp, Artificial sequence
  SiRNA target sequence
gtaggaggtgtagcagccata

SEQ ID NO: 50021 - DNA, 21 bp, Artificial sequence
  SiRNA target sequence
taggaggtgtagcagccatat

SEQ ID NO: 50022 - DNA, 21 bp, Artificial sequence
  SiRNA target sequence
aggaggtgtagcagccatatt

SEQ ID NO: 50023 - DNA, 21 bp, Artificial sequence
  SiRNA target sequence
ggaggtgtagcagccatattc

SEQ ID NO: 50024 - DNA, 21 bp, Artificial sequence
  SiRNA target sequence
gaggtgtagcagccatattcg

SEQ ID NO: 50025 - DNA, 21 bp, Artificial sequence
  SiRNA target sequence
aggtgtagcagccatattcgg

SEQ ID NO: 50026 - DNA, 21 bp, Artificial sequence
  SiRNA target sequence
ggtgtagcagccatattcggg

SEQ ID NO: 50027 - DNA, 21 bp, Artificial sequence
  SiRNA target sequence
gtgtagcagccatattcgggt

SEQ ID NO: 50028 - DNA, 21 bp, Artificial sequence
  SiRNA target sequence
tgtagcagccatattcgggtg

SEQ ID NO: 50029 - DNA, 21 bp, Artificial sequence
  SiRNA target sequence
gtagcagccatattcgggtgg

SEQ ID NO: 50030 - DNA, 21 bp, Artificial sequence
  SiRNA target sequence
tagcagccatattcgggtggt

SEQ ID NO: 50031 - DNA, 21 bp, Artificial sequence
  SiRNA target sequence
agcagccatattcgggtggtc

SEQ ID NO: 50032 - DNA, 21 bp, Artificial sequence
  SiRNA target sequence
gcagccatattcgggtggtcc

SEQ ID NO: 50033 - DNA, 21 bp, Artificial sequence
  SiRNA target sequence
cagccatattcgggtggtcca

SEQ ID NO: 50034 - DNA, 21 bp, Artificial sequence
  SiRNA target sequence
agccatattcgggtggtccaa

SEQ ID NO: 50035 - DNA, 21 bp, Artificial sequence
  SiRNA target sequence
gccatattcgggtggtccaaa

SEQ ID NO: 50036 - DNA, 21 bp, Artificial sequence
  SiRNA target sequence
ccatattcgggtggtccaaac

SEQ ID NO: 50037 - DNA, 21 bp, Artificial sequence
  SiRNA target sequence
catattcgggtggtccaaacc

SEQ ID NO: 50038 - DNA, 21 bp, Artificial sequence
  SiRNA target sequence
atattcgggtggtccaaaccc

SEQ ID NO: 50039 - DNA, 21 bp, Artificial sequence
  SiRNA target sequence
tattcgggtggtccaaacccc

SEQ ID NO: 50040 - DNA, 21 bp, Artificial sequence
  SiRNA target sequence
attcgggtggtccaaaccccg

SEQ ID NO: 50041 - DNA, 21 bp, Artificial sequence
  SiRNA target sequence
ttcgggtggtccaaaccccga

SEQ ID NO: 50042 - DNA, 21 bp, Artificial sequence
  SiRNA target sequence
tcgggtggtccaaaccccgaa

SEQ ID NO: 50043 - DNA, 21 bp, Artificial sequence
  SiRNA target sequence
cgggtggtccaaaccccgaaa

SEQ ID NO: 50044 - DNA, 21 bp, Artificial sequence
  SiRNA target sequence
gggtggtccaaaccccgaaat

SEQ ID NO: 50045 - DNA, 21 bp, Artificial sequence
  SiRNA target sequence
ggtggtccaaaccccgaaatc

SEQ ID NO: 50046 - DNA, 21 bp, Artificial sequence
  SiRNA target sequence
gtggtccaaaccccgaaatca

SEQ ID NO: 50047 - DNA, 21 bp, Artificial sequence
  SiRNA target sequence
tggtccaaaccccgaaatcag

SEQ ID NO: 50048 - DNA, 21 bp, Artificial sequence
  SiRNA target sequence
ggtccaaaccccgaaatcaga

SEQ ID NO: 50049 - DNA, 21 bp, Artificial sequence
  SiRNA target sequence
gtccaaaccccgaaatcagaa

SEQ ID NO: 50050 - DNA, 21 bp, Artificial sequence
  SiRNA target sequence
tccaaaccccgaaatcagaat

SEQ ID NO: 50051 - DNA, 21 bp, Artificial sequence
  SiRNA target sequence
ccaaaccccgaaatcagaatc

SEQ ID NO: 50052 - DNA, 21 bp, Artificial sequence
  SiRNA target sequence
caaaccccgaaatcagaatca

SEQ ID NO: 50053 - DNA, 21 bp, Artificial sequence
  SiRNA target sequence
aaaccccgaaatcagaatcaa

SEQ ID NO: 50054 - DNA, 21 bp, Artificial sequence
  SiRNA target sequence
aaccccgaaatcagaatcaag

SEQ ID NO: 50055 - DNA, 21 bp, Artificial sequence
  SiRNA target sequence
accccgaaatcagaatcaagt

SEQ ID NO: 50056 - DNA, 21 bp, Artificial sequence
  SiRNA target sequence
ccccgaaatcagaatcaagtg

SEQ ID NO: 50057 - DNA, 21 bp, Artificial sequence
  SiRNA target sequence
cccgaaatcagaatcaagtga

SEQ ID NO: 50058 - DNA, 21 bp, Artificial sequence
  SiRNA target sequence
ccgaaatcagaatcaagtgat

SEQ ID NO: 50059 - DNA, 21 bp, Artificial sequence
  SiRNA target sequence
cgaaatcagaatcaagtgatg

SEQ ID NO: 50060 - DNA, 21 bp, Artificial sequence
  SiRNA target sequence
gaaatcagaatcaagtgatgc

SEQ ID NO: 50061 - DNA, 21 bp, Artificial sequence
  SiRNA target sequence
aaatcagaatcaagtgatgcc

SEQ ID NO: 50062 - DNA, 21 bp, Artificial sequence
  SiRNA target sequence
aatcagaatcaagtgatgcct

SEQ ID NO: 50063 - DNA, 21 bp, Artificial sequence
  SiRNA target sequence
atcagaatcaagtgatgcctt

SEQ ID NO: 50064 - DNA, 21 bp, Artificial sequence
  SiRNA target sequence
tcagaatcaagtgatgcctta

SEQ ID NO: 50065 - DNA, 21 bp, Artificial sequence
  SiRNA target sequence
cagaatcaagtgatgccttat

SEQ ID NO: 50066 - DNA, 21 bp, Artificial sequence
  SiRNA target sequence
agaatcaagtgatgccttatc

SEQ ID NO: 50067 - DNA, 21 bp, Artificial sequence
  SiRNA target sequence
gaatcaagtgatgccttatca

SEQ ID NO: 50068 - DNA, 21 bp, Artificial sequence
  SiRNA target sequence
aatcaagtgatgccttatcag

SEQ ID NO: 50069 - DNA, 21 bp, Artificial sequence
  SiRNA target sequence
atcaagtgatgccttatcaga

SEQ ID NO: 50070 - DNA, 21 bp, Artificial sequence
  SiRNA target sequence
tcaagtgatgccttatcagaa

SEQ ID NO: 50071 - DNA, 21 bp, Artificial sequence
  SiRNA target sequence
caagtgatgccttatcagaat

SEQ ID NO: 50072 - DNA, 21 bp, Artificial sequence
  SiRNA target sequence
aagtgatgccttatcagaatg

SEQ ID NO: 50073 - DNA, 21 bp, Artificial sequence
  SiRNA target sequence
agtgatgccttatcagaatgt

SEQ ID NO: 50074 - DNA, 21 bp, Artificial sequence
  SiRNA target sequence
gtgatgccttatcagaatgtg

SEQ ID NO: 50075 - DNA, 21 bp, Artificial sequence
  SiRNA target sequence
tgatgccttatcagaatgtgc

SEQ ID NO: 50076 - DNA, 21 bp, Artificial sequence
  SiRNA target sequence
gatgccttatcagaatgtgcc

SEQ ID NO: 50077 - DNA, 21 bp, Artificial sequence
  SiRNA target sequence
atgccttatcagaatgtgcct

SEQ ID NO: 50078 - DNA, 21 bp, Artificial sequence
  SiRNA target sequence
tgccttatcagaatgtgcctg

SEQ ID NO: 50079 - DNA, 21 bp, Artificial sequence
  SiRNA target sequence
gccttatcagaatgtgcctgg

SEQ ID NO: 50080 - DNA, 21 bp, Artificial sequence
  SiRNA target sequence
ccttatcagaatgtgcctgga

SEQ ID NO: 50081 - DNA, 21 bp, Artificial sequence
  SiRNA target sequence
cttatcagaatgtgcctggat

SEQ ID NO: 50082 - DNA, 21 bp, Artificial sequence
  SiRNA target sequence
ttatcagaatgtgcctggatg

SEQ ID NO: 50083 - DNA, 21 bp, Artificial sequence
  SiRNA target sequence
tatcagaatgtgcctggatgg

SEQ ID NO: 50084 - DNA, 21 bp, Artificial sequence
  SiRNA target sequence
atcagaatgtgcctggatggg

SEQ ID NO: 50085 - DNA, 21 bp, Artificial sequence
  SiRNA target sequence
tcagaatgtgcctggatgggg

SEQ ID NO: 50086 - DNA, 21 bp, Artificial sequence
  SiRNA target sequence
cagaatgtgcctggatgggga

SEQ ID NO: 50087 - DNA, 21 bp, Artificial sequence
  SiRNA target sequence
agaatgtgcctggatggggat

SEQ ID NO: 50088 - DNA, 21 bp, Artificial sequence
  SiRNA target sequence
gaatgtgcctggatggggata

SEQ ID NO: 50089 - DNA, 21 bp, Artificial sequence
  SiRNA target sequence
aatgtgcctggatggggatat

SEQ ID NO: 50090 - DNA, 21 bp, Artificial sequence
  SiRNA target sequence
atgtgcctggatggggatatt

SEQ ID NO: 50091 - DNA, 21 bp, Artificial sequence
  SiRNA target sequence
tgtgcctggatggggatattc

SEQ ID NO: 50092 - DNA, 21 bp, Artificial sequence
  SiRNA target sequence
gtgcctggatggggatattcc

SEQ ID NO: 50093 - DNA, 21 bp, Artificial sequence
  SiRNA target sequence
tgcctggatggggatattccc

SEQ ID NO: 50094 - DNA, 21 bp, Artificial sequence
  SiRNA target sequence
gcctggatggggatattccct

SEQ ID NO: 50095 - DNA, 21 bp, Artificial sequence
  SiRNA target sequence
cctggatggggatattcccta

SEQ ID NO: 50096 - DNA, 21 bp, Artificial sequence
  SiRNA target sequence
ctggatggggatattccctat

SEQ ID NO: 50097 - DNA, 21 bp, Artificial sequence
  SiRNA target sequence
tggatggggatattccctata

SEQ ID NO: 50098 - DNA, 21 bp, Artificial sequence
  SiRNA target sequence
ggatggggatattccctatat

SEQ ID NO: 50099 - DNA, 21 bp, Artificial sequence
  SiRNA target sequence
gatggggatattccctatata

SEQ ID NO: 50100 - DNA, 21 bp, Artificial sequence
  SiRNA target sequence
atggggatattccctatataa

SEQ ID NO: 50101 - DNA, 21 bp, Artificial sequence
  SiRNA target sequence
tggggatattccctatataaa

SEQ ID NO: 50102 - DNA, 21 bp, Artificial sequence
  SiRNA target sequence
ggggatattccctatataaag

SEQ ID NO: 50103 - DNA, 21 bp, Artificial sequence
  SiRNA target sequence
gggatattccctatataaagg

SEQ ID NO: 50104 - DNA, 21 bp, Artificial sequence
  SiRNA target sequence
ggatattccctatataaaggc

SEQ ID NO: 50105 - DNA, 21 bp, Artificial sequence
  SiRNA target sequence
gatattccctatataaaggca

SEQ ID NO: 50106 - DNA, 21 bp, Artificial sequence
  SiRNA target sequence
atattccctatataaaggcat

SEQ ID NO: 50107 - DNA, 21 bp, Artificial sequence
  SiRNA target sequence
tattccctatataaaggcatt

SEQ ID NO: 50108 - DNA, 21 bp, Artificial sequence
  SiRNA target sequence
attccctatataaaggcattg

SEQ ID NO: 50109 - DNA, 21 bp, Artificial sequence
  SiRNA target sequence
ttccctatataaaggcattga

SEQ ID NO: 50110 - DNA, 21 bp, Artificial sequence
  SiRNA target sequence
tccctatataaaggcattgac

SEQ ID NO: 50111 - DNA, 21 bp, Artificial sequence
  SiRNA target sequence
ccctatataaaggcattgaca

SEQ ID NO: 50112 - DNA, 21 bp, Artificial sequence
  SiRNA target sequence
cctatataaaggcattgacat

SEQ ID NO: 50113 - DNA, 21 bp, Artificial sequence
  SiRNA target sequence
ctatataaaggcattgacatg

SEQ ID NO: 50114 - DNA, 21 bp, Artificial sequence
  SiRNA target sequence
tatataaaggcattgacatga

SEQ ID NO: 50115 - DNA, 21 bp, Artificial sequence
  SiRNA target sequence
atataaaggcattgacatgag

SEQ ID NO: 50116 - DNA, 21 bp, Artificial sequence
  SiRNA target sequence
tataaaggcattgacatgagt

SEQ ID NO: 50117 - DNA, 21 bp, Artificial sequence
  SiRNA target sequence
ataaaggcattgacatgagtg

SEQ ID NO: 50118 - DNA, 21 bp, Artificial sequence
  SiRNA target sequence
taaaggcattgacatgagtgt

SEQ ID NO: 50119 - DNA, 21 bp, Artificial sequence
  SiRNA target sequence
aaaggcattgacatgagtgta

SEQ ID NO: 50120 - DNA, 21 bp, Artificial sequence
  SiRNA target sequence
aaggcattgacatgagtgtac

SEQ ID NO: 50121 - DNA, 21 bp, Artificial sequence
  SiRNA target sequence
aggcattgacatgagtgtacc

SEQ ID NO: 50122 - DNA, 21 bp, Artificial sequence
  SiRNA target sequence
ggcattgacatgagtgtacca

SEQ ID NO: 50123 - DNA, 21 bp, Artificial sequence
  SiRNA target sequence
gcattgacatgagtgtaccac

SEQ ID NO: 50124 - DNA, 21 bp, Artificial sequence
  SiRNA target sequence
cattgacatgagtgtaccact

SEQ ID NO: 50125 - DNA, 21 bp, Artificial sequence
  SiRNA target sequence
attgacatgagtgtaccactt

SEQ ID NO: 50126 - DNA, 21 bp, Artificial sequence
  SiRNA target sequence
ttgacatgagtgtaccacttg

SEQ ID NO: 50127 - DNA, 21 bp, Artificial sequence
  SiRNA target sequence
tgacatgagtgtaccacttgc

SEQ ID NO: 50128 - DNA, 21 bp, Artificial sequence
  SiRNA target sequence
gacatgagtgtaccacttgct

SEQ ID NO: 50129 - DNA, 21 bp, Artificial sequence
  SiRNA target sequence
acatgagtgtaccacttgctt

SEQ ID NO: 50130 - DNA, 21 bp, Artificial sequence
  SiRNA target sequence
catgagtgtaccacttgctta

SEQ ID NO: 50131 - DNA, 21 bp, Artificial sequence
  SiRNA target sequence
atgagtgtaccacttgcttat

SEQ ID NO: 50132 - DNA, 21 bp, Artificial sequence
  SiRNA target sequence
tgagtgtaccacttgcttatg

SEQ ID NO: 50133 - DNA, 21 bp, Artificial sequence
  SiRNA target sequence
gagtgtaccacttgcttatga

SEQ ID NO: 50134 - DNA, 21 bp, Artificial sequence
  SiRNA target sequence
agtgtaccacttgcttatgac

SEQ ID NO: 50135 - DNA, 21 bp, Artificial sequence
  SiRNA target sequence
gtgtaccacttgcttatgacc

SEQ ID NO: 50136 - DNA, 21 bp, Artificial sequence
  SiRNA target sequence
tgtaccacttgcttatgaccc

SEQ ID NO: 50137 - DNA, 21 bp, Artificial sequence
  SiRNA target sequence
gtaccacttgcttatgacccc

SEQ ID NO: 50138 - DNA, 21 bp, Artificial sequence
  SiRNA target sequence
taccacttgcttatgacccca

SEQ ID NO: 50139 - DNA, 21 bp, Artificial sequence
  SiRNA target sequence
accacttgcttatgaccccaa

SEQ ID NO: 50140 - DNA, 21 bp, Artificial sequence
  SiRNA target sequence
ccacttgcttatgaccccaat

SEQ ID NO: 50141 - DNA, 21 bp, Artificial sequence
  SiRNA target sequence
cacttgcttatgaccccaata

SEQ ID NO: 50142 - DNA, 21 bp, Artificial sequence
  SiRNA target sequence
acttgcttatgaccccaataa

SEQ ID NO: 50143 - DNA, 21 bp, Artificial sequence
  SiRNA target sequence
cttgcttatgaccccaataac

SEQ ID NO: 50144 - DNA, 21 bp, Artificial sequence
  SiRNA target sequence
ttgcttatgaccccaataacg

SEQ ID NO: 50145 - DNA, 21 bp, Artificial sequence
  SiRNA target sequence
tgcttatgaccccaataacga

SEQ ID NO: 50146 - DNA, 21 bp, Artificial sequence
  SiRNA target sequence
gcttatgaccccaataacgaa

SEQ ID NO: 50147 - DNA, 21 bp, Artificial sequence
  SiRNA target sequence
cttatgaccccaataacgaat

SEQ ID NO: 50148 - DNA, 21 bp, Artificial sequence
  SiRNA target sequence
ttatgaccccaataacgaatt

SEQ ID NO: 50149 - DNA, 21 bp, Artificial sequence
  SiRNA target sequence
tatgaccccaataacgaatta

SEQ ID NO: 50150 - DNA, 21 bp, Artificial sequence
  SiRNA target sequence
atgaccccaataacgaattag

SEQ ID NO: 50151 - DNA, 21 bp, Artificial sequence
  SiRNA target sequence
tgaccccaataacgaattagg

SEQ ID NO: 50152 - DNA, 21 bp, Artificial sequence
  SiRNA target sequence
gaccccaataacgaattagga

SEQ ID NO: 50153 - DNA, 21 bp, Artificial sequence
  SiRNA target sequence
accccaataacgaattaggag

SEQ ID NO: 50154 - DNA, 21 bp, Artificial sequence
  SiRNA target sequence
ccccaataacgaattaggaga

SEQ ID NO: 50155 - DNA, 21 bp, Artificial sequence
  SiRNA target sequence
cccaataacgaattaggagac

SEQ ID NO: 50156 - DNA, 21 bp, Artificial sequence
  SiRNA target sequence
ccaataacgaattaggagact

SEQ ID NO: 50157 - DNA, 21 bp, Artificial sequence
  SiRNA target sequence
caataacgaattaggagactt

SEQ ID NO: 50158 - DNA, 21 bp, Artificial sequence
  SiRNA target sequence
aataacgaattaggagacttg

SEQ ID NO: 50159 - DNA, 21 bp, Artificial sequence
  SiRNA target sequence
ataacgaattaggagacttgc

SEQ ID NO: 50160 - DNA, 21 bp, Artificial sequence
  SiRNA target sequence
taacgaattaggagacttgcg

SEQ ID NO: 50161 - DNA, 21 bp, Artificial sequence
  SiRNA target sequence
aacgaattaggagacttgcga

SEQ ID NO: 50162 - DNA, 21 bp, Artificial sequence
  SiRNA target sequence
acgaattaggagacttgcgag

SEQ ID NO: 50163 - DNA, 21 bp, Artificial sequence
  SiRNA target sequence
cgaattaggagacttgcgaga

SEQ ID NO: 50164 - DNA, 21 bp, Artificial sequence
  SiRNA target sequence
gaattaggagacttgcgagat

SEQ ID NO: 50165 - DNA, 21 bp, Artificial sequence
  SiRNA target sequence
aattaggagacttgcgagatg

SEQ ID NO: 50166 - DNA, 21 bp, Artificial sequence
  SiRNA target sequence
attaggagacttgcgagatgt

SEQ ID NO: 50167 - DNA, 21 bp, Artificial sequence
  SiRNA target sequence
ttaggagacttgcgagatgta

SEQ ID NO: 50168 - DNA, 21 bp, Artificial sequence
  SiRNA target sequence
taggagacttgcgagatgtat

SEQ ID NO: 50169 - DNA, 21 bp, Artificial sequence
  SiRNA target sequence
aggagacttgcgagatgtatt

SEQ ID NO: 50170 - DNA, 21 bp, Artificial sequence
  SiRNA target sequence
ggagacttgcgagatgtattt

SEQ ID NO: 50171 - DNA, 21 bp, Artificial sequence
  SiRNA target sequence
gagacttgcgagatgtatttc

SEQ ID NO: 50172 - DNA, 21 bp, Artificial sequence
  SiRNA target sequence
agacttgcgagatgtatttcc

SEQ ID NO: 50173 - DNA, 21 bp, Artificial sequence
  SiRNA target sequence
gacttgcgagatgtatttcca

SEQ ID NO: 50174 - DNA, 21 bp, Artificial sequence
  SiRNA target sequence
acttgcgagatgtatttccat

SEQ ID NO: 50175 - DNA, 21 bp, Artificial sequence
  SiRNA target sequence
cttgcgagatgtatttccatc

SEQ ID NO: 50176 - DNA, 21 bp, Artificial sequence
  SiRNA target sequence
ttgcgagatgtatttccatct

SEQ ID NO: 50177 - DNA, 21 bp, Artificial sequence
  SiRNA target sequence
tgcgagatgtatttccatctg

SEQ ID NO: 50178 - DNA, 21 bp, Artificial sequence
  SiRNA target sequence
gcgagatgtatttccatctgc

SEQ ID NO: 50179 - DNA, 21 bp, Artificial sequence
  SiRNA target sequence
cgagatgtatttccatctgcc

SEQ ID NO: 50180 - DNA, 21 bp, Artificial sequence
  SiRNA target sequence
gagatgtatttccatctgccg

SEQ ID NO: 50181 - DNA, 21 bp, Artificial sequence
  SiRNA target sequence
agatgtatttccatctgccgt

SEQ ID NO: 50182 - DNA, 21 bp, Artificial sequence
  SiRNA target sequence
gatgtatttccatctgccgta

SEQ ID NO: 50183 - DNA, 21 bp, Artificial sequence
  SiRNA target sequence
atgtatttccatctgccgtag

SEQ ID NO: 50184 - DNA, 21 bp, Artificial sequence
  SiRNA target sequence
tgtatttccatctgccgtaga

SEQ ID NO: 50185 - DNA, 21 bp, Artificial sequence
  SiRNA target sequence
gtatttccatctgccgtagac

SEQ ID NO: 50186 - DNA, 21 bp, Artificial sequence
  SiRNA target sequence
tatttccatctgccgtagacg

SEQ ID NO: 50187 - DNA, 21 bp, Artificial sequence
  SiRNA target sequence
atttccatctgccgtagacga

SEQ ID NO: 50188 - DNA, 21 bp, Artificial sequence
  SiRNA target sequence
tttccatctgccgtagacgaa

SEQ ID NO: 50189 - DNA, 21 bp, Artificial sequence
  SiRNA target sequence
ttccatctgccgtagacgaaa

SEQ ID NO: 50190 - DNA, 21 bp, Artificial sequence
  SiRNA target sequence
tccatctgccgtagacgaaat

SEQ ID NO: 50191 - DNA, 21 bp, Artificial sequence
  SiRNA target sequence
ccatctgccgtagacgaaatg

SEQ ID NO: 50192 - DNA, 21 bp, Artificial sequence
  SiRNA target sequence
catctgccgtagacgaaatgg

SEQ ID NO: 50193 - DNA, 21 bp, Artificial sequence
  SiRNA target sequence
atctgccgtagacgaaatggc

SEQ ID NO: 50194 - DNA, 21 bp, Artificial sequence
  SiRNA target sequence
tctgccgtagacgaaatggct

SEQ ID NO: 50195 - DNA, 21 bp, Artificial sequence
  SiRNA target sequence
ctgccgtagacgaaatggcta

SEQ ID NO: 50196 - DNA, 21 bp, Artificial sequence
  SiRNA target sequence
tgccgtagacgaaatggctat

SEQ ID NO: 50197 - DNA, 21 bp, Artificial sequence
  SiRNA target sequence
gccgtagacgaaatggctatt

SEQ ID NO: 50198 - DNA, 21 bp, Artificial sequence
  SiRNA target sequence
ccgtagacgaaatggctattg

SEQ ID NO: 50199 - DNA, 21 bp, Artificial sequence
  SiRNA target sequence
cgtagacgaaatggctattgg

SEQ ID NO: 50200 - DNA, 21 bp, Artificial sequence
  SiRNA target sequence
gtagacgaaatggctattgga

SEQ ID NO: 50201 - DNA, 21 bp, Artificial sequence
  SiRNA target sequence
tagacgaaatggctattggat

SEQ ID NO: 50202 - DNA, 21 bp, Artificial sequence
  SiRNA target sequence
agacgaaatggctattggata

SEQ ID NO: 50203 - DNA, 21 bp, Artificial sequence
  SiRNA target sequence
gacgaaatggctattggatat

SEQ ID NO: 50204 - DNA, 21 bp, Artificial sequence
  SiRNA target sequence
acgaaatggctattggatatg

SEQ ID NO: 50205 - DNA, 21 bp, Artificial sequence
  SiRNA target sequence
cgaaatggctattggatatgt

SEQ ID NO: 50206 - DNA, 21 bp, Artificial sequence
  SiRNA target sequence
gaaatggctattggatatgtt

SEQ ID NO: 50207 - DNA, 21 bp, Artificial sequence
  SiRNA target sequence
aaatggctattggatatgttt

SEQ ID NO: 50208 - DNA, 21 bp, Artificial sequence
  SiRNA target sequence
aatggctattggatatgtttg

SEQ ID NO: 50209 - DNA, 21 bp, Artificial sequence
  SiRNA target sequence
atggctattggatatgtttgt

SEQ ID NO: 50210 - DNA, 21 bp, Artificial sequence
  SiRNA target sequence
tggctattggatatgtttgtg

SEQ ID NO: 50211 - DNA, 21 bp, Artificial sequence
  SiRNA target sequence
ggctattggatatgtttgtgg

SEQ ID NO: 50212 - DNA, 21 bp, Artificial sequence
  SiRNA target sequence
gctattggatatgtttgtggc

SEQ ID NO: 50213 - DNA, 21 bp, Artificial sequence
  SiRNA target sequence
ctattggatatgtttgtggca

SEQ ID NO: 50214 - DNA, 21 bp, Artificial sequence
  SiRNA target sequence
tattggatatgtttgtggcaa

SEQ ID NO: 50215 - DNA, 21 bp, Artificial sequence
  SiRNA target sequence
attggatatgtttgtggcaat

SEQ ID NO: 50216 - DNA, 21 bp, Artificial sequence
  SiRNA target sequence
ttggatatgtttgtggcaatc

SEQ ID NO: 50217 - DNA, 21 bp, Artificial sequence
  SiRNA target sequence
tggatatgtttgtggcaatcc

SEQ ID NO: 50218 - DNA, 21 bp, Artificial sequence
  SiRNA target sequence
ggatatgtttgtggcaatcca

SEQ ID NO: 50219 - DNA, 21 bp, Artificial sequence
  SiRNA target sequence
gatatgtttgtggcaatccag

SEQ ID NO: 50220 - DNA, 21 bp, Artificial sequence
  SiRNA target sequence
atatgtttgtggcaatccagc

SEQ ID NO: 50221 - DNA, 21 bp, Artificial sequence
  SiRNA target sequence
tatgtttgtggcaatccagct

SEQ ID NO: 50222 - DNA, 21 bp, Artificial sequence
  SiRNA target sequence
atgtttgtggcaatccagcta

SEQ ID NO: 50223 - DNA, 21 bp, Artificial sequence
  SiRNA target sequence
tgtttgtggcaatccagctat

SEQ ID NO: 50224 - DNA, 21 bp, Artificial sequence
  SiRNA target sequence
gtttgtggcaatccagctata

SEQ ID NO: 50225 - DNA, 21 bp, Artificial sequence
  SiRNA target sequence
tttgtggcaatccagctataa

SEQ ID NO: 50226 - DNA, 21 bp, Artificial sequence
  SiRNA target sequence
ttgtggcaatccagctataaa

SEQ ID NO: 50227 - DNA, 21 bp, Artificial sequence
  SiRNA target sequence
tgtggcaatccagctataaaa

SEQ ID NO: 50228 - DNA, 21 bp, Artificial sequence
  SiRNA target sequence
gtggcaatccagctataaaac

SEQ ID NO: 50229 - DNA, 21 bp, Artificial sequence
  SiRNA target sequence
tggcaatccagctataaaaca

SEQ ID NO: 50230 - DNA, 21 bp, Artificial sequence
  SiRNA target sequence
ggcaatccagctataaaacat

SEQ ID NO: 50231 - DNA, 21 bp, Artificial sequence
  SiRNA target sequence
gcaatccagctataaaacatg

SEQ ID NO: 50232 - DNA, 21 bp, Artificial sequence
  SiRNA target sequence
caatccagctataaaacatgt

SEQ ID NO: 50233 - DNA, 21 bp, Artificial sequence
  SiRNA target sequence
aatccagctataaaacatgtc

SEQ ID NO: 50234 - DNA, 21 bp, Artificial sequence
  SiRNA target sequence
atccagctataaaacatgtcc

SEQ ID NO: 50235 - DNA, 21 bp, Artificial sequence
  SiRNA target sequence
tccagctataaaacatgtcct

SEQ ID NO: 50236 - DNA, 21 bp, Artificial sequence
  SiRNA target sequence
ccagctataaaacatgtcctc

SEQ ID NO: 50237 - DNA, 21 bp, Artificial sequence
  SiRNA target sequence
cagctataaaacatgtcctca

SEQ ID NO: 50238 - DNA, 21 bp, Artificial sequence
  SiRNA target sequence
agctataaaacatgtcctcac

SEQ ID NO: 50239 - DNA, 21 bp, Artificial sequence
  SiRNA target sequence
gctataaaacatgtcctcacc

SEQ ID NO: 50240 - DNA, 21 bp, Artificial sequence
  SiRNA target sequence
ctataaaacatgtcctcacct

SEQ ID NO: 50241 - DNA, 21 bp, Artificial sequence
  SiRNA target sequence
tataaaacatgtcctcacctg

SEQ ID NO: 50242 - DNA, 21 bp, Artificial sequence
  SiRNA target sequence
ataaaacatgtcctcacctgg

SEQ ID NO: 50243 - DNA, 21 bp, Artificial sequence
  SiRNA target sequence
taaaacatgtcctcacctgga

SEQ ID NO: 50244 - DNA, 21 bp, Artificial sequence
  SiRNA target sequence
aaaacatgtcctcacctggag

SEQ ID NO: 50245 - DNA, 21 bp, Artificial sequence
  SiRNA target sequence
aaacatgtcctcacctggagt

SEQ ID NO: 50246 - DNA, 21 bp, Artificial sequence
  SiRNA target sequence
aacatgtcctcacctggagta

SEQ ID NO: 50247 - DNA, 21 bp, Artificial sequence
  SiRNA target sequence
acatgtcctcacctggagtac

SEQ ID NO: 50248 - DNA, 21 bp, Artificial sequence
  SiRNA target sequence
catgtcctcacctggagtacg

SEQ ID NO: 50249 - DNA, 21 bp, Artificial sequence
  SiRNA target sequence
atgtcctcacctggagtacga

SEQ ID NO: 50250 - DNA, 21 bp, Artificial sequence
  SiRNA target sequence
tgtcctcacctggagtacgac

SEQ ID NO: 50251 - DNA, 21 bp, Artificial sequence
  SiRNA target sequence
gtcctcacctggagtacgaca

SEQ ID NO: 50252 - DNA, 21 bp, Artificial sequence
  SiRNA target sequence
tcctcacctggagtacgacag

SEQ ID NO: 50253 - DNA, 21 bp, Artificial sequence
  SiRNA target sequence
cctcacctggagtacgacaga

SEQ ID NO: 50254 - DNA, 21 bp, Artificial sequence
  SiRNA target sequence
ctcacctggagtacgacagat

SEQ ID NO: 50255 - DNA, 21 bp, Artificial sequence
  SiRNA target sequence
tcacctggagtacgacagatg

SEQ ID NO: 50256 - DNA, 21 bp, Artificial sequence
  SiRNA target sequence
cacctggagtacgacagatgt

SEQ ID NO: 50257 - DNA, 21 bp, Artificial sequence
  SiRNA target sequence
acctggagtacgacagatgtg

SEQ ID NO: 50258 - DNA, 21 bp, Artificial sequence
  SiRNA target sequence
cctggagtacgacagatgtgg

SEQ ID NO: 50259 - DNA, 21 bp, Artificial sequence
  SiRNA target sequence
ctggagtacgacagatgtggt

SEQ ID NO: 50260 - DNA, 21 bp, Artificial sequence
  SiRNA target sequence
tggagtacgacagatgtggtt

SEQ ID NO: 50261 - DNA, 21 bp, Artificial sequence
  SiRNA target sequence
ggagtacgacagatgtggttc

SEQ ID NO: 50262 - DNA, 21 bp, Artificial sequence
  SiRNA target sequence
gagtacgacagatgtggttca

SEQ ID NO: 50263 - DNA, 21 bp, Artificial sequence
  SiRNA target sequence
agtacgacagatgtggttcaa

SEQ ID NO: 50264 - DNA, 21 bp, Artificial sequence
  SiRNA target sequence
gtacgacagatgtggttcaaa

SEQ ID NO: 50265 - DNA, 21 bp, Artificial sequence
  SiRNA target sequence
tacgacagatgtggttcaaaa

SEQ ID NO: 50266 - DNA, 21 bp, Artificial sequence
  SiRNA target sequence
acgacagatgtggttcaaaac

SEQ ID NO: 50267 - DNA, 21 bp, Artificial sequence
  SiRNA target sequence
cgacagatgtggttcaaaacc

SEQ ID NO: 50268 - DNA, 21 bp, Artificial sequence
  SiRNA target sequence
gacagatgtggttcaaaaccc

SEQ ID NO: 50269 - DNA, 21 bp, Artificial sequence
  SiRNA target sequence
acagatgtggttcaaaacccg

SEQ ID NO: 50270 - DNA, 21 bp, Artificial sequence
  SiRNA target sequence
cagatgtggttcaaaacccga

SEQ ID NO: 50271 - DNA, 21 bp, Artificial sequence
  SiRNA target sequence
agatgtggttcaaaacccgat

SEQ ID NO: 50272 - DNA, 21 bp, Artificial sequence
  SiRNA target sequence
gatgtggttcaaaacccgata

SEQ ID NO: 50273 - DNA, 21 bp, Artificial sequence
  SiRNA target sequence
atgtggttcaaaacccgataa

SEQ ID NO: 50274 - DNA, 21 bp, Artificial sequence
  SiRNA target sequence
tgtggttcaaaacccgataag

SEQ ID NO: 50275 - DNA, 21 bp, Artificial sequence
  SiRNA target sequence
gtggttcaaaacccgataagt

SEQ ID NO: 50276 - DNA, 21 bp, Artificial sequence
  SiRNA target sequence
tggttcaaaacccgataagta

SEQ ID NO: 50277 - DNA, 21 bp, Artificial sequence
  SiRNA target sequence
ggttcaaaacccgataagtaa

SEQ ID NO: 50278 - DNA, 21 bp, Artificial sequence
  SiRNA target sequence
gttcaaaacccgataagtaac

SEQ ID NO: 50279 - DNA, 21 bp, Artificial sequence
  SiRNA target sequence
ttcaaaacccgataagtaacg

SEQ ID NO: 50280 - DNA, 21 bp, Artificial sequence
  SiRNA target sequence
tcaaaacccgataagtaacgg

SEQ ID NO: 50281 - DNA, 21 bp, Artificial sequence
  SiRNA target sequence
caaaacccgataagtaacgga

SEQ ID NO: 50282 - DNA, 21 bp, Artificial sequence
  SiRNA target sequence
aaaacccgataagtaacggag

SEQ ID NO: 50283 - DNA, 21 bp, Artificial sequence
  SiRNA target sequence
aaacccgataagtaacggaga

SEQ ID NO: 50284 - DNA, 21 bp, Artificial sequence
  SiRNA target sequence
aacccgataagtaacggagat

SEQ ID NO: 50285 - DNA, 21 bp, Artificial sequence
  SiRNA target sequence
acccgataagtaacggagatg

SEQ ID NO: 50286 - DNA, 21 bp, Artificial sequence
  SiRNA target sequence
cccgataagtaacggagatga

SEQ ID NO: 50287 - DNA, 21 bp, Artificial sequence
  SiRNA target sequence
ccgataagtaacggagatgat

SEQ ID NO: 50288 - DNA, 21 bp, Artificial sequence
  SiRNA target sequence
cgataagtaacggagatgatt

SEQ ID NO: 50289 - DNA, 21 bp, Artificial sequence
  SiRNA target sequence
gataagtaacggagatgattg

SEQ ID NO: 50290 - DNA, 21 bp, Artificial sequence
  SiRNA target sequence
ataagtaacggagatgattgg

SEQ ID NO: 50291 - DNA, 21 bp, Artificial sequence
  SiRNA target sequence
taagtaacggagatgattggg

SEQ ID NO: 50292 - DNA, 21 bp, Artificial sequence
  SiRNA target sequence
aagtaacggagatgattgggg

SEQ ID NO: 50293 - DNA, 21 bp, Artificial sequence
  SiRNA target sequence
agtaacggagatgattggggc

SEQ ID NO: 50294 - DNA, 21 bp, Artificial sequence
  SiRNA target sequence
gtaacggagatgattggggcg

SEQ ID NO: 50295 - DNA, 21 bp, Artificial sequence
  SiRNA target sequence
taacggagatgattggggcgg

SEQ ID NO: 50296 - DNA, 21 bp, Artificial sequence
  SiRNA target sequence
aacggagatgattggggcggt

SEQ ID NO: 50297 - DNA, 21 bp, Artificial sequence
  SiRNA target sequence
acggagatgattggggcggtg

SEQ ID NO: 50298 - DNA, 21 bp, Artificial sequence
  SiRNA target sequence
cggagatgattggggcggtgt

SEQ ID NO: 50299 - DNA, 21 bp, Artificial sequence
  SiRNA target sequence
ggagatgattggggcggtgta

SEQ ID NO: 50300 - DNA, 21 bp, Artificial sequence
  SiRNA target sequence
gagatgattggggcggtgtaa

SEQ ID NO: 50301 - DNA, 21 bp, Artificial sequence
  SiRNA target sequence
agatgattggggcggtgtaat

SEQ ID NO: 50302 - DNA, 21 bp, Artificial sequence
  SiRNA target sequence
gatgattggggcggtgtaata

SEQ ID NO: 50303 - DNA, 21 bp, Artificial sequence
  SiRNA target sequence
atgattggggcggtgtaatac

SEQ ID NO: 50304 - DNA, 21 bp, Artificial sequence
  SiRNA target sequence
tgattggggcggtgtaatacc

SEQ ID NO: 50305 - DNA, 21 bp, Artificial sequence
  SiRNA target sequence
gattggggcggtgtaatacca

SEQ ID NO: 50306 - DNA, 21 bp, Artificial sequence
  SiRNA target sequence
attggggcggtgtaataccag

SEQ ID NO: 50307 - DNA, 21 bp, Artificial sequence
  SiRNA target sequence
ttggggcggtgtaataccagt

SEQ ID NO: 50308 - DNA, 21 bp, Artificial sequence
  SiRNA target sequence
tggggcggtgtaataccagtg

SEQ ID NO: 50309 - DNA, 21 bp, Artificial sequence
  SiRNA target sequence
ggggcggtgtaataccagtgg

SEQ ID NO: 50310 - DNA, 21 bp, Artificial sequence
  SiRNA target sequence
gggcggtgtaataccagtggg

SEQ ID NO: 50311 - DNA, 21 bp, Artificial sequence
  SiRNA target sequence
ggcggtgtaataccagtggga

SEQ ID NO: 50312 - DNA, 21 bp, Artificial sequence
  SiRNA target sequence
gcggtgtaataccagtgggaa

SEQ ID NO: 50313 - DNA, 21 bp, Artificial sequence
  SiRNA target sequence
cggtgtaataccagtgggaat

SEQ ID NO: 50314 - DNA, 21 bp, Artificial sequence
  SiRNA target sequence
ggtgtaataccagtgggaatg

SEQ ID NO: 50315 - DNA, 21 bp, Artificial sequence
  SiRNA target sequence
gtgtaataccagtgggaatgc

SEQ ID NO: 50316 - DNA, 21 bp, Artificial sequence
  SiRNA target sequence
tgtaataccagtgggaatgcc

SEQ ID NO: 50317 - DNA, 21 bp, Artificial sequence
  SiRNA target sequence
gtaataccagtgggaatgcct

SEQ ID NO: 50318 - DNA, 21 bp, Artificial sequence
  SiRNA target sequence
taataccagtgggaatgcctt

SEQ ID NO: 50319 - DNA, 21 bp, Artificial sequence
  SiRNA target sequence
aataccagtgggaatgccttg

SEQ ID NO: 50320 - DNA, 21 bp, Artificial sequence
  SiRNA target sequence
ataccagtgggaatgccttgc

SEQ ID NO: 50321 - DNA, 21 bp, Artificial sequence
  SiRNA target sequence
taccagtgggaatgccttgct

SEQ ID NO: 50322 - DNA, 21 bp, Artificial sequence
  SiRNA target sequence
accagtgggaatgccttgcta

SEQ ID NO: 50323 - DNA, 21 bp, Artificial sequence
  SiRNA target sequence
ccagtgggaatgccttgctac

SEQ ID NO: 50324 - DNA, 21 bp, Artificial sequence
  SiRNA target sequence
cagtgggaatgccttgctact

SEQ ID NO: 50325 - DNA, 21 bp, Artificial sequence
  SiRNA target sequence
agtgggaatgccttgctactc

SEQ ID NO: 50326 - DNA, 21 bp, Artificial sequence
  SiRNA target sequence
gtgggaatgccttgctactct

SEQ ID NO: 50327 - DNA, 21 bp, Artificial sequence
  SiRNA target sequence
tgggaatgccttgctactcta

SEQ ID NO: 50328 - DNA, 21 bp, Artificial sequence
  SiRNA target sequence
gggaatgccttgctactctaa

SEQ ID NO: 50329 - DNA, 21 bp, Artificial sequence
  SiRNA target sequence
ggaatgccttgctactctaag

SEQ ID NO: 50330 - DNA, 21 bp, Artificial sequence
  SiRNA target sequence
gaatgccttgctactctaaga

SEQ ID NO: 50331 - DNA, 21 bp, Artificial sequence
  SiRNA target sequence
aatgccttgctactctaagac

SEQ ID NO: 50332 - DNA, 21 bp, Artificial sequence
  SiRNA target sequence
atgccttgctactctaagact

SEQ ID NO: 50333 - DNA, 21 bp, Artificial sequence
  SiRNA target sequence
tgccttgctactctaagacta

SEQ ID NO: 50334 - DNA, 21 bp, Artificial sequence
  SiRNA target sequence
gccttgctactctaagactat

SEQ ID NO: 50335 - DNA, 21 bp, Artificial sequence
  SiRNA target sequence
ccttgctactctaagactatt

SEQ ID NO: 50336 - DNA, 21 bp, Artificial sequence
  SiRNA target sequence
cttgctactctaagactatta

SEQ ID NO: 50337 - DNA, 21 bp, Artificial sequence
  SiRNA target sequence
ttgctactctaagactattag

SEQ ID NO: 50338 - DNA, 21 bp, Artificial sequence
  SiRNA target sequence
tgctactctaagactattaga

SEQ ID NO: 50339 - DNA, 21 bp, Artificial sequence
  SiRNA target sequence
gctactctaagactattagag

SEQ ID NO: 50340 - DNA, 21 bp, Artificial sequence
  SiRNA target sequence
ctactctaagactattagagc

SEQ ID NO: 50341 - DNA, 21 bp, Artificial sequence
  SiRNA target sequence
tactctaagactattagagca

SEQ ID NO: 50342 - DNA, 21 bp, Artificial sequence
  SiRNA target sequence
actctaagactattagagcag

SEQ ID NO: 50343 - DNA, 21 bp, Artificial sequence
  SiRNA target sequence
ctctaagactattagagcagt

SEQ ID NO: 50344 - DNA, 21 bp, Artificial sequence
  SiRNA target sequence
tctaagactattagagcagtt

SEQ ID NO: 50345 - DNA, 21 bp, Artificial sequence
  SiRNA target sequence
ctaagactattagagcagtta

SEQ ID NO: 50346 - DNA, 21 bp, Artificial sequence
  SiRNA target sequence
taagactattagagcagttaa

SEQ ID NO: 50347 - DNA, 21 bp, Artificial sequence
  SiRNA target sequence
aagactattagagcagttaaa

SEQ ID NO: 50348 - DNA, 21 bp, Artificial sequence
  SiRNA target sequence
agactattagagcagttaaag

SEQ ID NO: 50349 - DNA, 21 bp, Artificial sequence
  SiRNA target sequence
gactattagagcagttaaagg

SEQ ID NO: 50350 - DNA, 21 bp, Artificial sequence
  SiRNA target sequence
actattagagcagttaaaggc

SEQ ID NO: 50351 - DNA, 21 bp, Artificial sequence
  SiRNA target sequence
ctattagagcagttaaaggcg

SEQ ID NO: 50352 - DNA, 21 bp, Artificial sequence
  SiRNA target sequence
tattagagcagttaaaggcgc

SEQ ID NO: 50353 - DNA, 21 bp, Artificial sequence
  SiRNA target sequence
attagagcagttaaaggcgcc

SEQ ID NO: 50354 - DNA, 21 bp, Artificial sequence
  SiRNA target sequence
ttagagcagttaaaggcgcca

SEQ ID NO: 50355 - DNA, 21 bp, Artificial sequence
  SiRNA target sequence
tagagcagttaaaggcgccac

SEQ ID NO: 50356 - DNA, 21 bp, Artificial sequence
  SiRNA target sequence
agagcagttaaaggcgccact

SEQ ID NO: 50357 - DNA, 21 bp, Artificial sequence
  SiRNA target sequence
gagcagttaaaggcgccactt

SEQ ID NO: 50358 - DNA, 21 bp, Artificial sequence
  SiRNA target sequence
agcagttaaaggcgccacttc

SEQ ID NO: 50359 - DNA, 21 bp, Artificial sequence
  SiRNA target sequence
gcagttaaaggcgccacttcg

SEQ ID NO: 50360 - DNA, 21 bp, Artificial sequence
  SiRNA target sequence
cagttaaaggcgccacttcga

SEQ ID NO: 50361 - DNA, 21 bp, Artificial sequence
  SiRNA target sequence
agttaaaggcgccacttcgac

SEQ ID NO: 50362 - DNA, 21 bp, Artificial sequence
  SiRNA target sequence
gttaaaggcgccacttcgacg

SEQ ID NO: 50363 - DNA, 21 bp, Artificial sequence
  SiRNA target sequence
ttaaaggcgccacttcgacgt

SEQ ID NO: 50364 - DNA, 21 bp, Artificial sequence
  SiRNA target sequence
taaaggcgccacttcgacgtc

SEQ ID NO: 50365 - DNA, 21 bp, Artificial sequence
  SiRNA target sequence
aaaggcgccacttcgacgtca

SEQ ID NO: 50366 - DNA, 21 bp, Artificial sequence
  SiRNA target sequence
aaggcgccacttcgacgtcaa

SEQ ID NO: 50367 - DNA, 21 bp, Artificial sequence
  SiRNA target sequence
aggcgccacttcgacgtcaaa

SEQ ID NO: 50368 - DNA, 21 bp, Artificial sequence
  SiRNA target sequence
ggcgccacttcgacgtcaaaa

SEQ ID NO: 50369 - DNA, 21 bp, Artificial sequence
  SiRNA target sequence
gcgccacttcgacgtcaaaaa

SEQ ID NO: 50370 - DNA, 21 bp, Artificial sequence
  SiRNA target sequence
cgccacttcgacgtcaaaaac

SEQ ID NO: 50371 - DNA, 21 bp, Artificial sequence
  SiRNA target sequence
gccacttcgacgtcaaaaacc

SEQ ID NO: 50372 - DNA, 21 bp, Artificial sequence
  SiRNA target sequence
ccacttcgacgtcaaaaaccg

SEQ ID NO: 50373 - DNA, 21 bp, Artificial sequence
  SiRNA target sequence
cacttcgacgtcaaaaaccga

SEQ ID NO: 50374 - DNA, 21 bp, Artificial sequence
  SiRNA target sequence
acttcgacgtcaaaaaccgaa

SEQ ID NO: 50375 - DNA, 21 bp, Artificial sequence
  SiRNA target sequence
cttcgacgtcaaaaaccgaag

SEQ ID NO: 50376 - DNA, 21 bp, Artificial sequence
  SiRNA target sequence
ttcgacgtcaaaaaccgaagt

SEQ ID NO: 50377 - DNA, 21 bp, Artificial sequence
  SiRNA target sequence
tcgacgtcaaaaaccgaagtg

SEQ ID NO: 50378 - DNA, 21 bp, Artificial sequence
  SiRNA target sequence
cgacgtcaaaaaccgaagtga

SEQ ID NO: 50379 - DNA, 21 bp, Artificial sequence
  SiRNA target sequence
gacgtcaaaaaccgaagtgat

SEQ ID NO: 50380 - DNA, 21 bp, Artificial sequence
  SiRNA target sequence
acgtcaaaaaccgaagtgatg

SEQ ID NO: 50381 - DNA, 21 bp, Artificial sequence
  SiRNA target sequence
cgtcaaaaaccgaagtgatgg

SEQ ID NO: 50382 - DNA, 21 bp, Artificial sequence
  SiRNA target sequence
gtcaaaaaccgaagtgatgga

SEQ ID NO: 50383 - DNA, 21 bp, Artificial sequence
  SiRNA target sequence
tcaaaaaccgaagtgatggac

SEQ ID NO: 50384 - DNA, 21 bp, Artificial sequence
  SiRNA target sequence
caaaaaccgaagtgatggacc

SEQ ID NO: 50385 - DNA, 21 bp, Artificial sequence
  SiRNA target sequence
aaaaaccgaagtgatggaccc

SEQ ID NO: 50386 - DNA, 21 bp, Artificial sequence
  SiRNA target sequence
aaaaccgaagtgatggaccca

SEQ ID NO: 50387 - DNA, 21 bp, Artificial sequence
  SiRNA target sequence
aaaccgaagtgatggacccag

SEQ ID NO: 50388 - DNA, 21 bp, Artificial sequence
  SiRNA target sequence
aaccgaagtgatggacccagc

SEQ ID NO: 50389 - DNA, 21 bp, Artificial sequence
  SiRNA target sequence
accgaagtgatggacccagca

SEQ ID NO: 50390 - DNA, 21 bp, Artificial sequence
  SiRNA target sequence
ccgaagtgatggacccagcac

SEQ ID NO: 50391 - DNA, 21 bp, Artificial sequence
  SiRNA target sequence
cgaagtgatggacccagcacc

SEQ ID NO: 50392 - DNA, 21 bp, Artificial sequence
  SiRNA target sequence
gaagtgatggacccagcaccg

SEQ ID NO: 50393 - DNA, 21 bp, Artificial sequence
  SiRNA target sequence
aagtgatggacccagcaccgt

SEQ ID NO: 50394 - DNA, 21 bp, Artificial sequence
  SiRNA target sequence
agtgatggacccagcaccgtg

SEQ ID NO: 50395 - DNA, 21 bp, Artificial sequence
  SiRNA target sequence
gtgatggacccagcaccgtgt

SEQ ID NO: 50396 - DNA, 21 bp, Artificial sequence
  SiRNA target sequence
tgatggacccagcaccgtgtg

SEQ ID NO: 50397 - DNA, 21 bp, Artificial sequence
  SiRNA target sequence
gatggacccagcaccgtgtga

SEQ ID NO: 50398 - DNA, 21 bp, Artificial sequence
  SiRNA target sequence
atggacccagcaccgtgtgaa

SEQ ID NO: 50399 - DNA, 21 bp, Artificial sequence
  SiRNA target sequence
tggacccagcaccgtgtgaat

SEQ ID NO: 50400 - DNA, 21 bp, Artificial sequence
  SiRNA target sequence
ggacccagcaccgtgtgaata

SEQ ID NO: 50401 - DNA, 21 bp, Artificial sequence
  SiRNA target sequence
gacccagcaccgtgtgaatat

SEQ ID NO: 50402 - DNA, 21 bp, Artificial sequence
  SiRNA target sequence
acccagcaccgtgtgaatatg

SEQ ID NO: 50403 - DNA, 21 bp, Artificial sequence
  SiRNA target sequence
cccagcaccgtgtgaatatgt

SEQ ID NO: 50404 - DNA, 21 bp, Artificial sequence
  SiRNA target sequence
ccagcaccgtgtgaatatgtt

SEQ ID NO: 50405 - DNA, 21 bp, Artificial sequence
  SiRNA target sequence
cagcaccgtgtgaatatgttg

SEQ ID NO: 50406 - DNA, 21 bp, Artificial sequence
  SiRNA target sequence
agcaccgtgtgaatatgttgc

SEQ ID NO: 50407 - DNA, 21 bp, Artificial sequence
  SiRNA target sequence
gcaccgtgtgaatatgttgca

SEQ ID NO: 50408 - DNA, 21 bp, Artificial sequence
  SiRNA target sequence
caccgtgtgaatatgttgcaa

SEQ ID NO: 50409 - DNA, 21 bp, Artificial sequence
  SiRNA target sequence
accgtgtgaatatgttgcaaa

SEQ ID NO: 50410 - DNA, 21 bp, Artificial sequence
  SiRNA target sequence
ccgtgtgaatatgttgcaaat

SEQ ID NO: 50411 - DNA, 21 bp, Artificial sequence
  SiRNA target sequence
cgtgtgaatatgttgcaaatc

SEQ ID NO: 50412 - DNA, 21 bp, Artificial sequence
  SiRNA target sequence
gtgtgaatatgttgcaaatct

SEQ ID NO: 50413 - DNA, 21 bp, Artificial sequence
  SiRNA target sequence
tgtgaatatgttgcaaatctt

SEQ ID NO: 50414 - DNA, 21 bp, Artificial sequence
  SiRNA target sequence
gtgaatatgttgcaaatcttt

SEQ ID NO: 50415 - DNA, 21 bp, Artificial sequence
  SiRNA target sequence
tgaatatgttgcaaatctttt

SEQ ID NO: 50416 - DNA, 21 bp, Artificial sequence
  SiRNA target sequence
gaatatgttgcaaatcttttc

SEQ ID NO: 50417 - DNA, 21 bp, Artificial sequence
  SiRNA target sequence
aatatgttgcaaatcttttct

SEQ ID NO: 50418 - DNA, 21 bp, Artificial sequence
  SiRNA target sequence
atatgttgcaaatcttttctc

SEQ ID NO: 50419 - DNA, 21 bp, Artificial sequence
  SiRNA target sequence
tatgttgcaaatcttttctca

SEQ ID NO: 50420 - DNA, 21 bp, Artificial sequence
  SiRNA target sequence
atgttgcaaatcttttctcat

SEQ ID NO: 50421 - DNA, 21 bp, Artificial sequence
  SiRNA target sequence
tgttgcaaatcttttctcata

SEQ ID NO: 50422 - DNA, 21 bp, Artificial sequence
  SiRNA target sequence
gttgcaaatcttttctcatat

SEQ ID NO: 50423 - DNA, 21 bp, Artificial sequence
  SiRNA target sequence
ttgcaaatcttttctcatatt

SEQ ID NO: 50424 - DNA, 21 bp, Artificial sequence
  SiRNA target sequence
tgcaaatcttttctcatattg

SEQ ID NO: 50425 - DNA, 21 bp, Artificial sequence
  SiRNA target sequence
gcaaatcttttctcatattgg

SEQ ID NO: 50426 - DNA, 21 bp, Artificial sequence
  SiRNA target sequence
caaatcttttctcatattggc

SEQ ID NO: 50427 - DNA, 21 bp, Artificial sequence
  SiRNA target sequence
aaatcttttctcatattggcg

SEQ ID NO: 50428 - DNA, 21 bp, Artificial sequence
  SiRNA target sequence
aatcttttctcatattggcgt

SEQ ID NO: 50429 - DNA, 21 bp, Artificial sequence
  SiRNA target sequence
atcttttctcatattggcgtg

SEQ ID NO: 50430 - DNA, 21 bp, Artificial sequence
  SiRNA target sequence
tcttttctcatattggcgtgc

SEQ ID NO: 50431 - DNA, 21 bp, Artificial sequence
  SiRNA target sequence
cttttctcatattggcgtgca

SEQ ID NO: 50432 - DNA, 21 bp, Artificial sequence
  SiRNA target sequence
ttttctcatattggcgtgcaa

SEQ ID NO: 50433 - DNA, 21 bp, Artificial sequence
  SiRNA target sequence
tttctcatattggcgtgcaac

SEQ ID NO: 50434 - DNA, 21 bp, Artificial sequence
  SiRNA target sequence
ttctcatattggcgtgcaact

SEQ ID NO: 50435 - DNA, 21 bp, Artificial sequence
  SiRNA target sequence
tctcatattggcgtgcaacta

SEQ ID NO: 50436 - DNA, 21 bp, Artificial sequence
  SiRNA target sequence
ctcatattggcgtgcaactat

SEQ ID NO: 50437 - DNA, 21 bp, Artificial sequence
  SiRNA target sequence
tcatattggcgtgcaactatg

SEQ ID NO: 50438 - DNA, 21 bp, Artificial sequence
  SiRNA target sequence
catattggcgtgcaactatgt

SEQ ID NO: 50439 - DNA, 21 bp, Artificial sequence
  SiRNA target sequence
atattggcgtgcaactatgtg

SEQ ID NO: 50440 - DNA, 21 bp, Artificial sequence
  SiRNA target sequence
tattggcgtgcaactatgtgc

SEQ ID NO: 50441 - DNA, 21 bp, Artificial sequence
  SiRNA target sequence
attggcgtgcaactatgtgct

SEQ ID NO: 50442 - DNA, 21 bp, Artificial sequence
  SiRNA target sequence
ttggcgtgcaactatgtgcta

SEQ ID NO: 50443 - DNA, 21 bp, Artificial sequence
  SiRNA target sequence
tggcgtgcaactatgtgctat

SEQ ID NO: 50444 - DNA, 21 bp, Artificial sequence
  SiRNA target sequence
ggcgtgcaactatgtgctatc

SEQ ID NO: 50445 - DNA, 21 bp, Artificial sequence
  SiRNA target sequence
gcgtgcaactatgtgctatcg

SEQ ID NO: 50446 - DNA, 21 bp, Artificial sequence
  SiRNA target sequence
cgtgcaactatgtgctatcgt

SEQ ID NO: 50447 - DNA, 21 bp, Artificial sequence
  SiRNA target sequence
gtgcaactatgtgctatcgta

SEQ ID NO: 50448 - DNA, 21 bp, Artificial sequence
  SiRNA target sequence
tgcaactatgtgctatcgtat

SEQ ID NO: 50449 - DNA, 21 bp, Artificial sequence
  SiRNA target sequence
gcaactatgtgctatcgtatt

SEQ ID NO: 50450 - DNA, 21 bp, Artificial sequence
  SiRNA target sequence
caactatgtgctatcgtatta

SEQ ID NO: 50451 - DNA, 21 bp, Artificial sequence
  SiRNA target sequence
aactatgtgctatcgtattac

SEQ ID NO: 50452 - DNA, 21 bp, Artificial sequence
  SiRNA target sequence
actatgtgctatcgtattacg

SEQ ID NO: 50453 - DNA, 21 bp, Artificial sequence
  SiRNA target sequence
ctatgtgctatcgtattacgg

SEQ ID NO: 50454 - DNA, 21 bp, Artificial sequence
  SiRNA target sequence
tatgtgctatcgtattacggt

SEQ ID NO: 50455 - DNA, 21 bp, Artificial sequence
  SiRNA target sequence
atgtgctatcgtattacggta

SEQ ID NO: 50456 - DNA, 21 bp, Artificial sequence
  SiRNA target sequence
tgtgctatcgtattacggtag

SEQ ID NO: 50457 - DNA, 21 bp, Artificial sequence
  SiRNA target sequence
gtgctatcgtattacggtagt

SEQ ID NO: 50458 - DNA, 21 bp, Artificial sequence
  SiRNA target sequence
tgctatcgtattacggtagta

SEQ ID NO: 50459 - DNA, 21 bp, Artificial sequence
  SiRNA target sequence
gctatcgtattacggtagtaa

SEQ ID NO: 50460 - DNA, 21 bp, Artificial sequence
  SiRNA target sequence
ctatcgtattacggtagtaaa

SEQ ID NO: 50461 - DNA, 21 bp, Artificial sequence
  SiRNA target sequence
tatcgtattacggtagtaaag

SEQ ID NO: 50462 - DNA, 21 bp, Artificial sequence
  SiRNA target sequence
atcgtattacggtagtaaaga

SEQ ID NO: 50463 - DNA, 21 bp, Artificial sequence
  SiRNA target sequence
tcgtattacggtagtaaagac

SEQ ID NO: 50464 - DNA, 21 bp, Artificial sequence
  SiRNA target sequence
cgtattacggtagtaaagaca

SEQ ID NO: 50465 - DNA, 21 bp, Artificial sequence
  SiRNA target sequence
gtattacggtagtaaagacag

SEQ ID NO: 50466 - DNA, 21 bp, Artificial sequence
  SiRNA target sequence
tattacggtagtaaagacagc

SEQ ID NO: 50467 - DNA, 21 bp, Artificial sequence
  SiRNA target sequence
attacggtagtaaagacagct

SEQ ID NO: 50468 - DNA, 21 bp, Artificial sequence
  SiRNA target sequence
ttacggtagtaaagacagctt

SEQ ID NO: 50469 - DNA, 21 bp, Artificial sequence
  SiRNA target sequence
tacggtagtaaagacagcttt

SEQ ID NO: 50470 - DNA, 21 bp, Artificial sequence
  SiRNA target sequence
acggtagtaaagacagctttt

SEQ ID NO: 50471 - DNA, 21 bp, Artificial sequence
  SiRNA target sequence
cggtagtaaagacagcttttc

SEQ ID NO: 50472 - DNA, 21 bp, Artificial sequence
  SiRNA target sequence
ggtagtaaagacagcttttca

SEQ ID NO: 50473 - DNA, 21 bp, Artificial sequence
  SiRNA target sequence
gtagtaaagacagcttttcac

SEQ ID NO: 50474 - DNA, 21 bp, Artificial sequence
  SiRNA target sequence
tagtaaagacagcttttcaca

SEQ ID NO: 50475 - DNA, 21 bp, Artificial sequence
  SiRNA target sequence
agtaaagacagcttttcacac

SEQ ID NO: 50476 - DNA, 21 bp, Artificial sequence
  SiRNA target sequence
gtaaagacagcttttcacaca

SEQ ID NO: 50477 - DNA, 21 bp, Artificial sequence
  SiRNA target sequence
taaagacagcttttcacacag

SEQ ID NO: 50478 - DNA, 21 bp, Artificial sequence
  SiRNA target sequence
aaagacagcttttcacacagg

SEQ ID NO: 50479 - DNA, 21 bp, Artificial sequence
  SiRNA target sequence
aagacagcttttcacacaggc

SEQ ID NO: 50480 - DNA, 21 bp, Artificial sequence
  SiRNA target sequence
agacagcttttcacacaggca

SEQ ID NO: 50481 - DNA, 21 bp, Artificial sequence
  SiRNA target sequence
gacagcttttcacacaggcag

SEQ ID NO: 50482 - DNA, 21 bp, Artificial sequence
  SiRNA target sequence
acagcttttcacacaggcagg

SEQ ID NO: 50483 - DNA, 21 bp, Artificial sequence
  SiRNA target sequence
cagcttttcacacaggcaggt

SEQ ID NO: 50484 - DNA, 21 bp, Artificial sequence
  SiRNA target sequence
agcttttcacacaggcaggtt

SEQ ID NO: 50485 - DNA, 21 bp, Artificial sequence
  SiRNA target sequence
gcttttcacacaggcaggttg

SEQ ID NO: 50486 - DNA, 21 bp, Artificial sequence
  SiRNA target sequence
cttttcacacaggcaggttgg

SEQ ID NO: 50487 - DNA, 21 bp, Artificial sequence
  SiRNA target sequence
ttttcacacaggcaggttgga

SEQ ID NO: 50488 - DNA, 21 bp, Artificial sequence
  SiRNA target sequence
tttcacacaggcaggttggaa

SEQ ID NO: 50489 - DNA, 21 bp, Artificial sequence
  SiRNA target sequence
ttcacacaggcaggttggaaa

SEQ ID NO: 50490 - DNA, 21 bp, Artificial sequence
  SiRNA target sequence
tcacacaggcaggttggaaat

SEQ ID NO: 50491 - DNA, 21 bp, Artificial sequence
  SiRNA target sequence
cacacaggcaggttggaaatc

SEQ ID NO: 50492 - DNA, 21 bp, Artificial sequence
  SiRNA target sequence
acacaggcaggttggaaatct

SEQ ID NO: 50493 - DNA, 21 bp, Artificial sequence
  SiRNA target sequence
cacaggcaggttggaaatctt

SEQ ID NO: 50494 - DNA, 21 bp, Artificial sequence
  SiRNA target sequence
acaggcaggttggaaatcttc

SEQ ID NO: 50495 - DNA, 21 bp, Artificial sequence
  SiRNA target sequence
caggcaggttggaaatcttct

SEQ ID NO: 50496 - DNA, 21 bp, Artificial sequence
  SiRNA target sequence
aggcaggttggaaatcttctt

SEQ ID NO: 50497 - DNA, 21 bp, Artificial sequence
  SiRNA target sequence
ggcaggttggaaatcttcttt

SEQ ID NO: 50498 - DNA, 21 bp, Artificial sequence
  SiRNA target sequence
gcaggttggaaatcttctttg

SEQ ID NO: 50499 - DNA, 21 bp, Artificial sequence
  SiRNA target sequence
caggttggaaatcttctttga

SEQ ID NO: 50500 - DNA, 21 bp, Artificial sequence
  SiRNA target sequence
aggttggaaatcttctttgaa

SEQ ID NO: 50501 - DNA, 21 bp, Artificial sequence
  SiRNA target sequence
ggttggaaatcttctttgaac

SEQ ID NO: 50502 - DNA, 21 bp, Artificial sequence
  SiRNA target sequence
gttggaaatcttctttgaacc

SEQ ID NO: 50503 - DNA, 21 bp, Artificial sequence
  SiRNA target sequence
ttggaaatcttctttgaacca

SEQ ID NO: 50504 - DNA, 21 bp, Artificial sequence
  SiRNA target sequence
tggaaatcttctttgaaccag

SEQ ID NO: 50505 - DNA, 21 bp, Artificial sequence
  SiRNA target sequence
ggaaatcttctttgaaccagg

SEQ ID NO: 50506 - DNA, 21 bp, Artificial sequence
  SiRNA target sequence
gaaatcttctttgaaccagga

SEQ ID NO: 50507 - DNA, 21 bp, Artificial sequence
  SiRNA target sequence
aaatcttctttgaaccaggaa

SEQ ID NO: 50508 - DNA, 21 bp, Artificial sequence
  SiRNA target sequence
aatcttctttgaaccaggaag

SEQ ID NO: 50509 - DNA, 21 bp, Artificial sequence
  SiRNA target sequence
atcttctttgaaccaggaagt

SEQ ID NO: 50510 - DNA, 21 bp, Artificial sequence
  SiRNA target sequence
tcttctttgaaccaggaagta

SEQ ID NO: 50511 - DNA, 21 bp, Artificial sequence
  SiRNA target sequence
cttctttgaaccaggaagtat

SEQ ID NO: 50512 - DNA, 21 bp, Artificial sequence
  SiRNA target sequence
ttctttgaaccaggaagtatt

SEQ ID NO: 50513 - DNA, 21 bp, Artificial sequence
  SiRNA target sequence
tctttgaaccaggaagtattc

SEQ ID NO: 50514 - DNA, 21 bp, Artificial sequence
  SiRNA target sequence
ctttgaaccaggaagtattcc

SEQ ID NO: 50515 - DNA, 21 bp, Artificial sequence
  SiRNA target sequence
tttgaaccaggaagtattccc

SEQ ID NO: 50516 - DNA, 21 bp, Artificial sequence
  SiRNA target sequence
ttgaaccaggaagtattccca

SEQ ID NO: 50517 - DNA, 21 bp, Artificial sequence
  SiRNA target sequence
tgaaccaggaagtattcccac

SEQ ID NO: 50518 - DNA, 21 bp, Artificial sequence
  SiRNA target sequence
gaaccaggaagtattcccacg

SEQ ID NO: 50519 - DNA, 21 bp, Artificial sequence
  SiRNA target sequence
aaccaggaagtattcccacgg

SEQ ID NO: 50520 - DNA, 21 bp, Artificial sequence
  SiRNA target sequence
accaggaagtattcccacggt

SEQ ID NO: 50521 - DNA, 21 bp, Artificial sequence
  SiRNA target sequence
ccaggaagtattcccacggta

SEQ ID NO: 50522 - DNA, 21 bp, Artificial sequence
  SiRNA target sequence
caggaagtattcccacggtaa

SEQ ID NO: 50523 - DNA, 21 bp, Artificial sequence
  SiRNA target sequence
aggaagtattcccacggtaag

SEQ ID NO: 50524 - DNA, 21 bp, Artificial sequence
  SiRNA target sequence
ggaagtattcccacggtaaga

SEQ ID NO: 50525 - DNA, 21 bp, Artificial sequence
  SiRNA target sequence
gaagtattcccacggtaagaa

SEQ ID NO: 50526 - DNA, 21 bp, Artificial sequence
  SiRNA target sequence
aagtattcccacggtaagaac

SEQ ID NO: 50527 - DNA, 21 bp, Artificial sequence
  SiRNA target sequence
agtattcccacggtaagaacc

SEQ ID NO: 50528 - DNA, 21 bp, Artificial sequence
  SiRNA target sequence
gtattcccacggtaagaaccg

SEQ ID NO: 50529 - DNA, 21 bp, Artificial sequence
  SiRNA target sequence
tattcccacggtaagaaccgc

SEQ ID NO: 50530 - DNA, 21 bp, Artificial sequence
  SiRNA target sequence
attcccacggtaagaaccgca

SEQ ID NO: 50531 - DNA, 21 bp, Artificial sequence
  SiRNA target sequence
ttcccacggtaagaaccgcag

SEQ ID NO: 50532 - DNA, 21 bp, Artificial sequence
  SiRNA target sequence
tcccacggtaagaaccgcaga

SEQ ID NO: 50533 - DNA, 21 bp, Artificial sequence
  SiRNA target sequence
cccacggtaagaaccgcagat

SEQ ID NO: 50534 - DNA, 21 bp, Artificial sequence
  SiRNA target sequence
ccacggtaagaaccgcagata

SEQ ID NO: 50535 - DNA, 21 bp, Artificial sequence
  SiRNA target sequence
cacggtaagaaccgcagataa

SEQ ID NO: 50536 - DNA, 21 bp, Artificial sequence
  SiRNA target sequence
acggtaagaaccgcagataac

SEQ ID NO: 50537 - DNA, 21 bp, Artificial sequence
  SiRNA target sequence
cggtaagaaccgcagataact

SEQ ID NO: 50538 - DNA, 21 bp, Artificial sequence
  SiRNA target sequence
ggtaagaaccgcagataactt

SEQ ID NO: 50539 - DNA, 21 bp, Artificial sequence
  SiRNA target sequence
gtaagaaccgcagataactta

SEQ ID NO: 50540 - DNA, 21 bp, Artificial sequence
  SiRNA target sequence
taagaaccgcagataacttag

SEQ ID NO: 50541 - DNA, 21 bp, Artificial sequence
  SiRNA target sequence
aagaaccgcagataacttagg

SEQ ID NO: 50542 - DNA, 21 bp, Artificial sequence
  SiRNA target sequence
agaaccgcagataacttagga

SEQ ID NO: 50543 - DNA, 21 bp, Artificial sequence
  SiRNA target sequence
gaaccgcagataacttaggac

SEQ ID NO: 50544 - DNA, 21 bp, Artificial sequence
  SiRNA target sequence
aaccgcagataacttaggacc

SEQ ID NO: 50545 - DNA, 21 bp, Artificial sequence
  SiRNA target sequence
accgcagataacttaggacca

SEQ ID NO: 50546 - DNA, 21 bp, Artificial sequence
  SiRNA target sequence
ccgcagataacttaggaccag

SEQ ID NO: 50547 - DNA, 21 bp, Artificial sequence
  SiRNA target sequence
cgcagataacttaggaccaga

SEQ ID NO: 50548 - DNA, 21 bp, Artificial sequence
  SiRNA target sequence
gcagataacttaggaccagat

SEQ ID NO: 50549 - DNA, 21 bp, Artificial sequence
  SiRNA target sequence
cagataacttaggaccagatc

SEQ ID NO: 50550 - DNA, 21 bp, Artificial sequence
  SiRNA target sequence
agataacttaggaccagatca

SEQ ID NO: 50551 - DNA, 21 bp, Artificial sequence
  SiRNA target sequence
gataacttaggaccagatcag

SEQ ID NO: 50552 - DNA, 21 bp, Artificial sequence
  SiRNA target sequence
ataacttaggaccagatcaga

SEQ ID NO: 50553 - DNA, 21 bp, Artificial sequence
  SiRNA target sequence
taacttaggaccagatcagac

SEQ ID NO: 50554 - DNA, 21 bp, Artificial sequence
  SiRNA target sequence
aacttaggaccagatcagaca

SEQ ID NO: 50555 - DNA, 21 bp, Artificial sequence
  SiRNA target sequence
acttaggaccagatcagacac

SEQ ID NO: 50556 - DNA, 21 bp, Artificial sequence
  SiRNA target sequence
cttaggaccagatcagacaca

SEQ ID NO: 50557 - DNA, 21 bp, Artificial sequence
  SiRNA target sequence
ttaggaccagatcagacacaa

SEQ ID NO: 50558 - DNA, 21 bp, Artificial sequence
  SiRNA target sequence
taggaccagatcagacacaat

SEQ ID NO: 50559 - DNA, 21 bp, Artificial sequence
  SiRNA target sequence
aggaccagatcagacacaatt

SEQ ID NO: 50560 - DNA, 21 bp, Artificial sequence
  SiRNA target sequence
ggaccagatcagacacaattg

SEQ ID NO: 50561 - DNA, 21 bp, Artificial sequence
  SiRNA target sequence
gaccagatcagacacaattga

SEQ ID NO: 50562 - DNA, 21 bp, Artificial sequence
  SiRNA target sequence
accagatcagacacaattgaa

SEQ ID NO: 50563 - DNA, 21 bp, Artificial sequence
  SiRNA target sequence
ccagatcagacacaattgaac

SEQ ID NO: 50564 - DNA, 21 bp, Artificial sequence
  SiRNA target sequence
cagatcagacacaattgaacg

SEQ ID NO: 50565 - DNA, 21 bp, Artificial sequence
  SiRNA target sequence
agatcagacacaattgaacgg

SEQ ID NO: 50566 - DNA, 21 bp, Artificial sequence
  SiRNA target sequence
gatcagacacaattgaacgga

SEQ ID NO: 50567 - DNA, 21 bp, Artificial sequence
  SiRNA target sequence
atcagacacaattgaacggaa

SEQ ID NO: 50568 - DNA, 21 bp, Artificial sequence
  SiRNA target sequence
tcagacacaattgaacggaac

SEQ ID NO: 50569 - DNA, 21 bp, Artificial sequence
  SiRNA target sequence
cagacacaattgaacggaaca

SEQ ID NO: 50570 - DNA, 21 bp, Artificial sequence
  SiRNA target sequence
agacacaattgaacggaacaa

SEQ ID NO: 50571 - DNA, 21 bp, Artificial sequence
  SiRNA target sequence
gacacaattgaacggaacaat

SEQ ID NO: 50572 - DNA, 21 bp, Artificial sequence
  SiRNA target sequence
acacaattgaacggaacaata

SEQ ID NO: 50573 - DNA, 21 bp, Artificial sequence
  SiRNA target sequence
cacaattgaacggaacaatag

SEQ ID NO: 50574 - DNA, 21 bp, Artificial sequence
  SiRNA target sequence
acaattgaacggaacaatagc

SEQ ID NO: 50575 - DNA, 21 bp, Artificial sequence
  SiRNA target sequence
caattgaacggaacaatagct

SEQ ID NO: 50576 - DNA, 21 bp, Artificial sequence
  SiRNA target sequence
aattgaacggaacaatagctc

SEQ ID NO: 50577 - DNA, 21 bp, Artificial sequence
  SiRNA target sequence
attgaacggaacaatagctcc

SEQ ID NO: 50578 - DNA, 21 bp, Artificial sequence
  SiRNA target sequence
ttgaacggaacaatagctcca

SEQ ID NO: 50579 - DNA, 21 bp, Artificial sequence
  SiRNA target sequence
tgaacggaacaatagctccat

SEQ ID NO: 50580 - DNA, 21 bp, Artificial sequence
  SiRNA target sequence
gaacggaacaatagctccatc

SEQ ID NO: 50581 - DNA, 21 bp, Artificial sequence
  SiRNA target sequence
aacggaacaatagctccatcc

SEQ ID NO: 50582 - DNA, 21 bp, Artificial sequence
  SiRNA target sequence
acggaacaatagctccatccg

SEQ ID NO: 50583 - DNA, 21 bp, Artificial sequence
  SiRNA target sequence
cggaacaatagctccatccga

SEQ ID NO: 50584 - DNA, 21 bp, Artificial sequence
  SiRNA target sequence
ggaacaatagctccatccgat

SEQ ID NO: 50585 - DNA, 21 bp, Artificial sequence
  SiRNA target sequence
gaacaatagctccatccgata

SEQ ID NO: 50586 - DNA, 21 bp, Artificial sequence
  SiRNA target sequence
aacaatagctccatccgataa

SEQ ID NO: 50587 - DNA, 21 bp, Artificial sequence
  SiRNA target sequence
acaatagctccatccgataac

SEQ ID NO: 50588 - DNA, 21 bp, Artificial sequence
  SiRNA target sequence
caatagctccatccgataaca

SEQ ID NO: 50589 - DNA, 21 bp, Artificial sequence
  SiRNA target sequence
aatagctccatccgataacaa

SEQ ID NO: 50590 - DNA, 21 bp, Artificial sequence
  SiRNA target sequence
atagctccatccgataacaac

SEQ ID NO: 50591 - DNA, 21 bp, Artificial sequence
  SiRNA target sequence
tagctccatccgataacaact

SEQ ID NO: 50592 - DNA, 21 bp, Artificial sequence
  SiRNA target sequence
agctccatccgataacaacta

SEQ ID NO: 50593 - DNA, 21 bp, Artificial sequence
  SiRNA target sequence
gctccatccgataacaactat

SEQ ID NO: 50594 - DNA, 21 bp, Artificial sequence
  SiRNA target sequence
ctccatccgataacaactata

SEQ ID NO: 50595 - DNA, 21 bp, Artificial sequence
  SiRNA target sequence
tccatccgataacaactataa

SEQ ID NO: 50596 - DNA, 21 bp, Artificial sequence
  SiRNA target sequence
ccatccgataacaactataag

SEQ ID NO: 50597 - DNA, 21 bp, Artificial sequence
  SiRNA target sequence
catccgataacaactataagt

SEQ ID NO: 50598 - DNA, 21 bp, Artificial sequence
  SiRNA target sequence
atccgataacaactataagta

SEQ ID NO: 50599 - DNA, 21 bp, Artificial sequence
  SiRNA target sequence
tccgataacaactataagtat

SEQ ID NO: 50600 - DNA, 21 bp, Artificial sequence
  SiRNA target sequence
ccgataacaactataagtata

SEQ ID NO: 50601 - DNA, 21 bp, Artificial sequence
  SiRNA target sequence
cgataacaactataagtatat

SEQ ID NO: 50602 - DNA, 21 bp, Artificial sequence
  SiRNA target sequence
gataacaactataagtatata

SEQ ID NO: 50603 - DNA, 21 bp, Artificial sequence
  SiRNA target sequence
ataacaactataagtatatat

SEQ ID NO: 50604 - DNA, 21 bp, Artificial sequence
  SiRNA target sequence
taacaactataagtatatatt

SEQ ID NO: 50605 - DNA, 21 bp, Artificial sequence
  SiRNA target sequence
aacaactataagtatatatta

SEQ ID NO: 50606 - DNA, 21 bp, Artificial sequence
  SiRNA target sequence
acaactataagtatatattag

SEQ ID NO: 50607 - DNA, 21 bp, Artificial sequence
  SiRNA target sequence
caactataagtatatattaga

SEQ ID NO: 50608 - DNA, 21 bp, Artificial sequence
  SiRNA target sequence
aactataagtatatattagac

SEQ ID NO: 50609 - DNA, 21 bp, Artificial sequence
  SiRNA target sequence
actataagtatatattagact

SEQ ID NO: 50610 - DNA, 21 bp, Artificial sequence
  SiRNA target sequence
ctataagtatatattagactt

SEQ ID NO: 50611 - DNA, 21 bp, Artificial sequence
  SiRNA target sequence
tataagtatatattagactta

SEQ ID NO: 50612 - DNA, 21 bp, Artificial sequence
  SiRNA target sequence
ataagtatatattagacttaa

SEQ ID NO: 50613 - DNA, 21 bp, Artificial sequence
  SiRNA target sequence
taagtatatattagacttaac

SEQ ID NO: 50614 - DNA, 21 bp, Artificial sequence
  SiRNA target sequence
aagtatatattagacttaaca

SEQ ID NO: 50615 - DNA, 21 bp, Artificial sequence
  SiRNA target sequence
agtatatattagacttaacaa

SEQ ID NO: 50616 - DNA, 21 bp, Artificial sequence
  SiRNA target sequence
gtatatattagacttaacaaa

SEQ ID NO: 50617 - DNA, 21 bp, Artificial sequence
  SiRNA target sequence
tatatattagacttaacaaat

SEQ ID NO: 50618 - DNA, 21 bp, Artificial sequence
  SiRNA target sequence
atatattagacttaacaaatg

SEQ ID NO: 50619 - DNA, 21 bp, Artificial sequence
  SiRNA target sequence
tatattagacttaacaaatga

SEQ ID NO: 50620 - DNA, 21 bp, Artificial sequence
  SiRNA target sequence
atattagacttaacaaatgat

SEQ ID NO: 50621 - DNA, 21 bp, Artificial sequence
  SiRNA target sequence
tattagacttaacaaatgata

SEQ ID NO: 50622 - DNA, 21 bp, Artificial sequence
  SiRNA target sequence
attagacttaacaaatgatac

SEQ ID NO: 50623 - DNA, 21 bp, Artificial sequence
  SiRNA target sequence
ttagacttaacaaatgatact

SEQ ID NO: 50624 - DNA, 21 bp, Artificial sequence
  SiRNA target sequence
tagacttaacaaatgatactg

SEQ ID NO: 50625 - DNA, 21 bp, Artificial sequence
  SiRNA target sequence
agacttaacaaatgatactga

SEQ ID NO: 50626 - DNA, 21 bp, Artificial sequence
  SiRNA target sequence
gacttaacaaatgatactgag

SEQ ID NO: 50627 - DNA, 21 bp, Artificial sequence
  SiRNA target sequence
acttaacaaatgatactgagg

SEQ ID NO: 50628 - DNA, 21 bp, Artificial sequence
  SiRNA target sequence
cttaacaaatgatactgaggt

SEQ ID NO: 50629 - DNA, 21 bp, Artificial sequence
  SiRNA target sequence
ttaacaaatgatactgaggtt

SEQ ID NO: 50630 - DNA, 21 bp, Artificial sequence
  SiRNA target sequence
taacaaatgatactgaggtta

SEQ ID NO: 50631 - DNA, 21 bp, Artificial sequence
  SiRNA target sequence
aacaaatgatactgaggttac

SEQ ID NO: 50632 - DNA, 21 bp, Artificial sequence
  SiRNA target sequence
acaaatgatactgaggttacg

SEQ ID NO: 50633 - DNA, 21 bp, Artificial sequence
  SiRNA target sequence
caaatgatactgaggttacga

SEQ ID NO: 50634 - DNA, 21 bp, Artificial sequence
  SiRNA target sequence
aaatgatactgaggttacgat

SEQ ID NO: 50635 - DNA, 21 bp, Artificial sequence
  SiRNA target sequence
aatgatactgaggttacgatc

SEQ ID NO: 50636 - DNA, 21 bp, Artificial sequence
  SiRNA target sequence
atgatactgaggttacgatca

SEQ ID NO: 50637 - DNA, 21 bp, Artificial sequence
  SiRNA target sequence
tgatactgaggttacgatcaa

SEQ ID NO: 50638 - DNA, 21 bp, Artificial sequence
  SiRNA target sequence
gatactgaggttacgatcaaa

SEQ ID NO: 50639 - DNA, 21 bp, Artificial sequence
  SiRNA target sequence
atactgaggttacgatcaaag

SEQ ID NO: 50640 - DNA, 21 bp, Artificial sequence
  SiRNA target sequence
tactgaggttacgatcaaagt

SEQ ID NO: 50641 - DNA, 21 bp, Artificial sequence
  SiRNA target sequence
actgaggttacgatcaaagta

SEQ ID NO: 50642 - DNA, 21 bp, Artificial sequence
  SiRNA target sequence
ctgaggttacgatcaaagtac

SEQ ID NO: 50643 - DNA, 21 bp, Artificial sequence
  SiRNA target sequence
tgaggttacgatcaaagtacc

SEQ ID NO: 50644 - DNA, 21 bp, Artificial sequence
  SiRNA target sequence
gaggttacgatcaaagtacca

SEQ ID NO: 50645 - DNA, 21 bp, Artificial sequence
  SiRNA target sequence
aggttacgatcaaagtaccat

SEQ ID NO: 50646 - DNA, 21 bp, Artificial sequence
  SiRNA target sequence
ggttacgatcaaagtaccata

SEQ ID NO: 50647 - DNA, 21 bp, Artificial sequence
  SiRNA target sequence
gttacgatcaaagtaccatat

SEQ ID NO: 50648 - DNA, 21 bp, Artificial sequence
  SiRNA target sequence
ttacgatcaaagtaccatatg

SEQ ID NO: 50649 - DNA, 21 bp, Artificial sequence
  SiRNA target sequence
tacgatcaaagtaccatatgt

SEQ ID NO: 50650 - DNA, 21 bp, Artificial sequence
  SiRNA target sequence
acgatcaaagtaccatatgtt

SEQ ID NO: 50651 - DNA, 21 bp, Artificial sequence
  SiRNA target sequence
cgatcaaagtaccatatgttt

SEQ ID NO: 50652 - DNA, 21 bp, Artificial sequence
  SiRNA target sequence
gatcaaagtaccatatgtttc

SEQ ID NO: 50653 - DNA, 21 bp, Artificial sequence
  SiRNA target sequence
atcaaagtaccatatgtttcg

SEQ ID NO: 50654 - DNA, 21 bp, Artificial sequence
  SiRNA target sequence
tcaaagtaccatatgtttcga

SEQ ID NO: 50655 - DNA, 21 bp, Artificial sequence
  SiRNA target sequence
caaagtaccatatgtttcgaa

SEQ ID NO: 50656 - DNA, 21 bp, Artificial sequence
  SiRNA target sequence
aaagtaccatatgtttcgaat

SEQ ID NO: 50657 - DNA, 21 bp, Artificial sequence
  SiRNA target sequence
aagtaccatatgtttcgaata

SEQ ID NO: 50658 - DNA, 21 bp, Artificial sequence
  SiRNA target sequence
agtaccatatgtttcgaataa

SEQ ID NO: 50659 - DNA, 21 bp, Artificial sequence
  SiRNA target sequence
gtaccatatgtttcgaataag

SEQ ID NO: 50660 - DNA, 21 bp, Artificial sequence
  SiRNA target sequence
taccatatgtttcgaataaga

SEQ ID NO: 50661 - DNA, 21 bp, Artificial sequence
  SiRNA target sequence
accatatgtttcgaataagat

SEQ ID NO: 50662 - DNA, 21 bp, Artificial sequence
  SiRNA target sequence
ccatatgtttcgaataagatg

SEQ ID NO: 50663 - DNA, 21 bp, Artificial sequence
  SiRNA target sequence
catatgtttcgaataagatgt

SEQ ID NO: 50664 - DNA, 21 bp, Artificial sequence
  SiRNA target sequence
atatgtttcgaataagatgtt

SEQ ID NO: 50665 - DNA, 21 bp, Artificial sequence
  SiRNA target sequence
tatgtttcgaataagatgttt

SEQ ID NO: 50666 - DNA, 21 bp, Artificial sequence
  SiRNA target sequence
atgtttcgaataagatgttta

SEQ ID NO: 50667 - DNA, 21 bp, Artificial sequence
  SiRNA target sequence
tgtttcgaataagatgtttat

SEQ ID NO: 50668 - DNA, 21 bp, Artificial sequence
  SiRNA target sequence
gtttcgaataagatgtttatg

SEQ ID NO: 50669 - DNA, 21 bp, Artificial sequence
  SiRNA target sequence
tttcgaataagatgtttatga

SEQ ID NO: 50670 - DNA, 21 bp, Artificial sequence
  SiRNA target sequence
ttcgaataagatgtttatgaa

SEQ ID NO: 50671 - DNA, 21 bp, Artificial sequence
  SiRNA target sequence
tcgaataagatgtttatgaag

SEQ ID NO: 50672 - DNA, 21 bp, Artificial sequence
  SiRNA target sequence
cgaataagatgtttatgaaga

SEQ ID NO: 50673 - DNA, 21 bp, Artificial sequence
  SiRNA target sequence
gaataagatgtttatgaagac

SEQ ID NO: 50674 - DNA, 21 bp, Artificial sequence
  SiRNA target sequence
aataagatgtttatgaagacc

SEQ ID NO: 50675 - DNA, 21 bp, Artificial sequence
  SiRNA target sequence
ataagatgtttatgaagaccg

SEQ ID NO: 50676 - DNA, 21 bp, Artificial sequence
  SiRNA target sequence
taagatgtttatgaagaccgt

SEQ ID NO: 50677 - DNA, 21 bp, Artificial sequence
  SiRNA target sequence
aagatgtttatgaagaccgtt

SEQ ID NO: 50678 - DNA, 21 bp, Artificial sequence
  SiRNA target sequence
agatgtttatgaagaccgttg

SEQ ID NO: 50679 - DNA, 21 bp, Artificial sequence
  SiRNA target sequence
gatgtttatgaagaccgttgg

SEQ ID NO: 50680 - DNA, 21 bp, Artificial sequence
  SiRNA target sequence
atgtttatgaagaccgttggc

SEQ ID NO: 50681 - DNA, 21 bp, Artificial sequence
  SiRNA target sequence
tgtttatgaagaccgttggca

SEQ ID NO: 50682 - DNA, 21 bp, Artificial sequence
  SiRNA target sequence
gtttatgaagaccgttggcat

SEQ ID NO: 50683 - DNA, 21 bp, Artificial sequence
  SiRNA target sequence
tttatgaagaccgttggcatc

SEQ ID NO: 50684 - DNA, 21 bp, Artificial sequence
  SiRNA target sequence
ttatgaagaccgttggcatct

SEQ ID NO: 50685 - DNA, 21 bp, Artificial sequence
  SiRNA target sequence
tatgaagaccgttggcatcta

SEQ ID NO: 50686 - DNA, 21 bp, Artificial sequence
  SiRNA target sequence
atgaagaccgttggcatctac

SEQ ID NO: 50687 - DNA, 21 bp, Artificial sequence
  SiRNA target sequence
tgaagaccgttggcatctacg

SEQ ID NO: 50688 - DNA, 21 bp, Artificial sequence
  SiRNA target sequence
gaagaccgttggcatctacgg

SEQ ID NO: 50689 - DNA, 21 bp, Artificial sequence
  SiRNA target sequence
aagaccgttggcatctacggt

SEQ ID NO: 50690 - DNA, 21 bp, Artificial sequence
  SiRNA target sequence
agaccgttggcatctacggtg

SEQ ID NO: 50691 - DNA, 21 bp, Artificial sequence
  SiRNA target sequence
gaccgttggcatctacggtgc

SEQ ID NO: 50692 - DNA, 21 bp, Artificial sequence
  SiRNA target sequence
accgttggcatctacggtgcg

SEQ ID NO: 50693 - DNA, 21 bp, Artificial sequence
  SiRNA target sequence
ccgttggcatctacggtgcgc

SEQ ID NO: 50694 - DNA, 21 bp, Artificial sequence
  SiRNA target sequence
cgttggcatctacggtgcgca

SEQ ID NO: 50695 - DNA, 21 bp, Artificial sequence
  SiRNA target sequence
gttggcatctacggtgcgcat

SEQ ID NO: 50696 - DNA, 21 bp, Artificial sequence
  SiRNA target sequence
ttggcatctacggtgcgcatg

SEQ ID NO: 50697 - DNA, 21 bp, Artificial sequence
  SiRNA target sequence
tggcatctacggtgcgcatga

SEQ ID NO: 50698 - DNA, 21 bp, Artificial sequence
  SiRNA target sequence
ggcatctacggtgcgcatgat

SEQ ID NO: 50699 - DNA, 21 bp, Artificial sequence
  SiRNA target sequence
gcatctacggtgcgcatgatg

SEQ ID NO: 50700 - DNA, 21 bp, Artificial sequence
  SiRNA target sequence
catctacggtgcgcatgatga

SEQ ID NO: 50701 - DNA, 21 bp, Artificial sequence
  SiRNA target sequence
atctacggtgcgcatgatgag

SEQ ID NO: 50702 - DNA, 21 bp, Artificial sequence
  SiRNA target sequence
tctacggtgcgcatgatgagg

SEQ ID NO: 50703 - DNA, 21 bp, Artificial sequence
  SiRNA target sequence
ctacggtgcgcatgatgagga

SEQ ID NO: 50704 - DNA, 21 bp, Artificial sequence
  SiRNA target sequence
tacggtgcgcatgatgaggat

SEQ ID NO: 50705 - DNA, 21 bp, Artificial sequence
  SiRNA target sequence
acggtgcgcatgatgaggata

SEQ ID NO: 50706 - DNA, 21 bp, Artificial sequence
  SiRNA target sequence
cggtgcgcatgatgaggataa

SEQ ID NO: 50707 - DNA, 21 bp, Artificial sequence
  SiRNA target sequence
ggtgcgcatgatgaggataat

SEQ ID NO: 50708 - DNA, 21 bp, Artificial sequence
  SiRNA target sequence
gtgcgcatgatgaggataatt

SEQ ID NO: 50709 - DNA, 21 bp, Artificial sequence
  SiRNA target sequence
tgcgcatgatgaggataattg

SEQ ID NO: 50710 - DNA, 21 bp, Artificial sequence
  SiRNA target sequence
gcgcatgatgaggataattgg

SEQ ID NO: 50711 - DNA, 21 bp, Artificial sequence
  SiRNA target sequence
cgcatgatgaggataattgga

SEQ ID NO: 50712 - DNA, 21 bp, Artificial sequence
  SiRNA target sequence
gcatgatgaggataattggaa

SEQ ID NO: 50713 - DNA, 21 bp, Artificial sequence
  SiRNA target sequence
catgatgaggataattggaac

SEQ ID NO: 50714 - DNA, 21 bp, Artificial sequence
  SiRNA target sequence
atgatgaggataattggaact

SEQ ID NO: 50715 - DNA, 21 bp, Artificial sequence
  SiRNA target sequence
tgatgaggataattggaactt

SEQ ID NO: 50716 - DNA, 21 bp, Artificial sequence
  SiRNA target sequence
gatgaggataattggaacttt

SEQ ID NO: 50717 - DNA, 21 bp, Artificial sequence
  SiRNA target sequence
atgaggataattggaactttg

SEQ ID NO: 50718 - DNA, 21 bp, Artificial sequence
  SiRNA target sequence
tgaggataattggaactttga

SEQ ID NO: 50719 - DNA, 21 bp, Artificial sequence
  SiRNA target sequence
gaggataattggaactttgat

SEQ ID NO: 50720 - DNA, 21 bp, Artificial sequence
  SiRNA target sequence
aggataattggaactttgatg

SEQ ID NO: 50721 - DNA, 21 bp, Artificial sequence
  SiRNA target sequence
ggataattggaactttgatga

SEQ ID NO: 50722 - DNA, 21 bp, Artificial sequence
  SiRNA target sequence
gataattggaactttgatgaa

SEQ ID NO: 50723 - DNA, 21 bp, Artificial sequence
  SiRNA target sequence
ataattggaactttgatgaat

SEQ ID NO: 50724 - DNA, 21 bp, Artificial sequence
  SiRNA target sequence
taattggaactttgatgaatc

SEQ ID NO: 50725 - DNA, 21 bp, Artificial sequence
  SiRNA target sequence
aattggaactttgatgaatcc

SEQ ID NO: 50726 - DNA, 21 bp, Artificial sequence
  SiRNA target sequence
attggaactttgatgaatcct

SEQ ID NO: 50727 - DNA, 21 bp, Artificial sequence
  SiRNA target sequence
ttggaactttgatgaatcctt

SEQ ID NO: 50728 - DNA, 21 bp, Artificial sequence
  SiRNA target sequence
tggaactttgatgaatccttc

SEQ ID NO: 50729 - DNA, 21 bp, Artificial sequence
  SiRNA target sequence
ggaactttgatgaatccttca

SEQ ID NO: 50730 - DNA, 21 bp, Artificial sequence
  SiRNA target sequence
gaactttgatgaatccttcac

SEQ ID NO: 50731 - DNA, 21 bp, Artificial sequence
  SiRNA target sequence
aactttgatgaatccttcacc

SEQ ID NO: 50732 - DNA, 21 bp, Artificial sequence
  SiRNA target sequence
actttgatgaatccttcaccg

SEQ ID NO: 50733 - DNA, 21 bp, Artificial sequence
  SiRNA target sequence
ctttgatgaatccttcaccgg

SEQ ID NO: 50734 - DNA, 21 bp, Artificial sequence
  SiRNA target sequence
tttgatgaatccttcaccgga

SEQ ID NO: 50735 - DNA, 21 bp, Artificial sequence
  SiRNA target sequence
ttgatgaatccttcaccggat

SEQ ID NO: 50736 - DNA, 21 bp, Artificial sequence
  SiRNA target sequence
tgatgaatccttcaccggatt

SEQ ID NO: 50737 - DNA, 21 bp, Artificial sequence
  SiRNA target sequence
gatgaatccttcaccggattc

SEQ ID NO: 50738 - DNA, 21 bp, Artificial sequence
  SiRNA target sequence
atgaatccttcaccggattct

SEQ ID NO: 50739 - DNA, 21 bp, Artificial sequence
  SiRNA target sequence
tgaatccttcaccggattctt

SEQ ID NO: 50740 - DNA, 21 bp, Artificial sequence
  SiRNA target sequence
gaatccttcaccggattcttg

SEQ ID NO: 50741 - DNA, 21 bp, Artificial sequence
  SiRNA target sequence
aatccttcaccggattcttgt

SEQ ID NO: 50742 - DNA, 21 bp, Artificial sequence
  SiRNA target sequence
atccttcaccggattcttgtg

SEQ ID NO: 50743 - DNA, 21 bp, Artificial sequence
  SiRNA target sequence
tccttcaccggattcttgtgc

SEQ ID NO: 50744 - DNA, 21 bp, Artificial sequence
  SiRNA target sequence
ccttcaccggattcttgtgca

SEQ ID NO: 50745 - DNA, 21 bp, Artificial sequence
  SiRNA target sequence
cttcaccggattcttgtgcat

SEQ ID NO: 50746 - DNA, 21 bp, Artificial sequence
  SiRNA target sequence
ttcaccggattcttgtgcata

SEQ ID NO: 50747 - DNA, 21 bp, Artificial sequence
  SiRNA target sequence
tcaccggattcttgtgcataa

SEQ ID NO: 50748 - DNA, 21 bp, Artificial sequence
  SiRNA target sequence
caccggattcttgtgcataag

SEQ ID NO: 50749 - DNA, 21 bp, Artificial sequence
  SiRNA target sequence
accggattcttgtgcataagg

SEQ ID NO: 50750 - DNA, 21 bp, Artificial sequence
  SiRNA target sequence
ccggattcttgtgcataaggc

SEQ ID NO: 50751 - DNA, 21 bp, Artificial sequence
  SiRNA target sequence
cggattcttgtgcataaggcc

SEQ ID NO: 50752 - DNA, 21 bp, Artificial sequence
  SiRNA target sequence
ggattcttgtgcataaggcca

SEQ ID NO: 50753 - DNA, 21 bp, Artificial sequence
  SiRNA target sequence
gattcttgtgcataaggccaa

SEQ ID NO: 50754 - DNA, 21 bp, Artificial sequence
  SiRNA target sequence
attcttgtgcataaggccaat

SEQ ID NO: 50755 - DNA, 21 bp, Artificial sequence
  SiRNA target sequence
ttcttgtgcataaggccaatt

SEQ ID NO: 50756 - DNA, 21 bp, Artificial sequence
  SiRNA target sequence
tcttgtgcataaggccaatta

SEQ ID NO: 50757 - DNA, 21 bp, Artificial sequence
  SiRNA target sequence
cttgtgcataaggccaattac

SEQ ID NO: 50758 - DNA, 21 bp, Artificial sequence
  SiRNA target sequence
ttgtgcataaggccaattact

SEQ ID NO: 50759 - DNA, 21 bp, Artificial sequence
  SiRNA target sequence
tgtgcataaggccaattacta

SEQ ID NO: 50760 - DNA, 21 bp, Artificial sequence
  SiRNA target sequence
gtgcataaggccaattactaa

SEQ ID NO: 50761 - DNA, 21 bp, Artificial sequence
  SiRNA target sequence
tgcataaggccaattactaaa

SEQ ID NO: 50762 - DNA, 21 bp, Artificial sequence
  SiRNA target sequence
gcataaggccaattactaaac

SEQ ID NO: 50763 - DNA, 21 bp, Artificial sequence
  SiRNA target sequence
cataaggccaattactaaact

SEQ ID NO: 50764 - DNA, 21 bp, Artificial sequence
  SiRNA target sequence
ataaggccaattactaaactc

SEQ ID NO: 50765 - DNA, 21 bp, Artificial sequence
  SiRNA target sequence
taaggccaattactaaactca

SEQ ID NO: 50766 - DNA, 21 bp, Artificial sequence
  SiRNA target sequence
aaggccaattactaaactcat

SEQ ID NO: 50767 - DNA, 21 bp, Artificial sequence
  SiRNA target sequence
aggccaattactaaactcatg

SEQ ID NO: 50768 - DNA, 21 bp, Artificial sequence
  SiRNA target sequence
ggccaattactaaactcatgg

SEQ ID NO: 50769 - DNA, 21 bp, Artificial sequence
  SiRNA target sequence
gccaattactaaactcatggc

SEQ ID NO: 50770 - DNA, 21 bp, Artificial sequence
  SiRNA target sequence
ccaattactaaactcatggca

SEQ ID NO: 50771 - DNA, 21 bp, Artificial sequence
  SiRNA target sequence
caattactaaactcatggcac

SEQ ID NO: 50772 - DNA, 21 bp, Artificial sequence
  SiRNA target sequence
aattactaaactcatggcacc

SEQ ID NO: 50773 - DNA, 21 bp, Artificial sequence
  SiRNA target sequence
attactaaactcatggcacct

SEQ ID NO: 50774 - DNA, 21 bp, Artificial sequence
  SiRNA target sequence
ttactaaactcatggcacctg

SEQ ID NO: 50775 - DNA, 21 bp, Artificial sequence
  SiRNA target sequence
tactaaactcatggcacctga

SEQ ID NO: 50776 - DNA, 21 bp, Artificial sequence
  SiRNA target sequence
actaaactcatggcacctgat

SEQ ID NO: 50777 - DNA, 21 bp, Artificial sequence
  SiRNA target sequence
ctaaactcatggcacctgata

SEQ ID NO: 50778 - DNA, 21 bp, Artificial sequence
  SiRNA target sequence
taaactcatggcacctgatac

SEQ ID NO: 50779 - DNA, 21 bp, Artificial sequence
  SiRNA target sequence
aaactcatggcacctgatacg

SEQ ID NO: 50780 - DNA, 21 bp, Artificial sequence
  SiRNA target sequence
aactcatggcacctgatacgg

SEQ ID NO: 50781 - DNA, 21 bp, Artificial sequence
  SiRNA target sequence
actcatggcacctgatacggt

SEQ ID NO: 50782 - DNA, 21 bp, Artificial sequence
  SiRNA target sequence
ctcatggcacctgatacggta

SEQ ID NO: 50783 - DNA, 21 bp, Artificial sequence
  SiRNA target sequence
tcatggcacctgatacggtat

SEQ ID NO: 50784 - DNA, 21 bp, Artificial sequence
  SiRNA target sequence
catggcacctgatacggtatc

SEQ ID NO: 50785 - DNA, 21 bp, Artificial sequence
  SiRNA target sequence
atggcacctgatacggtatcg

SEQ ID NO: 50786 - DNA, 21 bp, Artificial sequence
  SiRNA target sequence
tggcacctgatacggtatcgc

SEQ ID NO: 50787 - DNA, 21 bp, Artificial sequence
  SiRNA target sequence
ggcacctgatacggtatcgca

SEQ ID NO: 50788 - DNA, 21 bp, Artificial sequence
  SiRNA target sequence
gcacctgatacggtatcgcag

SEQ ID NO: 50789 - DNA, 21 bp, Artificial sequence
  SiRNA target sequence
cacctgatacggtatcgcaga

SEQ ID NO: 50790 - DNA, 21 bp, Artificial sequence
  SiRNA target sequence
acctgatacggtatcgcagaa

SEQ ID NO: 50791 - DNA, 21 bp, Artificial sequence
  SiRNA target sequence
cctgatacggtatcgcagaaa

SEQ ID NO: 50792 - DNA, 21 bp, Artificial sequence
  SiRNA target sequence
ctgatacggtatcgcagaaag

SEQ ID NO: 50793 - DNA, 21 bp, Artificial sequence
  SiRNA target sequence
tgatacggtatcgcagaaagt

SEQ ID NO: 50794 - DNA, 21 bp, Artificial sequence
  SiRNA target sequence
gatacggtatcgcagaaagta

SEQ ID NO: 50795 - DNA, 21 bp, Artificial sequence
  SiRNA target sequence
atacggtatcgcagaaagtat

SEQ ID NO: 50796 - DNA, 21 bp, Artificial sequence
  SiRNA target sequence
tacggtatcgcagaaagtatc

SEQ ID NO: 50797 - DNA, 21 bp, Artificial sequence
  SiRNA target sequence
acggtatcgcagaaagtatct

SEQ ID NO: 50798 - DNA, 21 bp, Artificial sequence
  SiRNA target sequence
cggtatcgcagaaagtatcta

SEQ ID NO: 50799 - DNA, 21 bp, Artificial sequence
  SiRNA target sequence
ggtatcgcagaaagtatctat

SEQ ID NO: 50800 - DNA, 21 bp, Artificial sequence
  SiRNA target sequence
gtatcgcagaaagtatctata

SEQ ID NO: 50801 - DNA, 21 bp, Artificial sequence
  SiRNA target sequence
tatcgcagaaagtatctatag

SEQ ID NO: 50802 - DNA, 21 bp, Artificial sequence
  SiRNA target sequence
atcgcagaaagtatctatagt

SEQ ID NO: 50803 - DNA, 21 bp, Artificial sequence
  SiRNA target sequence
tcgcagaaagtatctatagtt

SEQ ID NO: 50804 - DNA, 21 bp, Artificial sequence
  SiRNA target sequence
cgcagaaagtatctatagttg

SEQ ID NO: 50805 - DNA, 21 bp, Artificial sequence
  SiRNA target sequence
gcagaaagtatctatagttgt

SEQ ID NO: 50806 - DNA, 21 bp, Artificial sequence
  SiRNA target sequence
cagaaagtatctatagttgta

SEQ ID NO: 50807 - DNA, 21 bp, Artificial sequence
  SiRNA target sequence
agaaagtatctatagttgtat

SEQ ID NO: 50808 - DNA, 21 bp, Artificial sequence
  SiRNA target sequence
gaaagtatctatagttgtatg

SEQ ID NO: 50809 - DNA, 21 bp, Artificial sequence
  SiRNA target sequence
aaagtatctatagttgtatgg

SEQ ID NO: 50810 - DNA, 21 bp, Artificial sequence
  SiRNA target sequence
aagtatctatagttgtatgga

SEQ ID NO: 50811 - DNA, 21 bp, Artificial sequence
  SiRNA target sequence
agtatctatagttgtatggaa

SEQ ID NO: 50812 - DNA, 21 bp, Artificial sequence
  SiRNA target sequence
gtatctatagttgtatggaaa

SEQ ID NO: 50813 - DNA, 21 bp, Artificial sequence
  SiRNA target sequence
tatctatagttgtatggaaat

SEQ ID NO: 50814 - DNA, 21 bp, Artificial sequence
  SiRNA target sequence
atctatagttgtatggaaatg

SEQ ID NO: 50815 - DNA, 21 bp, Artificial sequence
  SiRNA target sequence
tctatagttgtatggaaatgg

SEQ ID NO: 50816 - DNA, 21 bp, Artificial sequence
  SiRNA target sequence
ctatagttgtatggaaatggg

SEQ ID NO: 50817 - DNA, 21 bp, Artificial sequence
  SiRNA target sequence
tatagttgtatggaaatgggc

SEQ ID NO: 50818 - DNA, 21 bp, Artificial sequence
  SiRNA target sequence
atagttgtatggaaatgggca

SEQ ID NO: 50819 - DNA, 21 bp, Artificial sequence
  SiRNA target sequence
tagttgtatggaaatgggcag

SEQ ID NO: 50820 - DNA, 21 bp, Artificial sequence
  SiRNA target sequence
agttgtatggaaatgggcaga

SEQ ID NO: 50821 - DNA, 21 bp, Artificial sequence
  SiRNA target sequence
gttgtatggaaatgggcagaa

SEQ ID NO: 50822 - DNA, 21 bp, Artificial sequence
  SiRNA target sequence
ttgtatggaaatgggcagaag

SEQ ID NO: 50823 - DNA, 21 bp, Artificial sequence
  SiRNA target sequence
tgtatggaaatgggcagaaga

SEQ ID NO: 50824 - DNA, 21 bp, Artificial sequence
  SiRNA target sequence
gtatggaaatgggcagaagac

SEQ ID NO: 50825 - DNA, 21 bp, Artificial sequence
  SiRNA target sequence
tatggaaatgggcagaagacg

SEQ ID NO: 50826 - DNA, 21 bp, Artificial sequence
  SiRNA target sequence
atggaaatgggcagaagacgt

SEQ ID NO: 50827 - DNA, 21 bp, Artificial sequence
  SiRNA target sequence
tggaaatgggcagaagacgta

SEQ ID NO: 50828 - DNA, 21 bp, Artificial sequence
  SiRNA target sequence
ggaaatgggcagaagacgtag

SEQ ID NO: 50829 - DNA, 21 bp, Artificial sequence
  SiRNA target sequence
gaaatgggcagaagacgtagt

SEQ ID NO: 50830 - DNA, 21 bp, Artificial sequence
  SiRNA target sequence
aaatgggcagaagacgtagta

SEQ ID NO: 50831 - DNA, 21 bp, Artificial sequence
  SiRNA target sequence
aatgggcagaagacgtagtag

SEQ ID NO: 50832 - DNA, 21 bp, Artificial sequence
  SiRNA target sequence
atgggcagaagacgtagtagt

SEQ ID NO: 50833 - DNA, 21 bp, Artificial sequence
  SiRNA target sequence
tgggcagaagacgtagtagta

SEQ ID NO: 50834 - DNA, 21 bp, Artificial sequence
  SiRNA target sequence
gggcagaagacgtagtagtag

SEQ ID NO: 50835 - DNA, 21 bp, Artificial sequence
  SiRNA target sequence
ggcagaagacgtagtagtagt

SEQ ID NO: 50836 - DNA, 21 bp, Artificial sequence
  SiRNA target sequence
gcagaagacgtagtagtagta

SEQ ID NO: 50837 - DNA, 21 bp, Artificial sequence
  SiRNA target sequence
cagaagacgtagtagtagtag

SEQ ID NO: 50838 - DNA, 21 bp, Artificial sequence
  SiRNA target sequence
agaagacgtagtagtagtaga

SEQ ID NO: 50839 - DNA, 21 bp, Artificial sequence
  SiRNA target sequence
gaagacgtagtagtagtagaa

SEQ ID NO: 50840 - DNA, 21 bp, Artificial sequence
  SiRNA target sequence
aagacgtagtagtagtagaac

SEQ ID NO: 50841 - DNA, 21 bp, Artificial sequence
  SiRNA target sequence
agacgtagtagtagtagaacc

SEQ ID NO: 50842 - DNA, 21 bp, Artificial sequence
  SiRNA target sequence
gacgtagtagtagtagaacct

SEQ ID NO: 50843 - DNA, 21 bp, Artificial sequence
  SiRNA target sequence
acgtagtagtagtagaaccta

SEQ ID NO: 50844 - DNA, 21 bp, Artificial sequence
  SiRNA target sequence
cgtagtagtagtagaacctaa

SEQ ID NO: 50845 - DNA, 21 bp, Artificial sequence
  SiRNA target sequence
gtagtagtagtagaacctaaa

SEQ ID NO: 50846 - DNA, 21 bp, Artificial sequence
  SiRNA target sequence
tagtagtagtagaacctaaac

SEQ ID NO: 50847 - DNA, 21 bp, Artificial sequence
  SiRNA target sequence
agtagtagtagaacctaaacc

SEQ ID NO: 50848 - DNA, 21 bp, Artificial sequence
  SiRNA target sequence
gtagtagtagaacctaaacca

SEQ ID NO: 50849 - DNA, 21 bp, Artificial sequence
  SiRNA target sequence
tagtagtagaacctaaaccac

SEQ ID NO: 50850 - DNA, 21 bp, Artificial sequence
  SiRNA target sequence
agtagtagaacctaaaccact

SEQ ID NO: 50851 - DNA, 21 bp, Artificial sequence
  SiRNA target sequence
gtagtagaacctaaaccactc

SEQ ID NO: 50852 - DNA, 21 bp, Artificial sequence
  SiRNA target sequence
tagtagaacctaaaccactca

SEQ ID NO: 50853 - DNA, 21 bp, Artificial sequence
  SiRNA target sequence
agtagaacctaaaccactcac

SEQ ID NO: 50854 - DNA, 21 bp, Artificial sequence
  SiRNA target sequence
gtagaacctaaaccactcacc

SEQ ID NO: 50855 - DNA, 21 bp, Artificial sequence
  SiRNA target sequence
tagaacctaaaccactcacct

SEQ ID NO: 50856 - DNA, 21 bp, Artificial sequence
  SiRNA target sequence
agaacctaaaccactcacctc

SEQ ID NO: 50857 - DNA, 21 bp, Artificial sequence
  SiRNA target sequence
gaacctaaaccactcacctca

SEQ ID NO: 50858 - DNA, 21 bp, Artificial sequence
  SiRNA target sequence
aacctaaaccactcacctcag

SEQ ID NO: 50859 - DNA, 21 bp, Artificial sequence
  SiRNA target sequence
acctaaaccactcacctcagg

SEQ ID NO: 50860 - DNA, 21 bp, Artificial sequence
  SiRNA target sequence
cctaaaccactcacctcagga

SEQ ID NO: 50861 - DNA, 21 bp, Artificial sequence
  SiRNA target sequence
ctaaaccactcacctcaggac

SEQ ID NO: 50862 - DNA, 21 bp, Artificial sequence
  SiRNA target sequence
taaaccactcacctcaggacc

SEQ ID NO: 50863 - DNA, 21 bp, Artificial sequence
  SiRNA target sequence
aaaccactcacctcaggaccg

SEQ ID NO: 50864 - DNA, 21 bp, Artificial sequence
  SiRNA target sequence
aaccactcacctcaggaccga

SEQ ID NO: 50865 - DNA, 21 bp, Artificial sequence
  SiRNA target sequence
accactcacctcaggaccgac

SEQ ID NO: 50866 - DNA, 21 bp, Artificial sequence
  SiRNA target sequence
ccactcacctcaggaccgact

SEQ ID NO: 50867 - DNA, 21 bp, Artificial sequence
  SiRNA target sequence
cactcacctcaggaccgactc

SEQ ID NO: 50868 - DNA, 21 bp, Artificial sequence
  SiRNA target sequence
actcacctcaggaccgactca

SEQ ID NO: 50869 - DNA, 21 bp, Artificial sequence
  SiRNA target sequence
ctcacctcaggaccgactcaa

SEQ ID NO: 50870 - DNA, 21 bp, Artificial sequence
  SiRNA target sequence
tcacctcaggaccgactcaag

SEQ ID NO: 50871 - DNA, 21 bp, Artificial sequence
  SiRNA target sequence
cacctcaggaccgactcaagt

SEQ ID NO: 50872 - DNA, 21 bp, Artificial sequence
  SiRNA target sequence
acctcaggaccgactcaagtg

SEQ ID NO: 50873 - DNA, 21 bp, Artificial sequence
  SiRNA target sequence
cctcaggaccgactcaagtgt

SEQ ID NO: 50874 - DNA, 21 bp, Artificial sequence
  SiRNA target sequence
ctcaggaccgactcaagtgta

SEQ ID NO: 50875 - DNA, 21 bp, Artificial sequence
  SiRNA target sequence
tcaggaccgactcaagtgtac

SEQ ID NO: 50876 - DNA, 21 bp, Artificial sequence
  SiRNA target sequence
caggaccgactcaagtgtaca

SEQ ID NO: 50877 - DNA, 21 bp, Artificial sequence
  SiRNA target sequence
aggaccgactcaagtgtacaa

SEQ ID NO: 50878 - DNA, 21 bp, Artificial sequence
  SiRNA target sequence
ggaccgactcaagtgtacaat

SEQ ID NO: 50879 - DNA, 21 bp, Artificial sequence
  SiRNA target sequence
gaccgactcaagtgtacaatc

SEQ ID NO: 50880 - DNA, 21 bp, Artificial sequence
  SiRNA target sequence
accgactcaagtgtacaatcc

SEQ ID NO: 50881 - DNA, 21 bp, Artificial sequence
  SiRNA target sequence
ccgactcaagtgtacaatcca

SEQ ID NO: 50882 - DNA, 21 bp, Artificial sequence
  SiRNA target sequence
cgactcaagtgtacaatccac

SEQ ID NO: 50883 - DNA, 21 bp, Artificial sequence
  SiRNA target sequence
gactcaagtgtacaatccacc

SEQ ID NO: 50884 - DNA, 21 bp, Artificial sequence
  SiRNA target sequence
actcaagtgtacaatccacct

SEQ ID NO: 50885 - DNA, 21 bp, Artificial sequence
  SiRNA target sequence
ctcaagtgtacaatccacctg

SEQ ID NO: 50886 - DNA, 21 bp, Artificial sequence
  SiRNA target sequence
tcaagtgtacaatccacctgc

SEQ ID NO: 50887 - DNA, 21 bp, Artificial sequence
  SiRNA target sequence
caagtgtacaatccacctgca

SEQ ID NO: 50888 - DNA, 21 bp, Artificial sequence
  SiRNA target sequence
aagtgtacaatccacctgcag

SEQ ID NO: 50889 - DNA, 21 bp, Artificial sequence
  SiRNA target sequence
agtgtacaatccacctgcagt

SEQ ID NO: 50890 - DNA, 21 bp, Artificial sequence
  SiRNA target sequence
gtgtacaatccacctgcagta

SEQ ID NO: 50891 - DNA, 21 bp, Artificial sequence
  SiRNA target sequence
tgtacaatccacctgcagtag

SEQ ID NO: 50892 - DNA, 21 bp, Artificial sequence
  SiRNA target sequence
gtacaatccacctgcagtagc

SEQ ID NO: 50893 - DNA, 21 bp, Artificial sequence
  SiRNA target sequence
tacaatccacctgcagtagct

SEQ ID NO: 50894 - DNA, 21 bp, Artificial sequence
  SiRNA target sequence
acaatccacctgcagtagcta

SEQ ID NO: 50895 - DNA, 21 bp, Artificial sequence
  SiRNA target sequence
caatccacctgcagtagctag

SEQ ID NO: 50896 - DNA, 21 bp, Artificial sequence
  SiRNA target sequence
aatccacctgcagtagctaga

SEQ ID NO: 50897 - DNA, 21 bp, Artificial sequence
  SiRNA target sequence
atccacctgcagtagctagag

SEQ ID NO: 50898 - DNA, 21 bp, Artificial sequence
  SiRNA target sequence
tccacctgcagtagctagaga

SEQ ID NO: 50899 - DNA, 21 bp, Artificial sequence
  SiRNA target sequence
ccacctgcagtagctagagac

SEQ ID NO: 50900 - DNA, 21 bp, Artificial sequence
  SiRNA target sequence
cacctgcagtagctagagacc

SEQ ID NO: 50901 - DNA, 21 bp, Artificial sequence
  SiRNA target sequence
acctgcagtagctagagacct

SEQ ID NO: 50902 - DNA, 21 bp, Artificial sequence
  SiRNA target sequence
cctgcagtagctagagaccta

SEQ ID NO: 50903 - DNA, 21 bp, Artificial sequence
  SiRNA target sequence
ctgcagtagctagagacctag

SEQ ID NO: 50904 - DNA, 21 bp, Artificial sequence
  SiRNA target sequence
tgcagtagctagagacctagt

SEQ ID NO: 50905 - DNA, 21 bp, Artificial sequence
  SiRNA target sequence
gcagtagctagagacctagtt

SEQ ID NO: 50906 - DNA, 21 bp, Artificial sequence
  SiRNA target sequence
cagtagctagagacctagtta

SEQ ID NO: 50907 - DNA, 21 bp, Artificial sequence
  SiRNA target sequence
agtagctagagacctagttaa

SEQ ID NO: 50908 - DNA, 21 bp, Artificial sequence
  SiRNA target sequence
gtagctagagacctagttaaa

SEQ ID NO: 50909 - DNA, 21 bp, Artificial sequence
  SiRNA target sequence
tagctagagacctagttaaac

SEQ ID NO: 50910 - DNA, 21 bp, Artificial sequence
  SiRNA target sequence
agctagagacctagttaaaca

SEQ ID NO: 50911 - DNA, 21 bp, Artificial sequence
  SiRNA target sequence
gctagagacctagttaaacag

SEQ ID NO: 50912 - DNA, 21 bp, Artificial sequence
  SiRNA target sequence
ctagagacctagttaaacaga

SEQ ID NO: 50913 - DNA, 21 bp, Artificial sequence
  SiRNA target sequence
tagagacctagttaaacagat

SEQ ID NO: 50914 - DNA, 21 bp, Artificial sequence
  SiRNA target sequence
agagacctagttaaacagatt

SEQ ID NO: 50915 - DNA, 21 bp, Artificial sequence
  SiRNA target sequence
gagacctagttaaacagattg

SEQ ID NO: 50916 - DNA, 21 bp, Artificial sequence
  SiRNA target sequence
agacctagttaaacagattga

SEQ ID NO: 50917 - DNA, 21 bp, Artificial sequence
  SiRNA target sequence
gacctagttaaacagattgat

SEQ ID NO: 50918 - DNA, 21 bp, Artificial sequence
  SiRNA target sequence
acctagttaaacagattgatg

SEQ ID NO: 50919 - DNA, 21 bp, Artificial sequence
  SiRNA target sequence
cctagttaaacagattgatgt

SEQ ID NO: 50920 - DNA, 21 bp, Artificial sequence
  SiRNA target sequence
ctagttaaacagattgatgtt

SEQ ID NO: 50921 - DNA, 21 bp, Artificial sequence
  SiRNA target sequence
tagttaaacagattgatgttt

SEQ ID NO: 50922 - DNA, 21 bp, Artificial sequence
  SiRNA target sequence
agttaaacagattgatgtttc

SEQ ID NO: 50923 - DNA, 21 bp, Artificial sequence
  SiRNA target sequence
gttaaacagattgatgtttca

SEQ ID NO: 50924 - DNA, 21 bp, Artificial sequence
  SiRNA target sequence
ttaaacagattgatgtttcaa

SEQ ID NO: 50925 - DNA, 21 bp, Artificial sequence
  SiRNA target sequence
taaacagattgatgtttcaat

SEQ ID NO: 50926 - DNA, 21 bp, Artificial sequence
  SiRNA target sequence
aaacagattgatgtttcaatg

SEQ ID NO: 50927 - DNA, 21 bp, Artificial sequence
  SiRNA target sequence
aacagattgatgtttcaatgc

SEQ ID NO: 50928 - DNA, 21 bp, Artificial sequence
  SiRNA target sequence
acagattgatgtttcaatgca

SEQ ID NO: 50929 - DNA, 21 bp, Artificial sequence
  SiRNA target sequence
cagattgatgtttcaatgcaa

SEQ ID NO: 50930 - DNA, 21 bp, Artificial sequence
  SiRNA target sequence
agattgatgtttcaatgcaaa

SEQ ID NO: 50931 - DNA, 21 bp, Artificial sequence
  SiRNA target sequence
gattgatgtttcaatgcaaat

SEQ ID NO: 50932 - DNA, 21 bp, Artificial sequence
  SiRNA target sequence
attgatgtttcaatgcaaatt

SEQ ID NO: 50933 - DNA, 21 bp, Artificial sequence
  SiRNA target sequence
ttgatgtttcaatgcaaatta

SEQ ID NO: 50934 - DNA, 21 bp, Artificial sequence
  SiRNA target sequence
tgatgtttcaatgcaaattaa

SEQ ID NO: 50935 - DNA, 21 bp, Artificial sequence
  SiRNA target sequence
gatgtttcaatgcaaattaat

SEQ ID NO: 50936 - DNA, 21 bp, Artificial sequence
  SiRNA target sequence
atgtttcaatgcaaattaatt

SEQ ID NO: 50937 - DNA, 21 bp, Artificial sequence
  SiRNA target sequence
tgtttcaatgcaaattaattt

SEQ ID NO: 50938 - DNA, 21 bp, Artificial sequence
  SiRNA target sequence
gtttcaatgcaaattaattta

SEQ ID NO: 50939 - DNA, 21 bp, Artificial sequence
  SiRNA target sequence
tttcaatgcaaattaatttaa

SEQ ID NO: 50940 - DNA, 21 bp, Artificial sequence
  SiRNA target sequence
ttcaatgcaaattaatttaag

SEQ ID NO: 50941 - DNA, 21 bp, Artificial sequence
  SiRNA target sequence
tcaatgcaaattaatttaagt

SEQ ID NO: 50942 - DNA, 21 bp, Artificial sequence
  SiRNA target sequence
caatgcaaattaatttaagta

SEQ ID NO: 50943 - DNA, 21 bp, Artificial sequence
  SiRNA target sequence
aatgcaaattaatttaagtaa

SEQ ID NO: 50944 - DNA, 21 bp, Artificial sequence
  SiRNA target sequence
atgcaaattaatttaagtaac

SEQ ID NO: 50945 - DNA, 21 bp, Artificial sequence
  SiRNA target sequence
tgcaaattaatttaagtaaca

SEQ ID NO: 50946 - DNA, 21 bp, Artificial sequence
  SiRNA target sequence
gcaaattaatttaagtaacaa

SEQ ID NO: 50947 - DNA, 21 bp, Artificial sequence
  SiRNA target sequence
caaattaatttaagtaacaag

SEQ ID NO: 50948 - DNA, 21 bp, Artificial sequence
  SiRNA target sequence
aaattaatttaagtaacaaga

SEQ ID NO: 50949 - DNA, 21 bp, Artificial sequence
  SiRNA target sequence
aattaatttaagtaacaagac

SEQ ID NO: 50950 - DNA, 21 bp, Artificial sequence
  SiRNA target sequence
attaatttaagtaacaagact

SEQ ID NO: 50951 - DNA, 21 bp, Artificial sequence
  SiRNA target sequence
ttaatttaagtaacaagactg

SEQ ID NO: 50952 - DNA, 21 bp, Artificial sequence
  SiRNA target sequence
taatttaagtaacaagactga

SEQ ID NO: 50953 - DNA, 21 bp, Artificial sequence
  SiRNA target sequence
aatttaagtaacaagactgac

SEQ ID NO: 50954 - DNA, 21 bp, Artificial sequence
  SiRNA target sequence
atttaagtaacaagactgacg

SEQ ID NO: 50955 - DNA, 21 bp, Artificial sequence
  SiRNA target sequence
tttaagtaacaagactgacga

SEQ ID NO: 50956 - DNA, 21 bp, Artificial sequence
  SiRNA target sequence
ttaagtaacaagactgacgaa

SEQ ID NO: 50957 - DNA, 21 bp, Artificial sequence
  SiRNA target sequence
taagtaacaagactgacgaaa

SEQ ID NO: 50958 - DNA, 21 bp, Artificial sequence
  SiRNA target sequence
aagtaacaagactgacgaaaa

SEQ ID NO: 50959 - DNA, 21 bp, Artificial sequence
  SiRNA target sequence
agtaacaagactgacgaaaac

SEQ ID NO: 50960 - DNA, 21 bp, Artificial sequence
  SiRNA target sequence
gtaacaagactgacgaaaaca

SEQ ID NO: 50961 - DNA, 21 bp, Artificial sequence
  SiRNA target sequence
taacaagactgacgaaaacac

SEQ ID NO: 50962 - DNA, 21 bp, Artificial sequence
  SiRNA target sequence
aacaagactgacgaaaacaca

SEQ ID NO: 50963 - DNA, 21 bp, Artificial sequence
  SiRNA target sequence
acaagactgacgaaaacacaa

SEQ ID NO: 50964 - DNA, 21 bp, Artificial sequence
  SiRNA target sequence
caagactgacgaaaacacaat

SEQ ID NO: 50965 - DNA, 21 bp, Artificial sequence
  SiRNA target sequence
aagactgacgaaaacacaatc

SEQ ID NO: 50966 - DNA, 21 bp, Artificial sequence
  SiRNA target sequence
agactgacgaaaacacaatct

SEQ ID NO: 50967 - DNA, 21 bp, Artificial sequence
  SiRNA target sequence
gactgacgaaaacacaatctc

SEQ ID NO: 50968 - DNA, 21 bp, Artificial sequence
  SiRNA target sequence
actgacgaaaacacaatctct

SEQ ID NO: 50969 - DNA, 21 bp, Artificial sequence
  SiRNA target sequence
ctgacgaaaacacaatctctt

SEQ ID NO: 50970 - DNA, 21 bp, Artificial sequence
  SiRNA target sequence
tgacgaaaacacaatctcttt

SEQ ID NO: 50971 - DNA, 21 bp, Artificial sequence
  SiRNA target sequence
gacgaaaacacaatctctttc

SEQ ID NO: 50972 - DNA, 21 bp, Artificial sequence
  SiRNA target sequence
acgaaaacacaatctctttct

SEQ ID NO: 50973 - DNA, 21 bp, Artificial sequence
  SiRNA target sequence
cgaaaacacaatctctttctt

SEQ ID NO: 50974 - DNA, 21 bp, Artificial sequence
  SiRNA target sequence
gaaaacacaatctctttcttt

SEQ ID NO: 50975 - DNA, 21 bp, Artificial sequence
  SiRNA target sequence
aaaacacaatctctttctttg

SEQ ID NO: 50976 - DNA, 21 bp, Artificial sequence
  SiRNA target sequence
aaacacaatctctttctttga

SEQ ID NO: 50977 - DNA, 21 bp, Artificial sequence
  SiRNA target sequence
aacacaatctctttctttgac

SEQ ID NO: 50978 - DNA, 21 bp, Artificial sequence
  SiRNA target sequence
acacaatctctttctttgact

SEQ ID NO: 50979 - DNA, 21 bp, Artificial sequence
  SiRNA target sequence
cacaatctctttctttgactc

SEQ ID NO: 50980 - DNA, 21 bp, Artificial sequence
  SiRNA target sequence
acaatctctttctttgactca

SEQ ID NO: 50981 - DNA, 21 bp, Artificial sequence
  SiRNA target sequence
caatctctttctttgactcag

SEQ ID NO: 50982 - DNA, 21 bp, Artificial sequence
  SiRNA target sequence
aatctctttctttgactcagg

SEQ ID NO: 50983 - DNA, 21 bp, Artificial sequence
  SiRNA target sequence
atctctttctttgactcaggc

SEQ ID NO: 50984 - DNA, 21 bp, Artificial sequence
  SiRNA target sequence
tctctttctttgactcaggcg

SEQ ID NO: 50985 - DNA, 21 bp, Artificial sequence
  SiRNA target sequence
ctctttctttgactcaggcga

SEQ ID NO: 50986 - DNA, 21 bp, Artificial sequence
  SiRNA target sequence
tctttctttgactcaggcgac

SEQ ID NO: 50987 - DNA, 21 bp, Artificial sequence
  SiRNA target sequence
ctttctttgactcaggcgacc

SEQ ID NO: 50988 - DNA, 21 bp, Artificial sequence
  SiRNA target sequence
tttctttgactcaggcgaccc

SEQ ID NO: 50989 - DNA, 21 bp, Artificial sequence
  SiRNA target sequence
ttctttgactcaggcgaccca

SEQ ID NO: 50990 - DNA, 21 bp, Artificial sequence
  SiRNA target sequence
tctttgactcaggcgacccag

SEQ ID NO: 50991 - DNA, 21 bp, Artificial sequence
  SiRNA target sequence
ctttgactcaggcgacccaga

SEQ ID NO: 50992 - DNA, 21 bp, Artificial sequence
  SiRNA target sequence
tttgactcaggcgacccagaa

SEQ ID NO: 50993 - DNA, 21 bp, Artificial sequence
  SiRNA target sequence
ttgactcaggcgacccagaac

SEQ ID NO: 50994 - DNA, 21 bp, Artificial sequence
  SiRNA target sequence
tgactcaggcgacccagaacg

SEQ ID NO: 50995 - DNA, 21 bp, Artificial sequence
  SiRNA target sequence
gactcaggcgacccagaacga

SEQ ID NO: 50996 - DNA, 21 bp, Artificial sequence
  SiRNA target sequence
actcaggcgacccagaacgaa

SEQ ID NO: 50997 - DNA, 21 bp, Artificial sequence
  SiRNA target sequence
ctcaggcgacccagaacgaat

SEQ ID NO: 50998 - DNA, 21 bp, Artificial sequence
  SiRNA target sequence
tcaggcgacccagaacgaatg

SEQ ID NO: 50999 - DNA, 21 bp, Artificial sequence
  SiRNA target sequence
caggcgacccagaacgaatga

SEQ ID NO: 51000 - DNA, 21 bp, Artificial sequence
  SiRNA target sequence
aggcgacccagaacgaatgaa

SEQ ID NO: 51001 - DNA, 21 bp, Artificial sequence
  SiRNA target sequence
ggcgacccagaacgaatgaat

SEQ ID NO: 51002 - DNA, 21 bp, Artificial sequence
  SiRNA target sequence
gcgacccagaacgaatgaata

SEQ ID NO: 51003 - DNA, 21 bp, Artificial sequence
  SiRNA target sequence
cgacccagaacgaatgaataa

SEQ ID NO: 51004 - DNA, 21 bp, Artificial sequence
  SiRNA target sequence
gacccagaacgaatgaataat

SEQ ID NO: 51005 - DNA, 21 bp, Artificial sequence
  SiRNA target sequence
acccagaacgaatgaataatg

SEQ ID NO: 51006 - DNA, 21 bp, Artificial sequence
  SiRNA target sequence
cccagaacgaatgaataatga

SEQ ID NO: 51007 - DNA, 21 bp, Artificial sequence
  SiRNA target sequence
ccagaacgaatgaataatgag

SEQ ID NO: 51008 - DNA, 21 bp, Artificial sequence
  SiRNA target sequence
cagaacgaatgaataatgagg

SEQ ID NO: 51009 - DNA, 21 bp, Artificial sequence
  SiRNA target sequence
agaacgaatgaataatgaggc

SEQ ID NO: 51010 - DNA, 21 bp, Artificial sequence
  SiRNA target sequence
gaacgaatgaataatgaggct

SEQ ID NO: 51011 - DNA, 21 bp, Artificial sequence
  SiRNA target sequence
aacgaatgaataatgaggctc

SEQ ID NO: 51012 - DNA, 21 bp, Artificial sequence
  SiRNA target sequence
acgaatgaataatgaggctct

SEQ ID NO: 51013 - DNA, 21 bp, Artificial sequence
  SiRNA target sequence
cgaatgaataatgaggctctc

SEQ ID NO: 51014 - DNA, 21 bp, Artificial sequence
  SiRNA target sequence
gaatgaataatgaggctctca

SEQ ID NO: 51015 - DNA, 21 bp, Artificial sequence
  SiRNA target sequence
aatgaataatgaggctctcat

SEQ ID NO: 51016 - DNA, 21 bp, Artificial sequence
  SiRNA target sequence
atgaataatgaggctctcatg

SEQ ID NO: 51017 - DNA, 21 bp, Artificial sequence
  SiRNA target sequence
tgaataatgaggctctcatga

SEQ ID NO: 51018 - DNA, 21 bp, Artificial sequence
  SiRNA target sequence
gaataatgaggctctcatgag

SEQ ID NO: 51019 - DNA, 21 bp, Artificial sequence
  SiRNA target sequence
aataatgaggctctcatgagg

SEQ ID NO: 51020 - DNA, 21 bp, Artificial sequence
  SiRNA target sequence
ataatgaggctctcatgaggg

SEQ ID NO: 51021 - DNA, 21 bp, Artificial sequence
  SiRNA target sequence
taatgaggctctcatgagggg

SEQ ID NO: 51022 - DNA, 21 bp, Artificial sequence
  SiRNA target sequence
aatgaggctctcatgagggga

SEQ ID NO: 51023 - DNA, 21 bp, Artificial sequence
  SiRNA target sequence
atgaggctctcatgaggggat

SEQ ID NO: 51024 - DNA, 21 bp, Artificial sequence
  SiRNA target sequence
tgaggctctcatgaggggatg

SEQ ID NO: 51025 - DNA, 21 bp, Artificial sequence
  SiRNA target sequence
gaggctctcatgaggggatgt

SEQ ID NO: 51026 - DNA, 21 bp, Artificial sequence
  SiRNA target sequence
aggctctcatgaggggatgtg

SEQ ID NO: 51027 - DNA, 21 bp, Artificial sequence
  SiRNA target sequence
ggctctcatgaggggatgtgg

SEQ ID NO: 51028 - DNA, 21 bp, Artificial sequence
  SiRNA target sequence
gctctcatgaggggatgtggc

SEQ ID NO: 51029 - DNA, 21 bp, Artificial sequence
  SiRNA target sequence
ctctcatgaggggatgtggcg

SEQ ID NO: 51030 - DNA, 21 bp, Artificial sequence
  SiRNA target sequence
tctcatgaggggatgtggcga

SEQ ID NO: 51031 - DNA, 21 bp, Artificial sequence
  SiRNA target sequence
ctcatgaggggatgtggcgaa

SEQ ID NO: 51032 - DNA, 21 bp, Artificial sequence
  SiRNA target sequence
tcatgaggggatgtggcgaac

SEQ ID NO: 51033 - DNA, 21 bp, Artificial sequence
  SiRNA target sequence
catgaggggatgtggcgaaca

SEQ ID NO: 51034 - DNA, 21 bp, Artificial sequence
  SiRNA target sequence
atgaggggatgtggcgaacag

SEQ ID NO: 51035 - DNA, 21 bp, Artificial sequence
  SiRNA target sequence
tgaggggatgtggcgaacaga

SEQ ID NO: 51036 - DNA, 21 bp, Artificial sequence
  SiRNA target sequence
gaggggatgtggcgaacagat

SEQ ID NO: 51037 - DNA, 21 bp, Artificial sequence
  SiRNA target sequence
aggggatgtggcgaacagata

SEQ ID NO: 51038 - DNA, 21 bp, Artificial sequence
  SiRNA target sequence
ggggatgtggcgaacagatag

SEQ ID NO: 51039 - DNA, 21 bp, Artificial sequence
  SiRNA target sequence
gggatgtggcgaacagatagt

SEQ ID NO: 51040 - DNA, 21 bp, Artificial sequence
  SiRNA target sequence
ggatgtggcgaacagatagta

SEQ ID NO: 51041 - DNA, 21 bp, Artificial sequence
  SiRNA target sequence
gatgtggcgaacagatagtaa

SEQ ID NO: 51042 - DNA, 21 bp, Artificial sequence
  SiRNA target sequence
atgtggcgaacagatagtaaa

SEQ ID NO: 51043 - DNA, 21 bp, Artificial sequence
  SiRNA target sequence
tgtggcgaacagatagtaaat

SEQ ID NO: 51044 - DNA, 21 bp, Artificial sequence
  SiRNA target sequence
gtggcgaacagatagtaaatt

SEQ ID NO: 51045 - DNA, 21 bp, Artificial sequence
  SiRNA target sequence
tggcgaacagatagtaaattt

SEQ ID NO: 51046 - DNA, 21 bp, Artificial sequence
  SiRNA target sequence
ggcgaacagatagtaaattta

SEQ ID NO: 51047 - DNA, 21 bp, Artificial sequence
  SiRNA target sequence
gcgaacagatagtaaatttaa

SEQ ID NO: 51048 - DNA, 21 bp, Artificial sequence
  SiRNA target sequence
cgaacagatagtaaatttaag

SEQ ID NO: 51049 - DNA, 21 bp, Artificial sequence
  SiRNA target sequence
gaacagatagtaaatttaaga

SEQ ID NO: 51050 - DNA, 21 bp, Artificial sequence
  SiRNA target sequence
aacagatagtaaatttaagac

SEQ ID NO: 51051 - DNA, 21 bp, Artificial sequence
  SiRNA target sequence
acagatagtaaatttaagacc

SEQ ID NO: 51052 - DNA, 21 bp, Artificial sequence
  SiRNA target sequence
cagatagtaaatttaagaccc

SEQ ID NO: 51053 - DNA, 21 bp, Artificial sequence
  SiRNA target sequence
agatagtaaatttaagaccct

SEQ ID NO: 51054 - DNA, 21 bp, Artificial sequence
  SiRNA target sequence
gatagtaaatttaagaccctt

SEQ ID NO: 51055 - DNA, 21 bp, Artificial sequence
  SiRNA target sequence
atagtaaatttaagaccctta

SEQ ID NO: 51056 - DNA, 21 bp, Artificial sequence
  SiRNA target sequence
tagtaaatttaagacccttac

SEQ ID NO: 51057 - DNA, 21 bp, Artificial sequence
  SiRNA target sequence
agtaaatttaagacccttact

SEQ ID NO: 51058 - DNA, 21 bp, Artificial sequence
  SiRNA target sequence
gtaaatttaagacccttactt

SEQ ID NO: 51059 - DNA, 21 bp, Artificial sequence
  SiRNA target sequence
taaatttaagacccttacttc

SEQ ID NO: 51060 - DNA, 21 bp, Artificial sequence
  SiRNA target sequence
aaatttaagacccttacttcg

SEQ ID NO: 51061 - DNA, 21 bp, Artificial sequence
  SiRNA target sequence
aatttaagacccttacttcgc

SEQ ID NO: 51062 - DNA, 21 bp, Artificial sequence
  SiRNA target sequence
atttaagacccttacttcgca

SEQ ID NO: 51063 - DNA, 21 bp, Artificial sequence
  SiRNA target sequence
tttaagacccttacttcgcac

SEQ ID NO: 51064 - DNA, 21 bp, Artificial sequence
  SiRNA target sequence
ttaagacccttacttcgcaca

SEQ ID NO: 51065 - DNA, 21 bp, Artificial sequence
  SiRNA target sequence
taagacccttacttcgcacat

SEQ ID NO: 51066 - DNA, 21 bp, Artificial sequence
  SiRNA target sequence
aagacccttacttcgcacatt

SEQ ID NO: 51067 - DNA, 21 bp, Artificial sequence
  SiRNA target sequence
agacccttacttcgcacattc

SEQ ID NO: 51068 - DNA, 21 bp, Artificial sequence
  SiRNA target sequence
gacccttacttcgcacattcc

SEQ ID NO: 51069 - DNA, 21 bp, Artificial sequence
  SiRNA target sequence
acccttacttcgcacattccg

SEQ ID NO: 51070 - DNA, 21 bp, Artificial sequence
  SiRNA target sequence
cccttacttcgcacattccga

SEQ ID NO: 51071 - DNA, 21 bp, Artificial sequence
  SiRNA target sequence
ccttacttcgcacattccgaa

SEQ ID NO: 51072 - DNA, 21 bp, Artificial sequence
  SiRNA target sequence
cttacttcgcacattccgaac

SEQ ID NO: 51073 - DNA, 21 bp, Artificial sequence
  SiRNA target sequence
ttacttcgcacattccgaaca

SEQ ID NO: 51074 - DNA, 21 bp, Artificial sequence
  SiRNA target sequence
tacttcgcacattccgaacaa

SEQ ID NO: 51075 - DNA, 21 bp, Artificial sequence
  SiRNA target sequence
acttcgcacattccgaacaat

SEQ ID NO: 51076 - DNA, 21 bp, Artificial sequence
  SiRNA target sequence
cttcgcacattccgaacaata

SEQ ID NO: 51077 - DNA, 21 bp, Artificial sequence
  SiRNA target sequence
ttcgcacattccgaacaataa

SEQ ID NO: 51078 - DNA, 21 bp, Artificial sequence
  SiRNA target sequence
tcgcacattccgaacaataaa

SEQ ID NO: 51079 - DNA, 21 bp, Artificial sequence
  SiRNA target sequence
cgcacattccgaacaataaat

SEQ ID NO: 51080 - DNA, 21 bp, Artificial sequence
  SiRNA target sequence
gcacattccgaacaataaatg

SEQ ID NO: 51081 - DNA, 21 bp, Artificial sequence
  SiRNA target sequence
cacattccgaacaataaatga

SEQ ID NO: 51082 - DNA, 21 bp, Artificial sequence
  SiRNA target sequence
acattccgaacaataaatgat

SEQ ID NO: 51083 - DNA, 21 bp, Artificial sequence
  SiRNA target sequence
cattccgaacaataaatgata

SEQ ID NO: 51084 - DNA, 21 bp, Artificial sequence
  SiRNA target sequence
attccgaacaataaatgataa

SEQ ID NO: 51085 - DNA, 21 bp, Artificial sequence
  SiRNA target sequence
ttccgaacaataaatgataac

SEQ ID NO: 51086 - DNA, 21 bp, Artificial sequence
  SiRNA target sequence
tccgaacaataaatgataact

SEQ ID NO: 51087 - DNA, 21 bp, Artificial sequence
  SiRNA target sequence
ccgaacaataaatgataactg

SEQ ID NO: 51088 - DNA, 21 bp, Artificial sequence
  SiRNA target sequence
cgaacaataaatgataactgg

SEQ ID NO: 51089 - DNA, 21 bp, Artificial sequence
  SiRNA target sequence
gaacaataaatgataactgga

SEQ ID NO: 51090 - DNA, 21 bp, Artificial sequence
  SiRNA target sequence
aacaataaatgataactggag

SEQ ID NO: 51091 - DNA, 21 bp, Artificial sequence
  SiRNA target sequence
acaataaatgataactggagt

SEQ ID NO: 51092 - DNA, 21 bp, Artificial sequence
  SiRNA target sequence
caataaatgataactggagtt

SEQ ID NO: 51093 - DNA, 21 bp, Artificial sequence
  SiRNA target sequence
aataaatgataactggagttt

SEQ ID NO: 51094 - DNA, 21 bp, Artificial sequence
  SiRNA target sequence
ataaatgataactggagtttg

SEQ ID NO: 51095 - DNA, 21 bp, Artificial sequence
  SiRNA target sequence
taaatgataactggagtttgg

SEQ ID NO: 51096 - DNA, 21 bp, Artificial sequence
  SiRNA target sequence
aaatgataactggagtttggc

SEQ ID NO: 51097 - DNA, 21 bp, Artificial sequence
  SiRNA target sequence
aatgataactggagtttggca

SEQ ID NO: 51098 - DNA, 21 bp, Artificial sequence
  SiRNA target sequence
atgataactggagtttggcag

SEQ ID NO: 51099 - DNA, 21 bp, Artificial sequence
  SiRNA target sequence
tgataactggagtttggcagc

SEQ ID NO: 51100 - DNA, 21 bp, Artificial sequence
  SiRNA target sequence
gataactggagtttggcagca

SEQ ID NO: 51101 - DNA, 21 bp, Artificial sequence
  SiRNA target sequence
ataactggagtttggcagcaa

SEQ ID NO: 51102 - DNA, 21 bp, Artificial sequence
  SiRNA target sequence
taactggagtttggcagcaaa

SEQ ID NO: 51103 - DNA, 21 bp, Artificial sequence
  SiRNA target sequence
aactggagtttggcagcaaac

SEQ ID NO: 51104 - DNA, 21 bp, Artificial sequence
  SiRNA target sequence
actggagtttggcagcaaaca

SEQ ID NO: 51105 - DNA, 21 bp, Artificial sequence
  SiRNA target sequence
ctggagtttggcagcaaacac

SEQ ID NO: 51106 - DNA, 21 bp, Artificial sequence
  SiRNA target sequence
tggagtttggcagcaaacacc

SEQ ID NO: 51107 - DNA, 21 bp, Artificial sequence
  SiRNA target sequence
ggagtttggcagcaaacacca

SEQ ID NO: 51108 - DNA, 21 bp, Artificial sequence
  SiRNA target sequence
gagtttggcagcaaacaccaa

SEQ ID NO: 51109 - DNA, 21 bp, Artificial sequence
  SiRNA target sequence
agtttggcagcaaacaccaag

SEQ ID NO: 51110 - DNA, 21 bp, Artificial sequence
  SiRNA target sequence
gtttggcagcaaacaccaaga

SEQ ID NO: 51111 - DNA, 21 bp, Artificial sequence
  SiRNA target sequence
tttggcagcaaacaccaagac

SEQ ID NO: 51112 - DNA, 21 bp, Artificial sequence
  SiRNA target sequence
ttggcagcaaacaccaagaca

SEQ ID NO: 51113 - DNA, 21 bp, Artificial sequence
  SiRNA target sequence
tggcagcaaacaccaagacac

SEQ ID NO: 51114 - DNA, 21 bp, Artificial sequence
  SiRNA target sequence
ggcagcaaacaccaagacacc

SEQ ID NO: 51115 - DNA, 21 bp, Artificial sequence
  SiRNA target sequence
gcagcaaacaccaagacaccg

SEQ ID NO: 51116 - DNA, 21 bp, Artificial sequence
  SiRNA target sequence
cagcaaacaccaagacaccga

SEQ ID NO: 51117 - DNA, 21 bp, Artificial sequence
  SiRNA target sequence
agcaaacaccaagacaccgat

SEQ ID NO: 51118 - DNA, 21 bp, Artificial sequence
  SiRNA target sequence
gcaaacaccaagacaccgatc

SEQ ID NO: 51119 - DNA, 21 bp, Artificial sequence
  SiRNA target sequence
caaacaccaagacaccgatca

SEQ ID NO: 51120 - DNA, 21 bp, Artificial sequence
  SiRNA target sequence
aaacaccaagacaccgatcac

SEQ ID NO: 51121 - DNA, 21 bp, Artificial sequence
  SiRNA target sequence
aacaccaagacaccgatcaca

SEQ ID NO: 51122 - DNA, 21 bp, Artificial sequence
  SiRNA target sequence
acaccaagacaccgatcacag

SEQ ID NO: 51123 - DNA, 21 bp, Artificial sequence
  SiRNA target sequence
caccaagacaccgatcacaga

SEQ ID NO: 51124 - DNA, 21 bp, Artificial sequence
  SiRNA target sequence
accaagacaccgatcacagac

SEQ ID NO: 51125 - DNA, 21 bp, Artificial sequence
  SiRNA target sequence
ccaagacaccgatcacagacc

SEQ ID NO: 51126 - DNA, 21 bp, Artificial sequence
  SiRNA target sequence
caagacaccgatcacagacct

SEQ ID NO: 51127 - DNA, 21 bp, Artificial sequence
  SiRNA target sequence
aagacaccgatcacagaccta

SEQ ID NO: 51128 - DNA, 21 bp, Artificial sequence
  SiRNA target sequence
agacaccgatcacagacctaa

SEQ ID NO: 51129 - DNA, 21 bp, Artificial sequence
  SiRNA target sequence
gacaccgatcacagacctaac

SEQ ID NO: 51130 - DNA, 21 bp, Artificial sequence
  SiRNA target sequence
acaccgatcacagacctaaca

SEQ ID NO: 51131 - DNA, 21 bp, Artificial sequence
  SiRNA target sequence
caccgatcacagacctaacaa

SEQ ID NO: 51132 - DNA, 21 bp, Artificial sequence
  SiRNA target sequence
accgatcacagacctaacaaa

SEQ ID NO: 51133 - DNA, 21 bp, Artificial sequence
  SiRNA target sequence
ccgatcacagacctaacaaac

SEQ ID NO: 51134 - DNA, 21 bp, Artificial sequence
  SiRNA target sequence
cgatcacagacctaacaaaca

SEQ ID NO: 51135 - DNA, 21 bp, Artificial sequence
  SiRNA target sequence
gatcacagacctaacaaacac

SEQ ID NO: 51136 - DNA, 21 bp, Artificial sequence
  SiRNA target sequence
atcacagacctaacaaacacc

SEQ ID NO: 51137 - DNA, 21 bp, Artificial sequence
  SiRNA target sequence
tcacagacctaacaaacaccg

SEQ ID NO: 51138 - DNA, 21 bp, Artificial sequence
  SiRNA target sequence
cacagacctaacaaacaccgc

SEQ ID NO: 51139 - DNA, 21 bp, Artificial sequence
  SiRNA target sequence
acagacctaacaaacaccgca

SEQ ID NO: 51140 - DNA, 21 bp, Artificial sequence
  SiRNA target sequence
cagacctaacaaacaccgcag

SEQ ID NO: 51141 - DNA, 21 bp, Artificial sequence
  SiRNA target sequence
agacctaacaaacaccgcaga

SEQ ID NO: 51142 - DNA, 21 bp, Artificial sequence
  SiRNA target sequence
gacctaacaaacaccgcagat

SEQ ID NO: 51143 - DNA, 21 bp, Artificial sequence
  SiRNA target sequence
acctaacaaacaccgcagatg

SEQ ID NO: 51144 - DNA, 21 bp, Artificial sequence
  SiRNA target sequence
cctaacaaacaccgcagatgc

SEQ ID NO: 51145 - DNA, 21 bp, Artificial sequence
  SiRNA target sequence
ctaacaaacaccgcagatgct

SEQ ID NO: 51146 - DNA, 21 bp, Artificial sequence
  SiRNA target sequence
taacaaacaccgcagatgctg

SEQ ID NO: 51147 - DNA, 21 bp, Artificial sequence
  SiRNA target sequence
aacaaacaccgcagatgctga

SEQ ID NO: 51148 - DNA, 21 bp, Artificial sequence
  SiRNA target sequence
acaaacaccgcagatgctgaa

SEQ ID NO: 51149 - DNA, 21 bp, Artificial sequence
  SiRNA target sequence
caaacaccgcagatgctgaag

SEQ ID NO: 51150 - DNA, 21 bp, Artificial sequence
  SiRNA target sequence
aaacaccgcagatgctgaagg

SEQ ID NO: 51151 - DNA, 21 bp, Artificial sequence
  SiRNA target sequence
aacaccgcagatgctgaaggc

SEQ ID NO: 51152 - DNA, 21 bp, Artificial sequence
  SiRNA target sequence
acaccgcagatgctgaaggcc

SEQ ID NO: 51153 - DNA, 21 bp, Artificial sequence
  SiRNA target sequence
caccgcagatgctgaaggccg

SEQ ID NO: 51154 - DNA, 21 bp, Artificial sequence
  SiRNA target sequence
accgcagatgctgaaggccga

SEQ ID NO: 51155 - DNA, 21 bp, Artificial sequence
  SiRNA target sequence
ccgcagatgctgaaggccgag

SEQ ID NO: 51156 - DNA, 21 bp, Artificial sequence
  SiRNA target sequence
cgcagatgctgaaggccgaga

SEQ ID NO: 51157 - DNA, 21 bp, Artificial sequence
  SiRNA target sequence
gcagatgctgaaggccgagac

SEQ ID NO: 51158 - DNA, 21 bp, Artificial sequence
  SiRNA target sequence
cagatgctgaaggccgagact

SEQ ID NO: 51159 - DNA, 21 bp, Artificial sequence
  SiRNA target sequence
agatgctgaaggccgagacta

SEQ ID NO: 51160 - DNA, 21 bp, Artificial sequence
  SiRNA target sequence
gatgctgaaggccgagactat

SEQ ID NO: 51161 - DNA, 21 bp, Artificial sequence
  SiRNA target sequence
atgctgaaggccgagactata

SEQ ID NO: 51162 - DNA, 21 bp, Artificial sequence
  SiRNA target sequence
tgctgaaggccgagactatat

SEQ ID NO: 51163 - DNA, 21 bp, Artificial sequence
  SiRNA target sequence
gctgaaggccgagactatatg

SEQ ID NO: 51164 - DNA, 21 bp, Artificial sequence
  SiRNA target sequence
ctgaaggccgagactatatgt

SEQ ID NO: 51165 - DNA, 21 bp, Artificial sequence
  SiRNA target sequence
tgaaggccgagactatatgtc

SEQ ID NO: 51166 - DNA, 21 bp, Artificial sequence
  SiRNA target sequence
gaaggccgagactatatgtct

SEQ ID NO: 51167 - DNA, 21 bp, Artificial sequence
  SiRNA target sequence
aaggccgagactatatgtctt

SEQ ID NO: 51168 - DNA, 21 bp, Artificial sequence
  SiRNA target sequence
aggccgagactatatgtctta

SEQ ID NO: 51169 - DNA, 21 bp, Artificial sequence
  SiRNA target sequence
ggccgagactatatgtcttat

SEQ ID NO: 51170 - DNA, 21 bp, Artificial sequence
  SiRNA target sequence
gccgagactatatgtcttatc

SEQ ID NO: 51171 - DNA, 21 bp, Artificial sequence
  SiRNA target sequence
ccgagactatatgtcttatct

SEQ ID NO: 51172 - DNA, 21 bp, Artificial sequence
  SiRNA target sequence
cgagactatatgtcttatctt

SEQ ID NO: 51173 - DNA, 21 bp, Artificial sequence
  SiRNA target sequence
gagactatatgtcttatcttt

SEQ ID NO: 51174 - DNA, 21 bp, Artificial sequence
  SiRNA target sequence
agactatatgtcttatctttc

SEQ ID NO: 51175 - DNA, 21 bp, Artificial sequence
  SiRNA target sequence
gactatatgtcttatctttct

SEQ ID NO: 51176 - DNA, 21 bp, Artificial sequence
  SiRNA target sequence
actatatgtcttatctttctt

SEQ ID NO: 51177 - DNA, 21 bp, Artificial sequence
  SiRNA target sequence
ctatatgtcttatctttcttt

SEQ ID NO: 51178 - DNA, 21 bp, Artificial sequence
  SiRNA target sequence
tatatgtcttatctttctttt

SEQ ID NO: 51179 - DNA, 21 bp, Artificial sequence
  SiRNA target sequence
atatgtcttatctttcttttc

SEQ ID NO: 51180 - DNA, 21 bp, Artificial sequence
  SiRNA target sequence
tatgtcttatctttcttttct

SEQ ID NO: 51181 - DNA, 21 bp, Artificial sequence
  SiRNA target sequence
atgtcttatctttcttttctt

SEQ ID NO: 51182 - DNA, 21 bp, Artificial sequence
  SiRNA target sequence
tgtcttatctttcttttcttt

SEQ ID NO: 51183 - DNA, 21 bp, Artificial sequence
  SiRNA target sequence
gtcttatctttcttttcttta

SEQ ID NO: 51184 - DNA, 21 bp, Artificial sequence
  SiRNA target sequence
tcttatctttcttttctttat

SEQ ID NO: 51185 - DNA, 21 bp, Artificial sequence
  SiRNA target sequence
cttatctttcttttctttata

SEQ ID NO: 51186 - DNA, 21 bp, Artificial sequence
  SiRNA target sequence
ttatctttcttttctttatag

SEQ ID NO: 51187 - DNA, 21 bp, Artificial sequence
  SiRNA target sequence
tatctttcttttctttataga

SEQ ID NO: 51188 - DNA, 21 bp, Artificial sequence
  SiRNA target sequence
atctttcttttctttatagat

SEQ ID NO: 51189 - DNA, 21 bp, Artificial sequence
  SiRNA target sequence
tctttcttttctttatagatt

SEQ ID NO: 51190 - DNA, 21 bp, Artificial sequence
  SiRNA target sequence
ctttcttttctttatagattt

SEQ ID NO: 51191 - DNA, 21 bp, Artificial sequence
  SiRNA target sequence
tttcttttctttatagatttt

SEQ ID NO: 51192 - DNA, 21 bp, Artificial sequence
  SiRNA target sequence
ttcttttctttatagatttta

SEQ ID NO: 51193 - DNA, 21 bp, Artificial sequence
  SiRNA target sequence
tcttttctttatagattttat

SEQ ID NO: 51194 - DNA, 21 bp, Artificial sequence
  SiRNA target sequence
cttttctttatagattttatc

SEQ ID NO: 51195 - DNA, 21 bp, Artificial sequence
  SiRNA target sequence
ttttctttatagattttatcg

SEQ ID NO: 51196 - DNA, 21 bp, Artificial sequence
  SiRNA target sequence
tttctttatagattttatcga

SEQ ID NO: 51197 - DNA, 21 bp, Artificial sequence
  SiRNA target sequence
ttctttatagattttatcgag

SEQ ID NO: 51198 - DNA, 21 bp, Artificial sequence
  SiRNA target sequence
tctttatagattttatcgagg

SEQ ID NO: 51199 - DNA, 21 bp, Artificial sequence
  SiRNA target sequence
ctttatagattttatcgagga

SEQ ID NO: 51200 - DNA, 21 bp, Artificial sequence
  SiRNA target sequence
tttatagattttatcgaggag

SEQ ID NO: 51201 - DNA, 21 bp, Artificial sequence
  SiRNA target sequence
ttatagattttatcgaggagg

SEQ ID NO: 51202 - DNA, 21 bp, Artificial sequence
  SiRNA target sequence
tatagattttatcgaggaggt

SEQ ID NO: 51203 - DNA, 21 bp, Artificial sequence
  SiRNA target sequence
atagattttatcgaggaggta

SEQ ID NO: 51204 - DNA, 21 bp, Artificial sequence
  SiRNA target sequence
tagattttatcgaggaggtag

SEQ ID NO: 51205 - DNA, 21 bp, Artificial sequence
  SiRNA target sequence
agattttatcgaggaggtaga

SEQ ID NO: 51206 - DNA, 21 bp, Artificial sequence
  SiRNA target sequence
gattttatcgaggaggtagac

SEQ ID NO: 51207 - DNA, 21 bp, Artificial sequence
  SiRNA target sequence
attttatcgaggaggtagacg

SEQ ID NO: 51208 - DNA, 21 bp, Artificial sequence
  SiRNA target sequence
ttttatcgaggaggtagacga

SEQ ID NO: 51209 - DNA, 21 bp, Artificial sequence
  SiRNA target sequence
tttatcgaggaggtagacgat

SEQ ID NO: 51210 - DNA, 21 bp, Artificial sequence
  SiRNA target sequence
ttatcgaggaggtagacgata

SEQ ID NO: 51211 - DNA, 21 bp, Artificial sequence
  SiRNA target sequence
tatcgaggaggtagacgatat

SEQ ID NO: 51212 - DNA, 21 bp, Artificial sequence
  SiRNA target sequence
atcgaggaggtagacgatata

SEQ ID NO: 51213 - DNA, 21 bp, Artificial sequence
  SiRNA target sequence
tcgaggaggtagacgatataa

SEQ ID NO: 51214 - DNA, 21 bp, Artificial sequence
  SiRNA target sequence
cgaggaggtagacgatataaa

SEQ ID NO: 51215 - DNA, 21 bp, Artificial sequence
  SiRNA target sequence
gaggaggtagacgatataaat

SEQ ID NO: 51216 - DNA, 21 bp, Artificial sequence
  SiRNA target sequence
aggaggtagacgatataaatt

SEQ ID NO: 51217 - DNA, 21 bp, Artificial sequence
  SiRNA target sequence
ggaggtagacgatataaattc

SEQ ID NO: 51218 - DNA, 21 bp, Artificial sequence
  SiRNA target sequence
gaggtagacgatataaattct

SEQ ID NO: 51219 - DNA, 21 bp, Artificial sequence
  SiRNA target sequence
aggtagacgatataaattctt

SEQ ID NO: 51220 - DNA, 21 bp, Artificial sequence
  SiRNA target sequence
ggtagacgatataaattcttt

SEQ ID NO: 51221 - DNA, 21 bp, Artificial sequence
  SiRNA target sequence
gtagacgatataaattcttta

SEQ ID NO: 51222 - DNA, 21 bp, Artificial sequence
  SiRNA target sequence
tagacgatataaattctttaa

SEQ ID NO: 51223 - DNA, 21 bp, Artificial sequence
  SiRNA target sequence
agacgatataaattctttaac

SEQ ID NO: 51224 - DNA, 21 bp, Artificial sequence
  SiRNA target sequence
gacgatataaattctttaaca

SEQ ID NO: 51225 - DNA, 21 bp, Artificial sequence
  SiRNA target sequence
acgatataaattctttaacac

SEQ ID NO: 51226 - DNA, 21 bp, Artificial sequence
  SiRNA target sequence
cgatataaattctttaacacg

SEQ ID NO: 51227 - DNA, 21 bp, Artificial sequence
  SiRNA target sequence
gatataaattctttaacacga

SEQ ID NO: 51228 - DNA, 21 bp, Artificial sequence
  SiRNA target sequence
atataaattctttaacacgac

SEQ ID NO: 51229 - DNA, 21 bp, Artificial sequence
  SiRNA target sequence
tataaattctttaacacgacc

SEQ ID NO: 51230 - DNA, 21 bp, Artificial sequence
  SiRNA target sequence
ataaattctttaacacgaccc

SEQ ID NO: 51231 - DNA, 21 bp, Artificial sequence
  SiRNA target sequence
taaattctttaacacgacccc

SEQ ID NO: 51232 - DNA, 21 bp, Artificial sequence
  SiRNA target sequence
aaattctttaacacgaccccc

SEQ ID NO: 51233 - DNA, 21 bp, Artificial sequence
  SiRNA target sequence
aattctttaacacgacccccc

SEQ ID NO: 51234 - DNA, 21 bp, Artificial sequence
  SiRNA target sequence
attctttaacacgacccccct

SEQ ID NO: 51235 - DNA, 21 bp, Artificial sequence
  SiRNA target sequence
ttctttaacacgaccccccta

SEQ ID NO: 51236 - DNA, 21 bp, Artificial sequence
  SiRNA target sequence
tctttaacacgacccccctaa

SEQ ID NO: 51237 - DNA, 21 bp, Artificial sequence
  SiRNA target sequence
ctttaacacgacccccctaaa

SEQ ID NO: 51238 - DNA, 21 bp, Artificial sequence
  SiRNA target sequence
tttaacacgacccccctaaaa

SEQ ID NO: 51239 - DNA, 21 bp, Artificial sequence
  SiRNA target sequence
ttaacacgacccccctaaaac

SEQ ID NO: 51240 - DNA, 21 bp, Artificial sequence
  SiRNA target sequence
taacacgacccccctaaaaca

SEQ ID NO: 51241 - DNA, 21 bp, Artificial sequence
  SiRNA target sequence
aacacgacccccctaaaacaa

SEQ ID NO: 51242 - DNA, 21 bp, Artificial sequence
  SiRNA target sequence
acacgacccccctaaaacaat

SEQ ID NO: 51243 - DNA, 21 bp, Artificial sequence
  SiRNA target sequence
cacgacccccctaaaacaatc

SEQ ID NO: 51244 - DNA, 21 bp, Artificial sequence
  SiRNA target sequence
acgacccccctaaaacaatca

SEQ ID NO: 51245 - DNA, 21 bp, Artificial sequence
  SiRNA target sequence
cgacccccctaaaacaatcac

SEQ ID NO: 51246 - DNA, 21 bp, Artificial sequence
  SiRNA target sequence
gacccccctaaaacaatcaca

SEQ ID NO: 51247 - DNA, 21 bp, Artificial sequence
  SiRNA target sequence
acccccctaaaacaatcacaa

SEQ ID NO: 51248 - DNA, 21 bp, Artificial sequence
  SiRNA target sequence
cccccctaaaacaatcacaaa

SEQ ID NO: 51249 - DNA, 21 bp, Artificial sequence
  SiRNA target sequence
ccccctaaaacaatcacaaac

SEQ ID NO: 51250 - DNA, 21 bp, Artificial sequence
  SiRNA target sequence
cccctaaaacaatcacaaacc

SEQ ID NO: 51251 - DNA, 21 bp, Artificial sequence
  SiRNA target sequence
ccctaaaacaatcacaaacct

SEQ ID NO: 51252 - DNA, 21 bp, Artificial sequence
  SiRNA target sequence
cctaaaacaatcacaaacctg

SEQ ID NO: 51253 - DNA, 21 bp, Artificial sequence
  SiRNA target sequence
ctaaaacaatcacaaacctgt

SEQ ID NO: 51254 - DNA, 21 bp, Artificial sequence
  SiRNA target sequence
taaaacaatcacaaacctgtt

SEQ ID NO: 51255 - DNA, 21 bp, Artificial sequence
  SiRNA target sequence
aaaacaatcacaaacctgtta

SEQ ID NO: 51256 - DNA, 21 bp, Artificial sequence
  SiRNA target sequence
aaacaatcacaaacctgttat

SEQ ID NO: 51257 - DNA, 21 bp, Artificial sequence
  SiRNA target sequence
aacaatcacaaacctgttatg

SEQ ID NO: 51258 - DNA, 21 bp, Artificial sequence
  SiRNA target sequence
acaatcacaaacctgttatgt

SEQ ID NO: 51259 - DNA, 21 bp, Artificial sequence
  SiRNA target sequence
caatcacaaacctgttatgtg

SEQ ID NO: 51260 - DNA, 21 bp, Artificial sequence
  SiRNA target sequence
aatcacaaacctgttatgtga

SEQ ID NO: 51261 - DNA, 21 bp, Artificial sequence
  SiRNA target sequence
atcacaaacctgttatgtgag

SEQ ID NO: 51262 - DNA, 21 bp, Artificial sequence
  SiRNA target sequence
tcacaaacctgttatgtgagg

SEQ ID NO: 51263 - DNA, 21 bp, Artificial sequence
  SiRNA target sequence
cacaaacctgttatgtgagga

SEQ ID NO: 51264 - DNA, 21 bp, Artificial sequence
  SiRNA target sequence
acaaacctgttatgtgaggag

SEQ ID NO: 51265 - DNA, 21 bp, Artificial sequence
  SiRNA target sequence
caaacctgttatgtgaggagt

SEQ ID NO: 51266 - DNA, 21 bp, Artificial sequence
  SiRNA target sequence
aaacctgttatgtgaggagtt

SEQ ID NO: 51267 - DNA, 21 bp, Artificial sequence
  SiRNA target sequence
aacctgttatgtgaggagttt

SEQ ID NO: 51268 - DNA, 21 bp, Artificial sequence
  SiRNA target sequence
acctgttatgtgaggagtttt

SEQ ID NO: 51269 - DNA, 21 bp, Artificial sequence
  SiRNA target sequence
cctgttatgtgaggagttttc

SEQ ID NO: 51270 - DNA, 21 bp, Artificial sequence
  SiRNA target sequence
ctgttatgtgaggagttttct

SEQ ID NO: 51271 - DNA, 21 bp, Artificial sequence
  SiRNA target sequence
tgttatgtgaggagttttcta

SEQ ID NO: 51272 - DNA, 21 bp, Artificial sequence
  SiRNA target sequence
gttatgtgaggagttttctaa

SEQ ID NO: 51273 - DNA, 21 bp, Artificial sequence
  SiRNA target sequence
ttatgtgaggagttttctaat

SEQ ID NO: 51274 - DNA, 21 bp, Artificial sequence
  SiRNA target sequence
tatgtgaggagttttctaatt

SEQ ID NO: 51275 - DNA, 21 bp, Artificial sequence
  SiRNA target sequence
atgtgaggagttttctaattc

SEQ ID NO: 51276 - DNA, 21 bp, Artificial sequence
  SiRNA target sequence
tgtgaggagttttctaattcc

SEQ ID NO: 51277 - DNA, 21 bp, Artificial sequence
  SiRNA target sequence
gtgaggagttttctaattccc

SEQ ID NO: 51278 - DNA, 21 bp, Artificial sequence
  SiRNA target sequence
tgaggagttttctaattcccc

SEQ ID NO: 51279 - DNA, 21 bp, Artificial sequence
  SiRNA target sequence
gaggagttttctaattccccg

SEQ ID NO: 51280 - DNA, 21 bp, Artificial sequence
  SiRNA target sequence
aggagttttctaattccccgt

SEQ ID NO: 51281 - DNA, 21 bp, Artificial sequence
  SiRNA target sequence
ggagttttctaattccccgta

SEQ ID NO: 51282 - DNA, 21 bp, Artificial sequence
  SiRNA target sequence
gagttttctaattccccgtaa

SEQ ID NO: 51283 - DNA, 21 bp, Artificial sequence
  SiRNA target sequence
agttttctaattccccgtaac

SEQ ID NO: 51284 - DNA, 21 bp, Artificial sequence
  SiRNA target sequence
gttttctaattccccgtaact

SEQ ID NO: 51285 - DNA, 21 bp, Artificial sequence
  SiRNA target sequence
ttttctaattccccgtaacta

SEQ ID NO: 51286 - DNA, 21 bp, Artificial sequence
  SiRNA target sequence
tttctaattccccgtaactac

SEQ ID NO: 51287 - DNA, 21 bp, Artificial sequence
  SiRNA target sequence
ttctaattccccgtaactaca

SEQ ID NO: 51288 - DNA, 21 bp, Artificial sequence
  SiRNA target sequence
tctaattccccgtaactacac

SEQ ID NO: 51289 - DNA, 21 bp, Artificial sequence
  SiRNA target sequence
ctaattccccgtaactacaca

SEQ ID NO: 51290 - DNA, 21 bp, Artificial sequence
  SiRNA target sequence
taattccccgtaactacacag

SEQ ID NO: 51291 - DNA, 21 bp, Artificial sequence
  SiRNA target sequence
aattccccgtaactacacagc

SEQ ID NO: 51292 - DNA, 21 bp, Artificial sequence
  SiRNA target sequence
attccccgtaactacacagcc

SEQ ID NO: 51293 - DNA, 21 bp, Artificial sequence
  SiRNA target sequence
ttccccgtaactacacagccg

SEQ ID NO: 51294 - DNA, 21 bp, Artificial sequence
  SiRNA target sequence
tccccgtaactacacagccga

SEQ ID NO: 51295 - DNA, 21 bp, Artificial sequence
  SiRNA target sequence
ccccgtaactacacagccgac

SEQ ID NO: 51296 - DNA, 21 bp, Artificial sequence
  SiRNA target sequence
cccgtaactacacagccgacg

SEQ ID NO: 51297 - DNA, 21 bp, Artificial sequence
  SiRNA target sequence
ccgtaactacacagccgacga

SEQ ID NO: 51298 - DNA, 21 bp, Artificial sequence
  SiRNA target sequence
cgtaactacacagccgacgaa

SEQ ID NO: 51299 - DNA, 21 bp, Artificial sequence
  SiRNA target sequence
gtaactacacagccgacgaaa

SEQ ID NO: 51300 - DNA, 21 bp, Artificial sequence
  SiRNA target sequence
taactacacagccgacgaaat

SEQ ID NO: 51301 - DNA, 21 bp, Artificial sequence
  SiRNA target sequence
aactacacagccgacgaaatt

SEQ ID NO: 51302 - DNA, 21 bp, Artificial sequence
  SiRNA target sequence
actacacagccgacgaaatta

SEQ ID NO: 51303 - DNA, 21 bp, Artificial sequence
  SiRNA target sequence
ctacacagccgacgaaattaa

SEQ ID NO: 51304 - DNA, 21 bp, Artificial sequence
  SiRNA target sequence
tacacagccgacgaaattaac

SEQ ID NO: 51305 - DNA, 21 bp, Artificial sequence
  SiRNA target sequence
acacagccgacgaaattaaca

SEQ ID NO: 51306 - DNA, 21 bp, Artificial sequence
  SiRNA target sequence
cacagccgacgaaattaacac

SEQ ID NO: 51307 - DNA, 21 bp, Artificial sequence
  SiRNA target sequence
acagccgacgaaattaacacc

SEQ ID NO: 51308 - DNA, 21 bp, Artificial sequence
  SiRNA target sequence
cagccgacgaaattaacaccg

SEQ ID NO: 51309 - DNA, 21 bp, Artificial sequence
  SiRNA target sequence
agccgacgaaattaacaccga

SEQ ID NO: 51310 - DNA, 21 bp, Artificial sequence
  SiRNA target sequence
gccgacgaaattaacaccgac

SEQ ID NO: 51311 - DNA, 21 bp, Artificial sequence
  SiRNA target sequence
ccgacgaaattaacaccgacg

SEQ ID NO: 51312 - DNA, 21 bp, Artificial sequence
  SiRNA target sequence
cgacgaaattaacaccgacgg

SEQ ID NO: 51313 - DNA, 21 bp, Artificial sequence
  SiRNA target sequence
gacgaaattaacaccgacgga

SEQ ID NO: 51314 - DNA, 21 bp, Artificial sequence
  SiRNA target sequence
acgaaattaacaccgacggac

SEQ ID NO: 51315 - DNA, 21 bp, Artificial sequence
  SiRNA target sequence
cgaaattaacaccgacggacc

SEQ ID NO: 51316 - DNA, 21 bp, Artificial sequence
  SiRNA target sequence
gaaattaacaccgacggacca

SEQ ID NO: 51317 - DNA, 21 bp, Artificial sequence
  SiRNA target sequence
aaattaacaccgacggaccat

SEQ ID NO: 51318 - DNA, 21 bp, Artificial sequence
  SiRNA target sequence
aattaacaccgacggaccatc

SEQ ID NO: 51319 - DNA, 21 bp, Artificial sequence
  SiRNA target sequence
attaacaccgacggaccatct

SEQ ID NO: 51320 - DNA, 21 bp, Artificial sequence
  SiRNA target sequence
ttaacaccgacggaccatctc

SEQ ID NO: 51321 - DNA, 21 bp, Artificial sequence
  SiRNA target sequence
taacaccgacggaccatctca

SEQ ID NO: 51322 - DNA, 21 bp, Artificial sequence
  SiRNA target sequence
aacaccgacggaccatctcat

SEQ ID NO: 51323 - DNA, 21 bp, Artificial sequence
  SiRNA target sequence
acaccgacggaccatctcata

SEQ ID NO: 51324 - DNA, 21 bp, Artificial sequence
  SiRNA target sequence
caccgacggaccatctcatat

SEQ ID NO: 51325 - DNA, 21 bp, Artificial sequence
  SiRNA target sequence
accgacggaccatctcatatt

SEQ ID NO: 51326 - DNA, 21 bp, Artificial sequence
  SiRNA target sequence
ccgacggaccatctcatatta

SEQ ID NO: 51327 - DNA, 21 bp, Artificial sequence
  SiRNA target sequence
cgacggaccatctcatattac

SEQ ID NO: 51328 - DNA, 21 bp, Artificial sequence
  SiRNA target sequence
gacggaccatctcatattaca

SEQ ID NO: 51329 - DNA, 21 bp, Artificial sequence
  SiRNA target sequence
acggaccatctcatattacat

SEQ ID NO: 51330 - DNA, 21 bp, Artificial sequence
  SiRNA target sequence
cggaccatctcatattacata

SEQ ID NO: 51331 - DNA, 21 bp, Artificial sequence
  SiRNA target sequence
ggaccatctcatattacatac

SEQ ID NO: 51332 - DNA, 21 bp, Artificial sequence
  SiRNA target sequence
gaccatctcatattacatacc

SEQ ID NO: 51333 - DNA, 21 bp, Artificial sequence
  SiRNA target sequence
accatctcatattacataccc

SEQ ID NO: 51334 - DNA, 21 bp, Artificial sequence
  SiRNA target sequence
ccatctcatattacataccca

SEQ ID NO: 51335 - DNA, 21 bp, Artificial sequence
  SiRNA target sequence
catctcatattacatacccag

SEQ ID NO: 51336 - DNA, 21 bp, Artificial sequence
  SiRNA target sequence
atctcatattacatacccagt

SEQ ID NO: 51337 - DNA, 21 bp, Artificial sequence
  SiRNA target sequence
tctcatattacatacccagta

SEQ ID NO: 51338 - DNA, 21 bp, Artificial sequence
  SiRNA target sequence
ctcatattacatacccagtaa

SEQ ID NO: 51339 - DNA, 21 bp, Artificial sequence
  SiRNA target sequence
tcatattacatacccagtaat

SEQ ID NO: 51340 - DNA, 21 bp, Artificial sequence
  SiRNA target sequence
catattacatacccagtaatt

SEQ ID NO: 51341 - DNA, 21 bp, Artificial sequence
  SiRNA target sequence
atattacatacccagtaatta

SEQ ID NO: 51342 - DNA, 21 bp, Artificial sequence
  SiRNA target sequence
tattacatacccagtaattaa

SEQ ID NO: 51343 - DNA, 21 bp, Artificial sequence
  SiRNA target sequence
attacatacccagtaattaac

SEQ ID NO: 51344 - DNA, 21 bp, Artificial sequence
  SiRNA target sequence
ttacatacccagtaattaacc

SEQ ID NO: 51345 - DNA, 21 bp, Artificial sequence
  SiRNA target sequence
tacatacccagtaattaaccc

SEQ ID NO: 51346 - DNA, 21 bp, Artificial sequence
  SiRNA target sequence
acatacccagtaattaaccca

SEQ ID NO: 51347 - DNA, 21 bp, Artificial sequence
  SiRNA target sequence
catacccagtaattaacccag

SEQ ID NO: 51348 - DNA, 21 bp, Artificial sequence
  SiRNA target sequence
atacccagtaattaacccagt

SEQ ID NO: 51349 - DNA, 21 bp, Artificial sequence
  SiRNA target sequence
tacccagtaattaacccagta

SEQ ID NO: 51350 - DNA, 21 bp, Artificial sequence
  SiRNA target sequence
acccagtaattaacccagtac

SEQ ID NO: 51351 - DNA, 21 bp, Artificial sequence
  SiRNA target sequence
cccagtaattaacccagtaca

SEQ ID NO: 51352 - DNA, 21 bp, Artificial sequence
  SiRNA target sequence
ccagtaattaacccagtacat

SEQ ID NO: 51353 - DNA, 21 bp, Artificial sequence
  SiRNA target sequence
cagtaattaacccagtacatg

SEQ ID NO: 51354 - DNA, 21 bp, Artificial sequence
  SiRNA target sequence
agtaattaacccagtacatga

SEQ ID NO: 51355 - DNA, 21 bp, Artificial sequence
  SiRNA target sequence
gtaattaacccagtacatgaa

SEQ ID NO: 51356 - DNA, 21 bp, Artificial sequence
  SiRNA target sequence
taattaacccagtacatgaag

SEQ ID NO: 51357 - DNA, 21 bp, Artificial sequence
  SiRNA target sequence
aattaacccagtacatgaagt

SEQ ID NO: 51358 - DNA, 21 bp, Artificial sequence
  SiRNA target sequence
attaacccagtacatgaagta

SEQ ID NO: 51359 - DNA, 21 bp, Artificial sequence
  SiRNA target sequence
ttaacccagtacatgaagtag

SEQ ID NO: 51360 - DNA, 21 bp, Artificial sequence
  SiRNA target sequence
taacccagtacatgaagtaga

SEQ ID NO: 51361 - DNA, 21 bp, Artificial sequence
  SiRNA target sequence
aacccagtacatgaagtagaa

SEQ ID NO: 51362 - DNA, 21 bp, Artificial sequence
  SiRNA target sequence
acccagtacatgaagtagaag

SEQ ID NO: 51363 - DNA, 21 bp, Artificial sequence
  SiRNA target sequence
cccagtacatgaagtagaagt

SEQ ID NO: 51364 - DNA, 21 bp, Artificial sequence
  SiRNA target sequence
ccagtacatgaagtagaagtt

SEQ ID NO: 51365 - DNA, 21 bp, Artificial sequence
  SiRNA target sequence
cagtacatgaagtagaagttc

SEQ ID NO: 51366 - DNA, 21 bp, Artificial sequence
  SiRNA target sequence
agtacatgaagtagaagttcc

SEQ ID NO: 51367 - DNA, 21 bp, Artificial sequence
  SiRNA target sequence
gtacatgaagtagaagttccc

SEQ ID NO: 51368 - DNA, 21 bp, Artificial sequence
  SiRNA target sequence
tacatgaagtagaagttccct

SEQ ID NO: 51369 - DNA, 21 bp, Artificial sequence
  SiRNA target sequence
acatgaagtagaagttccctt

SEQ ID NO: 51370 - DNA, 21 bp, Artificial sequence
  SiRNA target sequence
catgaagtagaagttcccttc

SEQ ID NO: 51371 - DNA, 21 bp, Artificial sequence
  SiRNA target sequence
atgaagtagaagttcccttct

SEQ ID NO: 51372 - DNA, 21 bp, Artificial sequence
  SiRNA target sequence
tgaagtagaagttcccttcta

SEQ ID NO: 51373 - DNA, 21 bp, Artificial sequence
  SiRNA target sequence
gaagtagaagttcccttctac

SEQ ID NO: 51374 - DNA, 21 bp, Artificial sequence
  SiRNA target sequence
aagtagaagttcccttctact

SEQ ID NO: 51375 - DNA, 21 bp, Artificial sequence
  SiRNA target sequence
agtagaagttcccttctactc

SEQ ID NO: 51376 - DNA, 21 bp, Artificial sequence
  SiRNA target sequence
gtagaagttcccttctactct

SEQ ID NO: 51377 - DNA, 21 bp, Artificial sequence
  SiRNA target sequence
tagaagttcccttctactctc

SEQ ID NO: 51378 - DNA, 21 bp, Artificial sequence
  SiRNA target sequence
agaagttcccttctactctca

SEQ ID NO: 51379 - DNA, 21 bp, Artificial sequence
  SiRNA target sequence
gaagttcccttctactctcag

SEQ ID NO: 51380 - DNA, 21 bp, Artificial sequence
  SiRNA target sequence
aagttcccttctactctcagt

SEQ ID NO: 51381 - DNA, 21 bp, Artificial sequence
  SiRNA target sequence
agttcccttctactctcagta

SEQ ID NO: 51382 - DNA, 21 bp, Artificial sequence
  SiRNA target sequence
gttcccttctactctcagtac

SEQ ID NO: 51383 - DNA, 21 bp, Artificial sequence
  SiRNA target sequence
ttcccttctactctcagtacc

SEQ ID NO: 51384 - DNA, 21 bp, Artificial sequence
  SiRNA target sequence
tcccttctactctcagtaccg

SEQ ID NO: 51385 - DNA, 21 bp, Artificial sequence
  SiRNA target sequence
cccttctactctcagtaccgc

SEQ ID NO: 51386 - DNA, 21 bp, Artificial sequence
  SiRNA target sequence
ccttctactctcagtaccgca

SEQ ID NO: 51387 - DNA, 21 bp, Artificial sequence
  SiRNA target sequence
cttctactctcagtaccgcaa

SEQ ID NO: 51388 - DNA, 21 bp, Artificial sequence
  SiRNA target sequence
ttctactctcagtaccgcaaa

SEQ ID NO: 51389 - DNA, 21 bp, Artificial sequence
  SiRNA target sequence
tctactctcagtaccgcaaaa

SEQ ID NO: 51390 - DNA, 21 bp, Artificial sequence
  SiRNA target sequence
ctactctcagtaccgcaaaat

SEQ ID NO: 51391 - DNA, 21 bp, Artificial sequence
  SiRNA target sequence
tactctcagtaccgcaaaatt

SEQ ID NO: 51392 - DNA, 21 bp, Artificial sequence
  SiRNA target sequence
actctcagtaccgcaaaattc

SEQ ID NO: 51393 - DNA, 21 bp, Artificial sequence
  SiRNA target sequence
ctctcagtaccgcaaaattcc

SEQ ID NO: 51394 - DNA, 21 bp, Artificial sequence
  SiRNA target sequence
tctcagtaccgcaaaattcct

SEQ ID NO: 51395 - DNA, 21 bp, Artificial sequence
  SiRNA target sequence
ctcagtaccgcaaaattccta

SEQ ID NO: 51396 - DNA, 21 bp, Artificial sequence
  SiRNA target sequence
tcagtaccgcaaaattcctat

SEQ ID NO: 51397 - DNA, 21 bp, Artificial sequence
  SiRNA target sequence
cagtaccgcaaaattcctatc

SEQ ID NO: 51398 - DNA, 21 bp, Artificial sequence
  SiRNA target sequence
agtaccgcaaaattcctatcg

SEQ ID NO: 51399 - DNA, 21 bp, Artificial sequence
  SiRNA target sequence
gtaccgcaaaattcctatcgc

SEQ ID NO: 51400 - DNA, 21 bp, Artificial sequence
  SiRNA target sequence
taccgcaaaattcctatcgct

SEQ ID NO: 51401 - DNA, 21 bp, Artificial sequence
  SiRNA target sequence
accgcaaaattcctatcgctt

SEQ ID NO: 51402 - DNA, 21 bp, Artificial sequence
  SiRNA target sequence
ccgcaaaattcctatcgcttc

SEQ ID NO: 51403 - DNA, 21 bp, Artificial sequence
  SiRNA target sequence
cgcaaaattcctatcgcttca

SEQ ID NO: 51404 - DNA, 21 bp, Artificial sequence
  SiRNA target sequence
gcaaaattcctatcgcttcaa

SEQ ID NO: 51405 - DNA, 21 bp, Artificial sequence
  SiRNA target sequence
caaaattcctatcgcttcaac

SEQ ID NO: 51406 - DNA, 21 bp, Artificial sequence
  SiRNA target sequence
aaaattcctatcgcttcaaca

SEQ ID NO: 51407 - DNA, 21 bp, Artificial sequence
  SiRNA target sequence
aaattcctatcgcttcaacat

SEQ ID NO: 51408 - DNA, 21 bp, Artificial sequence
  SiRNA target sequence
aattcctatcgcttcaacatc

SEQ ID NO: 51409 - DNA, 21 bp, Artificial sequence
  SiRNA target sequence
attcctatcgcttcaacatca

SEQ ID NO: 51410 - DNA, 21 bp, Artificial sequence
  SiRNA target sequence
ttcctatcgcttcaacatcag

SEQ ID NO: 51411 - DNA, 21 bp, Artificial sequence
  SiRNA target sequence
tcctatcgcttcaacatcaga

SEQ ID NO: 51412 - DNA, 21 bp, Artificial sequence
  SiRNA target sequence
cctatcgcttcaacatcagac

SEQ ID NO: 51413 - DNA, 21 bp, Artificial sequence
  SiRNA target sequence
ctatcgcttcaacatcagaca

SEQ ID NO: 51414 - DNA, 21 bp, Artificial sequence
  SiRNA target sequence
tatcgcttcaacatcagacaa

SEQ ID NO: 51415 - DNA, 21 bp, Artificial sequence
  SiRNA target sequence
atcgcttcaacatcagacaaa

SEQ ID NO: 51416 - DNA, 21 bp, Artificial sequence
  SiRNA target sequence
tcgcttcaacatcagacaaag

SEQ ID NO: 51417 - DNA, 21 bp, Artificial sequence
  SiRNA target sequence
cgcttcaacatcagacaaagg

SEQ ID NO: 51418 - DNA, 21 bp, Artificial sequence
  SiRNA target sequence
gcttcaacatcagacaaagga

SEQ ID NO: 51419 - DNA, 21 bp, Artificial sequence
  SiRNA target sequence
cttcaacatcagacaaaggat

SEQ ID NO: 51420 - DNA, 21 bp, Artificial sequence
  SiRNA target sequence
ttcaacatcagacaaaggata

SEQ ID NO: 51421 - DNA, 21 bp, Artificial sequence
  SiRNA target sequence
tcaacatcagacaaaggatac

SEQ ID NO: 51422 - DNA, 21 bp, Artificial sequence
  SiRNA target sequence
caacatcagacaaaggatacg

SEQ ID NO: 51423 - DNA, 21 bp, Artificial sequence
  SiRNA target sequence
aacatcagacaaaggatacga

SEQ ID NO: 51424 - DNA, 21 bp, Artificial sequence
  SiRNA target sequence
acatcagacaaaggatacgat

SEQ ID NO: 51425 - DNA, 21 bp, Artificial sequence
  SiRNA target sequence
catcagacaaaggatacgatt

SEQ ID NO: 51426 - DNA, 21 bp, Artificial sequence
  SiRNA target sequence
atcagacaaaggatacgattc

SEQ ID NO: 51427 - DNA, 21 bp, Artificial sequence
  SiRNA target sequence
tcagacaaaggatacgattca

SEQ ID NO: 51428 - DNA, 21 bp, Artificial sequence
  SiRNA target sequence
cagacaaaggatacgattcat

SEQ ID NO: 51429 - DNA, 21 bp, Artificial sequence
  SiRNA target sequence
agacaaaggatacgattcatc

SEQ ID NO: 51430 - DNA, 21 bp, Artificial sequence
  SiRNA target sequence
gacaaaggatacgattcatcc

SEQ ID NO: 51431 - DNA, 21 bp, Artificial sequence
  SiRNA target sequence
acaaaggatacgattcatccc

SEQ ID NO: 51432 - DNA, 21 bp, Artificial sequence
  SiRNA target sequence
caaaggatacgattcatccct

SEQ ID NO: 51433 - DNA, 21 bp, Artificial sequence
  SiRNA target sequence
aaaggatacgattcatccctc

SEQ ID NO: 51434 - DNA, 21 bp, Artificial sequence
  SiRNA target sequence
aaggatacgattcatccctca

SEQ ID NO: 51435 - DNA, 21 bp, Artificial sequence
  SiRNA target sequence
aggatacgattcatccctcat

SEQ ID NO: 51436 - DNA, 21 bp, Artificial sequence
  SiRNA target sequence
ggatacgattcatccctcatg

SEQ ID NO: 51437 - DNA, 21 bp, Artificial sequence
  SiRNA target sequence
gatacgattcatccctcatgt

SEQ ID NO: 51438 - DNA, 21 bp, Artificial sequence
  SiRNA target sequence
atacgattcatccctcatgta

SEQ ID NO: 51439 - DNA, 21 bp, Artificial sequence
  SiRNA target sequence
tacgattcatccctcatgtat

SEQ ID NO: 51440 - DNA, 21 bp, Artificial sequence
  SiRNA target sequence
acgattcatccctcatgtatt

SEQ ID NO: 51441 - DNA, 21 bp, Artificial sequence
  SiRNA target sequence
cgattcatccctcatgtatta

SEQ ID NO: 51442 - DNA, 21 bp, Artificial sequence
  SiRNA target sequence
gattcatccctcatgtattac

SEQ ID NO: 51443 - DNA, 21 bp, Artificial sequence
  SiRNA target sequence
attcatccctcatgtattaca

SEQ ID NO: 51444 - DNA, 21 bp, Artificial sequence
  SiRNA target sequence
ttcatccctcatgtattacac

SEQ ID NO: 51445 - DNA, 21 bp, Artificial sequence
  SiRNA target sequence
tcatccctcatgtattacaca

SEQ ID NO: 51446 - DNA, 21 bp, Artificial sequence
  SiRNA target sequence
catccctcatgtattacacaa

SEQ ID NO: 51447 - DNA, 21 bp, Artificial sequence
  SiRNA target sequence
atccctcatgtattacacaaa

SEQ ID NO: 51448 - DNA, 21 bp, Artificial sequence
  SiRNA target sequence
tccctcatgtattacacaaat

SEQ ID NO: 51449 - DNA, 21 bp, Artificial sequence
  SiRNA target sequence
ccctcatgtattacacaaatg

SEQ ID NO: 51450 - DNA, 21 bp, Artificial sequence
  SiRNA target sequence
cctcatgtattacacaaatgt

SEQ ID NO: 51451 - DNA, 21 bp, Artificial sequence
  SiRNA target sequence
ctcatgtattacacaaatgtt

SEQ ID NO: 51452 - DNA, 21 bp, Artificial sequence
  SiRNA target sequence
tcatgtattacacaaatgttg

SEQ ID NO: 51453 - DNA, 21 bp, Artificial sequence
  SiRNA target sequence
catgtattacacaaatgttgg

SEQ ID NO: 51454 - DNA, 21 bp, Artificial sequence
  SiRNA target sequence
atgtattacacaaatgttggt

SEQ ID NO: 51455 - DNA, 21 bp, Artificial sequence
  SiRNA target sequence
tgtattacacaaatgttggta

SEQ ID NO: 51456 - DNA, 21 bp, Artificial sequence
  SiRNA target sequence
gtattacacaaatgttggtac

SEQ ID NO: 51457 - DNA, 21 bp, Artificial sequence
  SiRNA target sequence
tattacacaaatgttggtacc

SEQ ID NO: 51458 - DNA, 21 bp, Artificial sequence
  SiRNA target sequence
attacacaaatgttggtaccc

SEQ ID NO: 51459 - DNA, 21 bp, Artificial sequence
  SiRNA target sequence
ttacacaaatgttggtaccca

SEQ ID NO: 51460 - DNA, 21 bp, Artificial sequence
  SiRNA target sequence
tacacaaatgttggtacccaa

SEQ ID NO: 51461 - DNA, 21 bp, Artificial sequence
  SiRNA target sequence
acacaaatgttggtacccaac

SEQ ID NO: 51462 - DNA, 21 bp, Artificial sequence
  SiRNA target sequence
cacaaatgttggtacccaaca

SEQ ID NO: 51463 - DNA, 21 bp, Artificial sequence
  SiRNA target sequence
acaaatgttggtacccaacag

SEQ ID NO: 51464 - DNA, 21 bp, Artificial sequence
  SiRNA target sequence
caaatgttggtacccaacaga

SEQ ID NO: 51465 - DNA, 21 bp, Artificial sequence
  SiRNA target sequence
aaatgttggtacccaacagat

SEQ ID NO: 51466 - DNA, 21 bp, Artificial sequence
  SiRNA target sequence
aatgttggtacccaacagatt

SEQ ID NO: 51467 - DNA, 21 bp, Artificial sequence
  SiRNA target sequence
atgttggtacccaacagattg

SEQ ID NO: 51468 - DNA, 21 bp, Artificial sequence
  SiRNA target sequence
tgttggtacccaacagattgt

SEQ ID NO: 51469 - DNA, 21 bp, Artificial sequence
  SiRNA target sequence
gttggtacccaacagattgta

SEQ ID NO: 51470 - DNA, 21 bp, Artificial sequence
  SiRNA target sequence
ttggtacccaacagattgtag

SEQ ID NO: 51471 - DNA, 21 bp, Artificial sequence
  SiRNA target sequence
tggtacccaacagattgtagc

SEQ ID NO: 51472 - DNA, 21 bp, Artificial sequence
  SiRNA target sequence
ggtacccaacagattgtagca

SEQ ID NO: 51473 - DNA, 21 bp, Artificial sequence
  SiRNA target sequence
gtacccaacagattgtagcac

SEQ ID NO: 51474 - DNA, 21 bp, Artificial sequence
  SiRNA target sequence
tacccaacagattgtagcacg

SEQ ID NO: 51475 - DNA, 21 bp, Artificial sequence
  SiRNA target sequence
acccaacagattgtagcacgt

SEQ ID NO: 51476 - DNA, 21 bp, Artificial sequence
  SiRNA target sequence
cccaacagattgtagcacgtg

SEQ ID NO: 51477 - DNA, 21 bp, Artificial sequence
  SiRNA target sequence
ccaacagattgtagcacgtgc

SEQ ID NO: 51478 - DNA, 21 bp, Artificial sequence
  SiRNA target sequence
caacagattgtagcacgtgcc

SEQ ID NO: 51479 - DNA, 21 bp, Artificial sequence
  SiRNA target sequence
aacagattgtagcacgtgccg

SEQ ID NO: 51480 - DNA, 21 bp, Artificial sequence
  SiRNA target sequence
acagattgtagcacgtgccgg

SEQ ID NO: 51481 - DNA, 21 bp, Artificial sequence
  SiRNA target sequence
cagattgtagcacgtgccggg

SEQ ID NO: 51482 - DNA, 21 bp, Artificial sequence
  SiRNA target sequence
agattgtagcacgtgccggga

SEQ ID NO: 51483 - DNA, 21 bp, Artificial sequence
  SiRNA target sequence
gattgtagcacgtgccgggaa

SEQ ID NO: 51484 - DNA, 21 bp, Artificial sequence
  SiRNA target sequence
attgtagcacgtgccgggaat

SEQ ID NO: 51485 - DNA, 21 bp, Artificial sequence
  SiRNA target sequence
ttgtagcacgtgccgggaatg

SEQ ID NO: 51486 - DNA, 21 bp, Artificial sequence
  SiRNA target sequence
tgtagcacgtgccgggaatga

SEQ ID NO: 51487 - DNA, 21 bp, Artificial sequence
  SiRNA target sequence
gtagcacgtgccgggaatgat

SEQ ID NO: 51488 - DNA, 21 bp, Artificial sequence
  SiRNA target sequence
tagcacgtgccgggaatgatg

SEQ ID NO: 51489 - DNA, 21 bp, Artificial sequence
  SiRNA target sequence
agcacgtgccgggaatgatga

SEQ ID NO: 51490 - DNA, 21 bp, Artificial sequence
  SiRNA target sequence
gcacgtgccgggaatgatgac

SEQ ID NO: 51491 - DNA, 21 bp, Artificial sequence
  SiRNA target sequence
cacgtgccgggaatgatgact

SEQ ID NO: 51492 - DNA, 21 bp, Artificial sequence
  SiRNA target sequence
acgtgccgggaatgatgactt

SEQ ID NO: 51493 - DNA, 21 bp, Artificial sequence
  SiRNA target sequence
cgtgccgggaatgatgacttc

SEQ ID NO: 51494 - DNA, 21 bp, Artificial sequence
  SiRNA target sequence
gtgccgggaatgatgacttca

SEQ ID NO: 51495 - DNA, 21 bp, Artificial sequence
  SiRNA target sequence
tgccgggaatgatgacttcac

SEQ ID NO: 51496 - DNA, 21 bp, Artificial sequence
  SiRNA target sequence
gccgggaatgatgacttcacc

SEQ ID NO: 51497 - DNA, 21 bp, Artificial sequence
  SiRNA target sequence
ccgggaatgatgacttcacct

SEQ ID NO: 51498 - DNA, 21 bp, Artificial sequence
  SiRNA target sequence
cgggaatgatgacttcacctt

SEQ ID NO: 51499 - DNA, 21 bp, Artificial sequence
  SiRNA target sequence
gggaatgatgacttcaccttt

SEQ ID NO: 51500 - DNA, 21 bp, Artificial sequence
  SiRNA target sequence
ggaatgatgacttcacctttg

SEQ ID NO: 51501 - DNA, 21 bp, Artificial sequence
  SiRNA target sequence
gaatgatgacttcacctttgg

SEQ ID NO: 51502 - DNA, 21 bp, Artificial sequence
  SiRNA target sequence
aatgatgacttcacctttggt

SEQ ID NO: 51503 - DNA, 21 bp, Artificial sequence
  SiRNA target sequence
atgatgacttcacctttggtt

SEQ ID NO: 51504 - DNA, 21 bp, Artificial sequence
  SiRNA target sequence
tgatgacttcacctttggttg

SEQ ID NO: 51505 - DNA, 21 bp, Artificial sequence
  SiRNA target sequence
gatgacttcacctttggttgg

SEQ ID NO: 51506 - DNA, 21 bp, Artificial sequence
  SiRNA target sequence
atgacttcacctttggttgga

SEQ ID NO: 51507 - DNA, 21 bp, Artificial sequence
  SiRNA target sequence
tgacttcacctttggttggat

SEQ ID NO: 51508 - DNA, 21 bp, Artificial sequence
  SiRNA target sequence
gacttcacctttggttggatg

SEQ ID NO: 51509 - DNA, 21 bp, Artificial sequence
  SiRNA target sequence
acttcacctttggttggatga

SEQ ID NO: 51510 - DNA, 21 bp, Artificial sequence
  SiRNA target sequence
cttcacctttggttggatgat

SEQ ID NO: 51511 - DNA, 21 bp, Artificial sequence
  SiRNA target sequence
ttcacctttggttggatgata

SEQ ID NO: 51512 - DNA, 21 bp, Artificial sequence
  SiRNA target sequence
tcacctttggttggatgatag

SEQ ID NO: 51513 - DNA, 21 bp, Artificial sequence
  SiRNA target sequence
cacctttggttggatgatagg

SEQ ID NO: 51514 - DNA, 21 bp, Artificial sequence
  SiRNA target sequence
acctttggttggatgataggc

SEQ ID NO: 51515 - DNA, 21 bp, Artificial sequence
  SiRNA target sequence
cctttggttggatgataggca

SEQ ID NO: 51516 - DNA, 21 bp, Artificial sequence
  SiRNA target sequence
ctttggttggatgataggcac

SEQ ID NO: 51517 - DNA, 21 bp, Artificial sequence
  SiRNA target sequence
tttggttggatgataggcact

SEQ ID NO: 51518 - DNA, 21 bp, Artificial sequence
  SiRNA target sequence
ttggttggatgataggcactc

SEQ ID NO: 51519 - DNA, 21 bp, Artificial sequence
  SiRNA target sequence
tggttggatgataggcactcc

SEQ ID NO: 51520 - DNA, 21 bp, Artificial sequence
  SiRNA target sequence
ggttggatgataggcactccg

SEQ ID NO: 51521 - DNA, 21 bp, Artificial sequence
  SiRNA target sequence
gttggatgataggcactccgc

SEQ ID NO: 51522 - DNA, 21 bp, Artificial sequence
  SiRNA target sequence
ttggatgataggcactccgca

SEQ ID NO: 51523 - DNA, 21 bp, Artificial sequence
  SiRNA target sequence
tggatgataggcactccgcaa

SEQ ID NO: 51524 - DNA, 21 bp, Artificial sequence
  SiRNA target sequence
ggatgataggcactccgcaac

SEQ ID NO: 51525 - DNA, 21 bp, Artificial sequence
  SiRNA target sequence
gatgataggcactccgcaact

SEQ ID NO: 51526 - DNA, 21 bp, Artificial sequence
  SiRNA target sequence
atgataggcactccgcaactt

SEQ ID NO: 51527 - DNA, 21 bp, Artificial sequence
  SiRNA target sequence
tgataggcactccgcaacttc

SEQ ID NO: 51528 - DNA, 21 bp, Artificial sequence
  SiRNA target sequence
gataggcactccgcaacttca

SEQ ID NO: 51529 - DNA, 21 bp, Artificial sequence
  SiRNA target sequence
ataggcactccgcaacttcaa

SEQ ID NO: 51530 - DNA, 21 bp, Artificial sequence
  SiRNA target sequence
taggcactccgcaacttcaag

SEQ ID NO: 51531 - DNA, 21 bp, Artificial sequence
  SiRNA target sequence
aggcactccgcaacttcaagg

SEQ ID NO: 51532 - DNA, 21 bp, Artificial sequence
  SiRNA target sequence
ggcactccgcaacttcaaggt

SEQ ID NO: 51533 - DNA, 21 bp, Artificial sequence
  SiRNA target sequence
gcactccgcaacttcaaggta

SEQ ID NO: 51534 - DNA, 21 bp, Artificial sequence
  SiRNA target sequence
cactccgcaacttcaaggtat

SEQ ID NO: 51535 - DNA, 21 bp, Artificial sequence
  SiRNA target sequence
actccgcaacttcaaggtata

SEQ ID NO: 51536 - DNA, 21 bp, Artificial sequence
  SiRNA target sequence
ctccgcaacttcaaggtataa

SEQ ID NO: 51537 - DNA, 21 bp, Artificial sequence
  SiRNA target sequence
tccgcaacttcaaggtataac

SEQ ID NO: 51538 - DNA, 21 bp, Artificial sequence
  SiRNA target sequence
ccgcaacttcaaggtataact

SEQ ID NO: 51539 - DNA, 21 bp, Artificial sequence
  SiRNA target sequence
cgcaacttcaaggtataacta

SEQ ID NO: 51540 - DNA, 21 bp, Artificial sequence
  SiRNA target sequence
gcaacttcaaggtataactaa

SEQ ID NO: 51541 - DNA, 21 bp, Artificial sequence
  SiRNA target sequence
caacttcaaggtataactaaa

SEQ ID NO: 51542 - DNA, 21 bp, Artificial sequence
  SiRNA target sequence
aacttcaaggtataactaaag

SEQ ID NO: 51543 - DNA, 21 bp, Artificial sequence
  SiRNA target sequence
acttcaaggtataactaaaga

SEQ ID NO: 51544 - DNA, 21 bp, Artificial sequence
  SiRNA target sequence
cttcaaggtataactaaagaa

SEQ ID NO: 51545 - DNA, 21 bp, Artificial sequence
  SiRNA target sequence
ttcaaggtataactaaagaag

SEQ ID NO: 51546 - DNA, 21 bp, Artificial sequence
  SiRNA target sequence
tcaaggtataactaaagaagt

SEQ ID NO: 51547 - DNA, 21 bp, Artificial sequence
  SiRNA target sequence
caaggtataactaaagaagtc

SEQ ID NO: 51548 - DNA, 21 bp, Artificial sequence
  SiRNA target sequence
aaggtataactaaagaagtcg

SEQ ID NO: 51549 - DNA, 21 bp, Artificial sequence
  SiRNA target sequence
aggtataactaaagaagtcgc

SEQ ID NO: 51550 - DNA, 21 bp, Artificial sequence
  SiRNA target sequence
ggtataactaaagaagtcgca

SEQ ID NO: 51551 - DNA, 21 bp, Artificial sequence
  SiRNA target sequence
gtataactaaagaagtcgcaa

SEQ ID NO: 51552 - DNA, 21 bp, Artificial sequence
  SiRNA target sequence
tataactaaagaagtcgcaaa

SEQ ID NO: 51553 - DNA, 21 bp, Artificial sequence
  SiRNA target sequence
ataactaaagaagtcgcaaac

SEQ ID NO: 51554 - DNA, 21 bp, Artificial sequence
  SiRNA target sequence
taactaaagaagtcgcaaact

SEQ ID NO: 51555 - DNA, 21 bp, Artificial sequence
  SiRNA target sequence
aactaaagaagtcgcaaacta

SEQ ID NO: 51556 - DNA, 21 bp, Artificial sequence
  SiRNA target sequence
actaaagaagtcgcaaactag

SEQ ID NO: 51557 - DNA, 21 bp, Artificial sequence
  SiRNA target sequence
ctaaagaagtcgcaaactaga

SEQ ID NO: 51558 - DNA, 21 bp, Artificial sequence
  SiRNA target sequence
taaagaagtcgcaaactagat

SEQ ID NO: 51559 - DNA, 21 bp, Artificial sequence
  SiRNA target sequence
aaagaagtcgcaaactagatg

SEQ ID NO: 51560 - DNA, 21 bp, Artificial sequence
  SiRNA target sequence
aagaagtcgcaaactagatgt

SEQ ID NO: 51561 - DNA, 21 bp, Artificial sequence
  SiRNA target sequence
agaagtcgcaaactagatgtg

SEQ ID NO: 51562 - DNA, 21 bp, Artificial sequence
  SiRNA target sequence
gaagtcgcaaactagatgtgc

SEQ ID NO: 51563 - DNA, 21 bp, Artificial sequence
  SiRNA target sequence
aagtcgcaaactagatgtgca

SEQ ID NO: 51564 - DNA, 21 bp, Artificial sequence
  SiRNA target sequence
agtcgcaaactagatgtgcat

SEQ ID NO: 51565 - DNA, 21 bp, Artificial sequence
  SiRNA target sequence
gtcgcaaactagatgtgcatt

SEQ ID NO: 51566 - DNA, 21 bp, Artificial sequence
  SiRNA target sequence
tcgcaaactagatgtgcatta

SEQ ID NO: 51567 - DNA, 21 bp, Artificial sequence
  SiRNA target sequence
cgcaaactagatgtgcattag

SEQ ID NO: 51568 - DNA, 21 bp, Artificial sequence
  SiRNA target sequence
gcaaactagatgtgcattagg

SEQ ID NO: 51569 - DNA, 21 bp, Artificial sequence
  SiRNA target sequence
caaactagatgtgcattagga

SEQ ID NO: 51570 - DNA, 21 bp, Artificial sequence
  SiRNA target sequence
aaactagatgtgcattaggag

SEQ ID NO: 51571 - DNA, 21 bp, Artificial sequence
  SiRNA target sequence
aactagatgtgcattaggaga

SEQ ID NO: 51572 - DNA, 21 bp, Artificial sequence
  SiRNA target sequence
actagatgtgcattaggagac

SEQ ID NO: 51573 - DNA, 21 bp, Artificial sequence
  SiRNA target sequence
ctagatgtgcattaggagaca

SEQ ID NO: 51574 - DNA, 21 bp, Artificial sequence
  SiRNA target sequence
tagatgtgcattaggagacag

SEQ ID NO: 51575 - DNA, 21 bp, Artificial sequence
  SiRNA target sequence
agatgtgcattaggagacagt

SEQ ID NO: 51576 - DNA, 21 bp, Artificial sequence
  SiRNA target sequence
gatgtgcattaggagacagta

SEQ ID NO: 51577 - DNA, 21 bp, Artificial sequence
  SiRNA target sequence
atgtgcattaggagacagtaa

SEQ ID NO: 51578 - DNA, 21 bp, Artificial sequence
  SiRNA target sequence
tgtgcattaggagacagtaaa

SEQ ID NO: 51579 - DNA, 21 bp, Artificial sequence
  SiRNA target sequence
gtgcattaggagacagtaaaa

SEQ ID NO: 51580 - DNA, 21 bp, Artificial sequence
  SiRNA target sequence
tgcattaggagacagtaaaat

SEQ ID NO: 51581 - DNA, 21 bp, Artificial sequence
  SiRNA target sequence
gcattaggagacagtaaaatc

SEQ ID NO: 51582 - DNA, 21 bp, Artificial sequence
  SiRNA target sequence
cattaggagacagtaaaatct

SEQ ID NO: 51583 - DNA, 21 bp, Artificial sequence
  SiRNA target sequence
attaggagacagtaaaatctc

SEQ ID NO: 51584 - DNA, 21 bp, Artificial sequence
  SiRNA target sequence
ttaggagacagtaaaatctcc

SEQ ID NO: 51585 - DNA, 21 bp, Artificial sequence
  SiRNA target sequence
taggagacagtaaaatctcct

SEQ ID NO: 51586 - DNA, 21 bp, Artificial sequence
  SiRNA target sequence
aggagacagtaaaatctcctt

SEQ ID NO: 51587 - DNA, 21 bp, Artificial sequence
  SiRNA target sequence
ggagacagtaaaatctccttt

SEQ ID NO: 51588 - DNA, 21 bp, Artificial sequence
  SiRNA target sequence
gagacagtaaaatctcctttt

SEQ ID NO: 51589 - DNA, 21 bp, Artificial sequence
  SiRNA target sequence
agacagtaaaatctccttttg

SEQ ID NO: 51590 - DNA, 21 bp, Artificial sequence
  SiRNA target sequence
gacagtaaaatctccttttgt

SEQ ID NO: 51591 - DNA, 21 bp, Artificial sequence
  SiRNA target sequence
acagtaaaatctccttttgta

SEQ ID NO: 51592 - DNA, 21 bp, Artificial sequence
  SiRNA target sequence
cagtaaaatctccttttgtat

SEQ ID NO: 51593 - DNA, 21 bp, Artificial sequence
  SiRNA target sequence
agtaaaatctccttttgtatg

SEQ ID NO: 51594 - DNA, 21 bp, Artificial sequence
  SiRNA target sequence
gtaaaatctccttttgtatgg

SEQ ID NO: 51595 - DNA, 21 bp, Artificial sequence
  SiRNA target sequence
taaaatctccttttgtatggc

SEQ ID NO: 51596 - DNA, 21 bp, Artificial sequence
  SiRNA target sequence
aaaatctccttttgtatggct

SEQ ID NO: 51597 - DNA, 21 bp, Artificial sequence
  SiRNA target sequence
aaatctccttttgtatggcta

SEQ ID NO: 51598 - DNA, 21 bp, Artificial sequence
  SiRNA target sequence
aatctccttttgtatggctat

SEQ ID NO: 51599 - DNA, 21 bp, Artificial sequence
  SiRNA target sequence
atctccttttgtatggctatt

SEQ ID NO: 51600 - DNA, 21 bp, Artificial sequence
  SiRNA target sequence
tctccttttgtatggctatta

SEQ ID NO: 51601 - DNA, 21 bp, Artificial sequence
  SiRNA target sequence
ctccttttgtatggctattag

SEQ ID NO: 51602 - DNA, 21 bp, Artificial sequence
  SiRNA target sequence
tccttttgtatggctattagt

SEQ ID NO: 51603 - DNA, 21 bp, Artificial sequence
  SiRNA target sequence
ccttttgtatggctattagtc

SEQ ID NO: 51604 - DNA, 21 bp, Artificial sequence
  SiRNA target sequence
cttttgtatggctattagtct

SEQ ID NO: 51605 - DNA, 21 bp, Artificial sequence
  SiRNA target sequence
ttttgtatggctattagtcta

SEQ ID NO: 51606 - DNA, 21 bp, Artificial sequence
  SiRNA target sequence
tttgtatggctattagtctaa

SEQ ID NO: 51607 - DNA, 21 bp, Artificial sequence
  SiRNA target sequence
ttgtatggctattagtctaaa

SEQ ID NO: 51608 - DNA, 21 bp, Artificial sequence
  SiRNA target sequence
tgtatggctattagtctaaat

SEQ ID NO: 51609 - DNA, 21 bp, Artificial sequence
  SiRNA target sequence
gtatggctattagtctaaatt

SEQ ID NO: 51610 - DNA, 21 bp, Artificial sequence
  SiRNA target sequence
tatggctattagtctaaattt

SEQ ID NO: 51611 - DNA, 21 bp, Artificial sequence
  SiRNA target sequence
atggctattagtctaaatttt

SEQ ID NO: 51612 - DNA, 21 bp, Artificial sequence
  SiRNA target sequence
tggctattagtctaaattttt

SEQ ID NO: 51613 - DNA, 21 bp, Artificial sequence
  SiRNA target sequence
ggctattagtctaaatttttc

SEQ ID NO: 51614 - DNA, 21 bp, Artificial sequence
  SiRNA target sequence
gctattagtctaaatttttca

SEQ ID NO: 51615 - DNA, 21 bp, Artificial sequence
  SiRNA target sequence
ctattagtctaaatttttcag

SEQ ID NO: 51616 - DNA, 21 bp, Artificial sequence
  SiRNA target sequence
tattagtctaaatttttcaga

SEQ ID NO: 51617 - DNA, 21 bp, Artificial sequence
  SiRNA target sequence
attagtctaaatttttcagaa

SEQ ID NO: 51618 - DNA, 21 bp, Artificial sequence
  SiRNA target sequence
ttagtctaaatttttcagaaa

SEQ ID NO: 51619 - DNA, 21 bp, Artificial sequence
  SiRNA target sequence
tagtctaaatttttcagaaaa

SEQ ID NO: 51620 - DNA, 21 bp, Artificial sequence
  SiRNA target sequence
agtctaaatttttcagaaaat

SEQ ID NO: 51621 - DNA, 21 bp, Artificial sequence
  SiRNA target sequence
gtctaaatttttcagaaaatt

SEQ ID NO: 51622 - DNA, 21 bp, Artificial sequence
  SiRNA target sequence
tctaaatttttcagaaaattt

SEQ ID NO: 51623 - DNA, 21 bp, Artificial sequence
  SiRNA target sequence
ctaaatttttcagaaaatttc

SEQ ID NO: 51624 - DNA, 21 bp, Artificial sequence
  SiRNA target sequence
taaatttttcagaaaatttca

SEQ ID NO: 51625 - DNA, 21 bp, Artificial sequence
  SiRNA target sequence
aaatttttcagaaaatttcag

SEQ ID NO: 51626 - DNA, 21 bp, Artificial sequence
  SiRNA target sequence
aatttttcagaaaatttcagt

SEQ ID NO: 51627 - DNA, 21 bp, Artificial sequence
  SiRNA target sequence
atttttcagaaaatttcagtt

SEQ ID NO: 51628 - DNA, 21 bp, Artificial sequence
  SiRNA target sequence
tttttcagaaaatttcagttt

SEQ ID NO: 51629 - DNA, 21 bp, Artificial sequence
  SiRNA target sequence
ttttcagaaaatttcagttta

SEQ ID NO: 51630 - DNA, 21 bp, Artificial sequence
  SiRNA target sequence
tttcagaaaatttcagtttag

SEQ ID NO: 51631 - DNA, 21 bp, Artificial sequence
  SiRNA target sequence
ttcagaaaatttcagtttaga

SEQ ID NO: 51632 - DNA, 21 bp, Artificial sequence
  SiRNA target sequence
tcagaaaatttcagtttagac

SEQ ID NO: 51633 - DNA, 21 bp, Artificial sequence
  SiRNA target sequence
cagaaaatttcagtttagacc

SEQ ID NO: 51634 - DNA, 21 bp, Artificial sequence
  SiRNA target sequence
agaaaatttcagtttagaccg

SEQ ID NO: 51635 - DNA, 21 bp, Artificial sequence
  SiRNA target sequence
gaaaatttcagtttagaccga

SEQ ID NO: 51636 - DNA, 21 bp, Artificial sequence
  SiRNA target sequence
aaaatttcagtttagaccgaa

SEQ ID NO: 51637 - DNA, 21 bp, Artificial sequence
  SiRNA target sequence
aaatttcagtttagaccgaaa

SEQ ID NO: 51638 - DNA, 21 bp, Artificial sequence
  SiRNA target sequence
aatttcagtttagaccgaaac

SEQ ID NO: 51639 - DNA, 21 bp, Artificial sequence
  SiRNA target sequence
atttcagtttagaccgaaaca

SEQ ID NO: 51640 - DNA, 21 bp, Artificial sequence
  SiRNA target sequence
tttcagtttagaccgaaacag

SEQ ID NO: 51641 - DNA, 21 bp, Artificial sequence
  SiRNA target sequence
ttcagtttagaccgaaacaga

SEQ ID NO: 51642 - DNA, 21 bp, Artificial sequence
  SiRNA target sequence
tcagtttagaccgaaacagag

SEQ ID NO: 51643 - DNA, 21 bp, Artificial sequence
  SiRNA target sequence
cagtttagaccgaaacagagt

SEQ ID NO: 51644 - DNA, 21 bp, Artificial sequence
  SiRNA target sequence
agtttagaccgaaacagagta

SEQ ID NO: 51645 - DNA, 21 bp, Artificial sequence
  SiRNA target sequence
gtttagaccgaaacagagtag

SEQ ID NO: 51646 - DNA, 21 bp, Artificial sequence
  SiRNA target sequence
tttagaccgaaacagagtagt

SEQ ID NO: 51647 - DNA, 21 bp, Artificial sequence
  SiRNA target sequence
ttagaccgaaacagagtagta

SEQ ID NO: 51648 - DNA, 21 bp, Artificial sequence
  SiRNA target sequence
tagaccgaaacagagtagtac

SEQ ID NO: 51649 - DNA, 21 bp, Artificial sequence
  SiRNA target sequence
agaccgaaacagagtagtacg

SEQ ID NO: 51650 - DNA, 21 bp, Artificial sequence
  SiRNA target sequence
gaccgaaacagagtagtacga

SEQ ID NO: 51651 - DNA, 21 bp, Artificial sequence
  SiRNA target sequence
accgaaacagagtagtacgag

SEQ ID NO: 51652 - DNA, 21 bp, Artificial sequence
  SiRNA target sequence
ccgaaacagagtagtacgagc

SEQ ID NO: 51653 - DNA, 21 bp, Artificial sequence
  SiRNA target sequence
cgaaacagagtagtacgagca

SEQ ID NO: 51654 - DNA, 21 bp, Artificial sequence
  SiRNA target sequence
gaaacagagtagtacgagcac

SEQ ID NO: 51655 - DNA, 21 bp, Artificial sequence
  SiRNA target sequence
aaacagagtagtacgagcact

SEQ ID NO: 51656 - DNA, 21 bp, Artificial sequence
  SiRNA target sequence
aacagagtagtacgagcacta

SEQ ID NO: 51657 - DNA, 21 bp, Artificial sequence
  SiRNA target sequence
acagagtagtacgagcactat

SEQ ID NO: 51658 - DNA, 21 bp, Artificial sequence
  SiRNA target sequence
cagagtagtacgagcactatg

SEQ ID NO: 51659 - DNA, 21 bp, Artificial sequence
  SiRNA target sequence
agagtagtacgagcactatgg

SEQ ID NO: 51660 - DNA, 21 bp, Artificial sequence
  SiRNA target sequence
gagtagtacgagcactatggt

SEQ ID NO: 51661 - DNA, 21 bp, Artificial sequence
  SiRNA target sequence
agtagtacgagcactatggtt

SEQ ID NO: 51662 - DNA, 21 bp, Artificial sequence
  SiRNA target sequence
gtagtacgagcactatggttc

SEQ ID NO: 51663 - DNA, 21 bp, Artificial sequence
  SiRNA target sequence
tagtacgagcactatggttcg

SEQ ID NO: 51664 - DNA, 21 bp, Artificial sequence
  SiRNA target sequence
agtacgagcactatggttcga

SEQ ID NO: 51665 - DNA, 21 bp, Artificial sequence
  SiRNA target sequence
gtacgagcactatggttcgaa

SEQ ID NO: 51666 - DNA, 21 bp, Artificial sequence
  SiRNA target sequence
tacgagcactatggttcgaaa

SEQ ID NO: 51667 - DNA, 21 bp, Artificial sequence
  SiRNA target sequence
acgagcactatggttcgaaaa

SEQ ID NO: 51668 - DNA, 21 bp, Artificial sequence
  SiRNA target sequence
cgagcactatggttcgaaaag

SEQ ID NO: 51669 - DNA, 21 bp, Artificial sequence
  SiRNA target sequence
gagcactatggttcgaaaaga

SEQ ID NO: 51670 - DNA, 21 bp, Artificial sequence
  SiRNA target sequence
agcactatggttcgaaaagac

SEQ ID NO: 51671 - DNA, 21 bp, Artificial sequence
  SiRNA target sequence
gcactatggttcgaaaagacg

SEQ ID NO: 51672 - DNA, 21 bp, Artificial sequence
  SiRNA target sequence
cactatggttcgaaaagacgc

SEQ ID NO: 51673 - DNA, 21 bp, Artificial sequence
  SiRNA target sequence
actatggttcgaaaagacgct

SEQ ID NO: 51674 - DNA, 21 bp, Artificial sequence
  SiRNA target sequence
ctatggttcgaaaagacgctt

SEQ ID NO: 51675 - DNA, 21 bp, Artificial sequence
  SiRNA target sequence
tatggttcgaaaagacgctta

SEQ ID NO: 51676 - DNA, 21 bp, Artificial sequence
  SiRNA target sequence
atggttcgaaaagacgcttaa

SEQ ID NO: 51677 - DNA, 21 bp, Artificial sequence
  SiRNA target sequence
tggttcgaaaagacgcttaaa

SEQ ID NO: 51678 - DNA, 21 bp, Artificial sequence
  SiRNA target sequence
ggttcgaaaagacgcttaaaa

SEQ ID NO: 51679 - DNA, 21 bp, Artificial sequence
  SiRNA target sequence
gttcgaaaagacgcttaaaag

SEQ ID NO: 51680 - DNA, 21 bp, Artificial sequence
  SiRNA target sequence
ttcgaaaagacgcttaaaaga

SEQ ID NO: 51681 - DNA, 21 bp, Artificial sequence
  SiRNA target sequence
tcgaaaagacgcttaaaagaa

SEQ ID NO: 51682 - DNA, 21 bp, Artificial sequence
  SiRNA target sequence
cgaaaagacgcttaaaagaaa

SEQ ID NO: 51683 - DNA, 21 bp, Artificial sequence
  SiRNA target sequence
gaaaagacgcttaaaagaaat

SEQ ID NO: 51684 - DNA, 21 bp, Artificial sequence
  SiRNA target sequence
aaaagacgcttaaaagaaatc

SEQ ID NO: 51685 - DNA, 21 bp, Artificial sequence
  SiRNA target sequence
aaagacgcttaaaagaaatct

SEQ ID NO: 51686 - DNA, 21 bp, Artificial sequence
  SiRNA target sequence
aagacgcttaaaagaaatctc

SEQ ID NO: 51687 - DNA, 21 bp, Artificial sequence
  SiRNA target sequence
agacgcttaaaagaaatctca

SEQ ID NO: 51688 - DNA, 21 bp, Artificial sequence
  SiRNA target sequence
gacgcttaaaagaaatctcac

SEQ ID NO: 51689 - DNA, 21 bp, Artificial sequence
  SiRNA target sequence
acgcttaaaagaaatctcact

SEQ ID NO: 51690 - DNA, 21 bp, Artificial sequence
  SiRNA target sequence
cgcttaaaagaaatctcacta

SEQ ID NO: 51691 - DNA, 21 bp, Artificial sequence
  SiRNA target sequence
gcttaaaagaaatctcactag

SEQ ID NO: 51692 - DNA, 21 bp, Artificial sequence
  SiRNA target sequence
cttaaaagaaatctcactaga

SEQ ID NO: 51693 - DNA, 21 bp, Artificial sequence
  SiRNA target sequence
ttaaaagaaatctcactagaa

SEQ ID NO: 51694 - DNA, 21 bp, Artificial sequence
  SiRNA target sequence
taaaagaaatctcactagaag

SEQ ID NO: 51695 - DNA, 21 bp, Artificial sequence
  SiRNA target sequence
aaaagaaatctcactagaagg

SEQ ID NO: 51696 - DNA, 21 bp, Artificial sequence
  SiRNA target sequence
aaagaaatctcactagaagga

SEQ ID NO: 51697 - DNA, 21 bp, Artificial sequence
  SiRNA target sequence
aagaaatctcactagaaggag

SEQ ID NO: 51698 - DNA, 21 bp, Artificial sequence
  SiRNA target sequence
agaaatctcactagaaggagg

SEQ ID NO: 51699 - DNA, 21 bp, Artificial sequence
  SiRNA target sequence
gaaatctcactagaaggaggc

SEQ ID NO: 51700 - DNA, 21 bp, Artificial sequence
  SiRNA target sequence
aaatctcactagaaggaggct

SEQ ID NO: 51701 - DNA, 21 bp, Artificial sequence
  SiRNA target sequence
aatctcactagaaggaggctt

SEQ ID NO: 51702 - DNA, 21 bp, Artificial sequence
  SiRNA target sequence
atctcactagaaggaggcttt

SEQ ID NO: 51703 - DNA, 21 bp, Artificial sequence
  SiRNA target sequence
tctcactagaaggaggctttt

SEQ ID NO: 51704 - DNA, 21 bp, Artificial sequence
  SiRNA target sequence
ctcactagaaggaggctttta

SEQ ID NO: 51705 - DNA, 21 bp, Artificial sequence
  SiRNA target sequence
tcactagaaggaggcttttaa

SEQ ID NO: 51706 - DNA, 21 bp, Artificial sequence
  SiRNA target sequence
cactagaaggaggcttttaag

SEQ ID NO: 51707 - DNA, 21 bp, Artificial sequence
  SiRNA target sequence
actagaaggaggcttttaagc

SEQ ID NO: 51708 - DNA, 21 bp, Artificial sequence
  SiRNA target sequence
ctagaaggaggcttttaagct

SEQ ID NO: 51709 - DNA, 21 bp, Artificial sequence
  SiRNA target sequence
tagaaggaggcttttaagcta

SEQ ID NO: 51710 - DNA, 21 bp, Artificial sequence
  SiRNA target sequence
agaaggaggcttttaagctat

SEQ ID NO: 51711 - DNA, 21 bp, Artificial sequence
  SiRNA target sequence
gaaggaggcttttaagctatc

SEQ ID NO: 51712 - DNA, 21 bp, Artificial sequence
  SiRNA target sequence
aaggaggcttttaagctatca

SEQ ID NO: 51713 - DNA, 21 bp, Artificial sequence
  SiRNA target sequence
aggaggcttttaagctatcag

SEQ ID NO: 51714 - DNA, 21 bp, Artificial sequence
  SiRNA target sequence
ggaggcttttaagctatcagc

SEQ ID NO: 51715 - DNA, 21 bp, Artificial sequence
  SiRNA target sequence
gaggcttttaagctatcagct

SEQ ID NO: 51716 - DNA, 21 bp, Artificial sequence
  SiRNA target sequence
aggcttttaagctatcagctt

SEQ ID NO: 51717 - DNA, 21 bp, Artificial sequence
  SiRNA target sequence
ggcttttaagctatcagcttt

SEQ ID NO: 51718 - DNA, 21 bp, Artificial sequence
  SiRNA target sequence
gcttttaagctatcagctttt

SEQ ID NO: 51719 - DNA, 21 bp, Artificial sequence
  SiRNA target sequence
cttttaagctatcagcttttt

SEQ ID NO: 51720 - DNA, 21 bp, Artificial sequence
  SiRNA target sequence
ttttaagctatcagctttttg

SEQ ID NO: 51721 - DNA, 21 bp, Artificial sequence
  SiRNA target sequence
tttaagctatcagctttttga

SEQ ID NO: 51722 - DNA, 21 bp, Artificial sequence
  SiRNA target sequence
ttaagctatcagctttttgac

SEQ ID NO: 51723 - DNA, 21 bp, Artificial sequence
  SiRNA target sequence
taagctatcagctttttgaca

SEQ ID NO: 51724 - DNA, 21 bp, Artificial sequence
  SiRNA target sequence
aagctatcagctttttgacat

SEQ ID NO: 51725 - DNA, 21 bp, Artificial sequence
  SiRNA target sequence
agctatcagctttttgacata

SEQ ID NO: 51726 - DNA, 21 bp, Artificial sequence
  SiRNA target sequence
gctatcagctttttgacataa

SEQ ID NO: 51727 - DNA, 21 bp, Artificial sequence
  SiRNA target sequence
ctatcagctttttgacataat

SEQ ID NO: 51728 - DNA, 21 bp, Artificial sequence
  SiRNA target sequence
tatcagctttttgacataatc

SEQ ID NO: 51729 - DNA, 21 bp, Artificial sequence
  SiRNA target sequence
atcagctttttgacataatct

SEQ ID NO: 51730 - DNA, 21 bp, Artificial sequence
  SiRNA target sequence
tcagctttttgacataatcta

SEQ ID NO: 51731 - DNA, 21 bp, Artificial sequence
  SiRNA target sequence
cagctttttgacataatctaa

SEQ ID NO: 51732 - DNA, 21 bp, Artificial sequence
  SiRNA target sequence
agctttttgacataatctaac

SEQ ID NO: 51733 - DNA, 21 bp, Artificial sequence
  SiRNA target sequence
gctttttgacataatctaacg

SEQ ID NO: 51734 - DNA, 21 bp, Artificial sequence
  SiRNA target sequence
ctttttgacataatctaacga

SEQ ID NO: 51735 - DNA, 21 bp, Artificial sequence
  SiRNA target sequence
tttttgacataatctaacgac

SEQ ID NO: 51736 - DNA, 21 bp, Artificial sequence
  SiRNA target sequence
ttttgacataatctaacgact

SEQ ID NO: 51737 - DNA, 21 bp, Artificial sequence
  SiRNA target sequence
tttgacataatctaacgacta

SEQ ID NO: 51738 - DNA, 21 bp, Artificial sequence
  SiRNA target sequence
ttgacataatctaacgactac

SEQ ID NO: 51739 - DNA, 21 bp, Artificial sequence
  SiRNA target sequence
tgacataatctaacgactacg

SEQ ID NO: 51740 - DNA, 21 bp, Artificial sequence
  SiRNA target sequence
gacataatctaacgactacgg

SEQ ID NO: 51741 - DNA, 21 bp, Artificial sequence
  SiRNA target sequence
acataatctaacgactacggc

SEQ ID NO: 51742 - DNA, 21 bp, Artificial sequence
  SiRNA target sequence
cataatctaacgactacggca

SEQ ID NO: 51743 - DNA, 21 bp, Artificial sequence
  SiRNA target sequence
ataatctaacgactacggcaa

SEQ ID NO: 51744 - DNA, 21 bp, Artificial sequence
  SiRNA target sequence
taatctaacgactacggcaaa

SEQ ID NO: 51745 - DNA, 21 bp, Artificial sequence
  SiRNA target sequence
aatctaacgactacggcaaaa

SEQ ID NO: 51746 - DNA, 21 bp, Artificial sequence
  SiRNA target sequence
atctaacgactacggcaaaat

SEQ ID NO: 51747 - DNA, 21 bp, Artificial sequence
  SiRNA target sequence
tctaacgactacggcaaaatt

SEQ ID NO: 51748 - DNA, 21 bp, Artificial sequence
  SiRNA target sequence
ctaacgactacggcaaaattt

SEQ ID NO: 51749 - DNA, 21 bp, Artificial sequence
  SiRNA target sequence
taacgactacggcaaaatttc

SEQ ID NO: 51750 - DNA, 21 bp, Artificial sequence
  SiRNA target sequence
aacgactacggcaaaatttcg

SEQ ID NO: 51751 - DNA, 21 bp, Artificial sequence
  SiRNA target sequence
acgactacggcaaaatttcgg

SEQ ID NO: 51752 - DNA, 21 bp, Artificial sequence
  SiRNA target sequence
cgactacggcaaaatttcgga

SEQ ID NO: 51753 - DNA, 21 bp, Artificial sequence
  SiRNA target sequence
gactacggcaaaatttcggaa

SEQ ID NO: 51754 - DNA, 21 bp, Artificial sequence
  SiRNA target sequence
actacggcaaaatttcggaat

SEQ ID NO: 51755 - DNA, 21 bp, Artificial sequence
  SiRNA target sequence
ctacggcaaaatttcggaatt

SEQ ID NO: 51756 - DNA, 21 bp, Artificial sequence
  SiRNA target sequence
tacggcaaaatttcggaatta

SEQ ID NO: 51757 - DNA, 21 bp, Artificial sequence
  SiRNA target sequence
acggcaaaatttcggaattag

SEQ ID NO: 51758 - DNA, 21 bp, Artificial sequence
  SiRNA target sequence
cggcaaaatttcggaattagg

SEQ ID NO: 51759 - DNA, 21 bp, Artificial sequence
  SiRNA target sequence
ggcaaaatttcggaattagga

SEQ ID NO: 51760 - DNA, 21 bp, Artificial sequence
  SiRNA target sequence
gcaaaatttcggaattaggat

SEQ ID NO: 51761 - DNA, 21 bp, Artificial sequence
  SiRNA target sequence
caaaatttcggaattaggata

SEQ ID NO: 51762 - DNA, 21 bp, Artificial sequence
  SiRNA target sequence
aaaatttcggaattaggataa

SEQ ID NO: 51763 - DNA, 21 bp, Artificial sequence
  SiRNA target sequence
aaatttcggaattaggataat

SEQ ID NO: 51764 - DNA, 21 bp, Artificial sequence
  SiRNA target sequence
aatttcggaattaggataatt

SEQ ID NO: 51765 - DNA, 21 bp, Artificial sequence
  SiRNA target sequence
atttcggaattaggataattt

SEQ ID NO: 51766 - DNA, 21 bp, Artificial sequence
  SiRNA target sequence
tttcggaattaggataatttt

SEQ ID NO: 51767 - DNA, 21 bp, Artificial sequence
  SiRNA target sequence
ttcggaattaggataatttta

SEQ ID NO: 51768 - DNA, 21 bp, Artificial sequence
  SiRNA target sequence
tcggaattaggataattttaa

SEQ ID NO: 51769 - DNA, 21 bp, Artificial sequence
  SiRNA target sequence
cggaattaggataattttaaa

SEQ ID NO: 51770 - DNA, 21 bp, Artificial sequence
  SiRNA target sequence
ggaattaggataattttaaaa

SEQ ID NO: 51771 - DNA, 21 bp, Artificial sequence
  SiRNA target sequence
gaattaggataattttaaaaa

SEQ ID NO: 51772 - DNA, 21 bp, Artificial sequence
  SiRNA target sequence
gcttaacttcggagagctgac

SEQ ID NO: 51773 - DNA, 21 bp, Artificial sequence
  SiRNA target sequence
cttaacttcggagagctgacg

SEQ ID NO: 51774 - DNA, 21 bp, Artificial sequence
  SiRNA target sequence
ttaacttcggagagctgacga

SEQ ID NO: 51775 - DNA, 21 bp, Artificial sequence
  SiRNA target sequence
taacttcggagagctgacgag

SEQ ID NO: 51776 - DNA, 21 bp, Artificial sequence
  SiRNA target sequence
aacttcggagagctgacgagt

SEQ ID NO: 51777 - DNA, 21 bp, Artificial sequence
  SiRNA target sequence
acttcggagagctgacgagtt

SEQ ID NO: 51778 - DNA, 21 bp, Artificial sequence
  SiRNA target sequence
cttcggagagctgacgagttc

SEQ ID NO: 51779 - DNA, 21 bp, Artificial sequence
  SiRNA target sequence
ttcggagagctgacgagttcc

SEQ ID NO: 51780 - DNA, 21 bp, Artificial sequence
  SiRNA target sequence
tcggagagctgacgagttccg

SEQ ID NO: 51781 - DNA, 21 bp, Artificial sequence
  SiRNA target sequence
cggagagctgacgagttccgg

SEQ ID NO: 51782 - DNA, 21 bp, Artificial sequence
  SiRNA target sequence
ggagagctgacgagttccggt

SEQ ID NO: 51783 - DNA, 21 bp, Artificial sequence
  SiRNA target sequence
gagagctgacgagttccggtg

SEQ ID NO: 51784 - DNA, 21 bp, Artificial sequence
  SiRNA target sequence
agagctgacgagttccggtgt

SEQ ID NO: 51785 - DNA, 21 bp, Artificial sequence
  SiRNA target sequence
gagctgacgagttccggtgtt

SEQ ID NO: 51786 - DNA, 21 bp, Artificial sequence
  SiRNA target sequence
agctgacgagttccggtgttt

SEQ ID NO: 51787 - DNA, 21 bp, Artificial sequence
  SiRNA target sequence
gctgacgagttccggtgtttt

SEQ ID NO: 51788 - DNA, 21 bp, Artificial sequence
  SiRNA target sequence
ctgacgagttccggtgtttta

SEQ ID NO: 51789 - DNA, 21 bp, Artificial sequence
  SiRNA target sequence
tgacgagttccggtgttttac

SEQ ID NO: 51790 - DNA, 21 bp, Artificial sequence
  SiRNA target sequence
gacgagttccggtgttttaca

SEQ ID NO: 51791 - DNA, 21 bp, Artificial sequence
  SiRNA target sequence
acgagttccggtgttttacag

SEQ ID NO: 51792 - DNA, 21 bp, Artificial sequence
  SiRNA target sequence
cgagttccggtgttttacagt

SEQ ID NO: 51793 - DNA, 21 bp, Artificial sequence
  SiRNA target sequence
gagttccggtgttttacagta

SEQ ID NO: 51794 - DNA, 21 bp, Artificial sequence
  SiRNA target sequence
agttccggtgttttacagtag

SEQ ID NO: 51795 - DNA, 21 bp, Artificial sequence
  SiRNA target sequence
gttccggtgttttacagtaga

SEQ ID NO: 51796 - DNA, 21 bp, Artificial sequence
  SiRNA target sequence
ttccggtgttttacagtagat

SEQ ID NO: 51797 - DNA, 21 bp, Artificial sequence
  SiRNA target sequence
tccggtgttttacagtagata

SEQ ID NO: 51798 - DNA, 21 bp, Artificial sequence
  SiRNA target sequence
ccggtgttttacagtagatat

SEQ ID NO: 51799 - DNA, 21 bp, Artificial sequence
  SiRNA target sequence
cggtgttttacagtagatatg

SEQ ID NO: 51800 - DNA, 21 bp, Artificial sequence
  SiRNA target sequence
ggtgttttacagtagatatgg

SEQ ID NO: 51801 - DNA, 21 bp, Artificial sequence
  SiRNA target sequence
gtgttttacagtagatatggc

SEQ ID NO: 51802 - DNA, 21 bp, Artificial sequence
  SiRNA target sequence
tgttttacagtagatatggcc

SEQ ID NO: 51803 - DNA, 21 bp, Artificial sequence
  SiRNA target sequence
gttttacagtagatatggccg

SEQ ID NO: 51804 - DNA, 21 bp, Artificial sequence
  SiRNA target sequence
ttttacagtagatatggccgt

SEQ ID NO: 51805 - DNA, 21 bp, Artificial sequence
  SiRNA target sequence
tttacagtagatatggccgta

SEQ ID NO: 51806 - DNA, 21 bp, Artificial sequence
  SiRNA target sequence
ttacagtagatatggccgtag

SEQ ID NO: 51807 - DNA, 21 bp, Artificial sequence
  SiRNA target sequence
tacagtagatatggccgtagc

SEQ ID NO: 51808 - DNA, 21 bp, Artificial sequence
  SiRNA target sequence
acagtagatatggccgtagct

SEQ ID NO: 51809 - DNA, 21 bp, Artificial sequence
  SiRNA target sequence
cagtagatatggccgtagcta

SEQ ID NO: 51810 - DNA, 21 bp, Artificial sequence
  SiRNA target sequence
agtagatatggccgtagctaa

SEQ ID NO: 51811 - DNA, 21 bp, Artificial sequence
  SiRNA target sequence
gtagatatggccgtagctaag

SEQ ID NO: 51812 - DNA, 21 bp, Artificial sequence
  SiRNA target sequence
tagatatggccgtagctaagt

SEQ ID NO: 51813 - DNA, 21 bp, Artificial sequence
  SiRNA target sequence
agatatggccgtagctaagta

SEQ ID NO: 51814 - DNA, 21 bp, Artificial sequence
  SiRNA target sequence
gatatggccgtagctaagtac

SEQ ID NO: 51815 - DNA, 21 bp, Artificial sequence
  SiRNA target sequence
atatggccgtagctaagtact

SEQ ID NO: 51816 - DNA, 21 bp, Artificial sequence
  SiRNA target sequence
tatggccgtagctaagtactg

SEQ ID NO: 51817 - DNA, 21 bp, Artificial sequence
  SiRNA target sequence
atggccgtagctaagtactgc

SEQ ID NO: 51818 - DNA, 21 bp, Artificial sequence
  SiRNA target sequence
tggccgtagctaagtactgca

SEQ ID NO: 51819 - DNA, 21 bp, Artificial sequence
  SiRNA target sequence
ggccgtagctaagtactgcat

SEQ ID NO: 51820 - DNA, 21 bp, Artificial sequence
  SiRNA target sequence
gccgtagctaagtactgcata

SEQ ID NO: 51821 - DNA, 21 bp, Artificial sequence
  SiRNA target sequence
ccgtagctaagtactgcatag

SEQ ID NO: 51822 - DNA, 21 bp, Artificial sequence
  SiRNA target sequence
cgtagctaagtactgcataga

SEQ ID NO: 51823 - DNA, 21 bp, Artificial sequence
  SiRNA target sequence
gtagctaagtactgcatagat

SEQ ID NO: 51824 - DNA, 21 bp, Artificial sequence
  SiRNA target sequence
tagctaagtactgcatagata

SEQ ID NO: 51825 - DNA, 21 bp, Artificial sequence
  SiRNA target sequence
agctaagtactgcatagataa

SEQ ID NO: 51826 - DNA, 21 bp, Artificial sequence
  SiRNA target sequence
gctaagtactgcatagataaa

SEQ ID NO: 51827 - DNA, 21 bp, Artificial sequence
  SiRNA target sequence
ctaagtactgcatagataaaa

SEQ ID NO: 51828 - DNA, 21 bp, Artificial sequence
  SiRNA target sequence
taagtactgcatagataaaat

SEQ ID NO: 51829 - DNA, 21 bp, Artificial sequence
  SiRNA target sequence
aagtactgcatagataaaatt

SEQ ID NO: 51830 - DNA, 21 bp, Artificial sequence
  SiRNA target sequence
agtactgcatagataaaattt

SEQ ID NO: 51831 - DNA, 21 bp, Artificial sequence
  SiRNA target sequence
gtactgcatagataaaatttt

SEQ ID NO: 51832 - DNA, 21 bp, Artificial sequence
  SiRNA target sequence
tactgcatagataaaatttta

SEQ ID NO: 51833 - DNA, 21 bp, Artificial sequence
  SiRNA target sequence
actgcatagataaaattttat

SEQ ID NO: 51834 - DNA, 21 bp, Artificial sequence
  SiRNA target sequence
ctgcatagataaaattttatt

SEQ ID NO: 51835 - DNA, 21 bp, Artificial sequence
  SiRNA target sequence
tgcatagataaaattttatta

SEQ ID NO: 51836 - DNA, 21 bp, Artificial sequence
  SiRNA target sequence
gcatagataaaattttattaa

SEQ ID NO: 51837 - DNA, 21 bp, Artificial sequence
  SiRNA target sequence
catagataaaattttattaaa

SEQ ID NO: 51838 - DNA, 21 bp, Artificial sequence
  SiRNA target sequence
atagataaaattttattaaat

SEQ ID NO: 51839 - DNA, 21 bp, Artificial sequence
  SiRNA target sequence
tagataaaattttattaaatt

SEQ ID NO: 51840 - DNA, 21 bp, Artificial sequence
  SiRNA target sequence
agataaaattttattaaatta

SEQ ID NO: 51841 - DNA, 21 bp, Artificial sequence
  SiRNA target sequence
gataaaattttattaaattaa

SEQ ID NO: 51842 - DNA, 21 bp, Artificial sequence
  SiRNA target sequence
ataaaattttattaaattaat

SEQ ID NO: 51843 - DNA, 21 bp, Artificial sequence
  SiRNA target sequence
taaaattttattaaattaatt

SEQ ID NO: 51844 - DNA, 21 bp, Artificial sequence
  SiRNA target sequence
aaaattttattaaattaattt

SEQ ID NO: 51845 - DNA, 21 bp, Artificial sequence
  SiRNA target sequence
aaattttattaaattaattta

SEQ ID NO: 51846 - DNA, 21 bp, Artificial sequence
  SiRNA target sequence
aattttattaaattaatttat

SEQ ID NO: 51847 - DNA, 21 bp, Artificial sequence
  SiRNA target sequence
attttattaaattaatttatt

SEQ ID NO: 51848 - DNA, 21 bp, Artificial sequence
  SiRNA target sequence
ttttattaaattaatttattg

SEQ ID NO: 51849 - DNA, 21 bp, Artificial sequence
  SiRNA target sequence
tttattaaattaatttattga

SEQ ID NO: 51850 - DNA, 21 bp, Artificial sequence
  SiRNA target sequence
ttattaaattaatttattgaa

SEQ ID NO: 51851 - DNA, 21 bp, Artificial sequence
  SiRNA target sequence
tattaaattaatttattgaaa

SEQ ID NO: 51852 - DNA, 21 bp, Artificial sequence
  SiRNA target sequence
attaaattaatttattgaaaa

SEQ ID NO: 51853 - DNA, 21 bp, Artificial sequence
  SiRNA target sequence
ttaaattaatttattgaaaaa

SEQ ID NO: 51854 - DNA, 21 bp, Artificial sequence
  SiRNA target sequence
taaattaatttattgaaaaag

SEQ ID NO: 51855 - DNA, 21 bp, Artificial sequence
  SiRNA target sequence
aaattaatttattgaaaaagt

SEQ ID NO: 51856 - DNA, 21 bp, Artificial sequence
  SiRNA target sequence
aattaatttattgaaaaagta

SEQ ID NO: 51857 - DNA, 21 bp, Artificial sequence
  SiRNA target sequence
attaatttattgaaaaagtag

SEQ ID NO: 51858 - DNA, 21 bp, Artificial sequence
  SiRNA target sequence
ttaatttattgaaaaagtagt

SEQ ID NO: 51859 - DNA, 21 bp, Artificial sequence
  SiRNA target sequence
taatttattgaaaaagtagtt

SEQ ID NO: 51860 - DNA, 21 bp, Artificial sequence
  SiRNA target sequence
aatttattgaaaaagtagttt

SEQ ID NO: 51861 - DNA, 21 bp, Artificial sequence
  SiRNA target sequence
atttattgaaaaagtagtttt

SEQ ID NO: 51862 - DNA, 21 bp, Artificial sequence
  SiRNA target sequence
tttattgaaaaagtagttttc

SEQ ID NO: 51863 - DNA, 21 bp, Artificial sequence
  SiRNA target sequence
ttattgaaaaagtagttttca

SEQ ID NO: 51864 - DNA, 21 bp, Artificial sequence
  SiRNA target sequence
tattgaaaaagtagttttcat

SEQ ID NO: 51865 - DNA, 21 bp, Artificial sequence
  SiRNA target sequence
attgaaaaagtagttttcata

SEQ ID NO: 51866 - DNA, 21 bp, Artificial sequence
  SiRNA target sequence
ttgaaaaagtagttttcatat

SEQ ID NO: 51867 - DNA, 21 bp, Artificial sequence
  SiRNA target sequence
tgaaaaagtagttttcatatt

SEQ ID NO: 51868 - DNA, 21 bp, Artificial sequence
  SiRNA target sequence
gaaaaagtagttttcatatta

SEQ ID NO: 51869 - DNA, 21 bp, Artificial sequence
  SiRNA target sequence
aaaaagtagttttcatattat

SEQ ID NO: 51870 - DNA, 21 bp, Artificial sequence
  SiRNA target sequence
aaaagtagttttcatattatt

SEQ ID NO: 51871 - DNA, 21 bp, Artificial sequence
  SiRNA target sequence
aaagtagttttcatattattt

SEQ ID NO: 51872 - DNA, 21 bp, Artificial sequence
  SiRNA target sequence
aagtagttttcatattatttt

SEQ ID NO: 51873 - DNA, 21 bp, Artificial sequence
  SiRNA target sequence
agtagttttcatattattttc

SEQ ID NO: 51874 - DNA, 21 bp, Artificial sequence
  SiRNA target sequence
gtagttttcatattattttct

SEQ ID NO: 51875 - DNA, 21 bp, Artificial sequence
  SiRNA target sequence
tagttttcatattattttcta

SEQ ID NO: 51876 - DNA, 21 bp, Artificial sequence
  SiRNA target sequence
agttttcatattattttctaa

SEQ ID NO: 51877 - DNA, 21 bp, Artificial sequence
  SiRNA target sequence
gttttcatattattttctaaa

SEQ ID NO: 51878 - DNA, 21 bp, Artificial sequence
  SiRNA target sequence
ttttcatattattttctaaat

SEQ ID NO: 51879 - DNA, 21 bp, Artificial sequence
  SiRNA target sequence
tttcatattattttctaaatt

SEQ ID NO: 51880 - DNA, 21 bp, Artificial sequence
  SiRNA target sequence
ttcatattattttctaaattt

SEQ ID NO: 51881 - DNA, 21 bp, Artificial sequence
  SiRNA target sequence
tcatattattttctaaatttt

SEQ ID NO: 51882 - DNA, 21 bp, Artificial sequence
  SiRNA target sequence
catattattttctaaattttc

SEQ ID NO: 51883 - DNA, 21 bp, Artificial sequence
  SiRNA target sequence
atattattttctaaattttca

SEQ ID NO: 51884 - DNA, 21 bp, Artificial sequence
  SiRNA target sequence
tattattttctaaattttcaa

SEQ ID NO: 51885 - DNA, 21 bp, Artificial sequence
  SiRNA target sequence
attattttctaaattttcaaa

SEQ ID NO: 51886 - DNA, 21 bp, Artificial sequence
  SiRNA target sequence
ttattttctaaattttcaaac

SEQ ID NO: 51887 - DNA, 21 bp, Artificial sequence
  SiRNA target sequence
tattttctaaattttcaaact

SEQ ID NO: 51888 - DNA, 21 bp, Artificial sequence
  SiRNA target sequence
attttctaaattttcaaactt

SEQ ID NO: 51889 - DNA, 21 bp, Artificial sequence
  SiRNA target sequence
ttttctaaattttcaaacttt

SEQ ID NO: 51890 - DNA, 21 bp, Artificial sequence
  SiRNA target sequence
tttctaaattttcaaactttt

SEQ ID NO: 51891 - DNA, 21 bp, Artificial sequence
  SiRNA target sequence
ttctaaattttcaaactttta

SEQ ID NO: 51892 - DNA, 21 bp, Artificial sequence
  SiRNA target sequence
tctaaattttcaaacttttaa

SEQ ID NO: 51893 - DNA, 21 bp, Artificial sequence
  SiRNA target sequence
ctaaattttcaaacttttaaa

SEQ ID NO: 51894 - DNA, 21 bp, Artificial sequence
  SiRNA target sequence
taaattttcaaacttttaaat

SEQ ID NO: 51895 - DNA, 21 bp, Artificial sequence
  SiRNA target sequence
aaattttcaaacttttaaatt

SEQ ID NO: 51896 - DNA, 21 bp, Artificial sequence
  SiRNA target sequence
aattttcaaacttttaaatta

SEQ ID NO: 51897 - DNA, 21 bp, Artificial sequence
  SiRNA target sequence
attttcaaacttttaaattat

SEQ ID NO: 51898 - DNA, 21 bp, Artificial sequence
  SiRNA target sequence
ttttcaaacttttaaattata

SEQ ID NO: 51899 - DNA, 21 bp, Artificial sequence
  SiRNA target sequence
tttcaaacttttaaattatag

SEQ ID NO: 51900 - DNA, 21 bp, Artificial sequence
  SiRNA target sequence
ttcaaacttttaaattatagt

SEQ ID NO: 51901 - DNA, 21 bp, Artificial sequence
  SiRNA target sequence
tcaaacttttaaattatagta

SEQ ID NO: 51902 - DNA, 21 bp, Artificial sequence
  SiRNA target sequence
caaacttttaaattatagtac

SEQ ID NO: 51903 - DNA, 21 bp, Artificial sequence
  SiRNA target sequence
aaacttttaaattatagtaca

SEQ ID NO: 51904 - DNA, 21 bp, Artificial sequence
  SiRNA target sequence
aacttttaaattatagtacaa

SEQ ID NO: 51905 - DNA, 21 bp, Artificial sequence
  SiRNA target sequence
acttttaaattatagtacaat

SEQ ID NO: 51906 - DNA, 21 bp, Artificial sequence
  SiRNA target sequence
cttttaaattatagtacaatt

SEQ ID NO: 51907 - DNA, 21 bp, Artificial sequence
  SiRNA target sequence
ttttaaattatagtacaatta

SEQ ID NO: 51908 - DNA, 21 bp, Artificial sequence
  SiRNA target sequence
tttaaattatagtacaattat

SEQ ID NO: 51909 - DNA, 21 bp, Artificial sequence
  SiRNA target sequence
ttaaattatagtacaattatt

SEQ ID NO: 51910 - DNA, 21 bp, Artificial sequence
  SiRNA target sequence
taaattatagtacaattattt

SEQ ID NO: 51911 - DNA, 21 bp, Artificial sequence
  SiRNA target sequence
aaattatagtacaattatttt

SEQ ID NO: 51912 - DNA, 21 bp, Artificial sequence
  SiRNA target sequence
aattatagtacaattattttg

SEQ ID NO: 51913 - DNA, 21 bp, Artificial sequence
  SiRNA target sequence
attatagtacaattattttga

SEQ ID NO: 51914 - DNA, 21 bp, Artificial sequence
  SiRNA target sequence
ttatagtacaattattttgag

SEQ ID NO: 51915 - DNA, 21 bp, Artificial sequence
  SiRNA target sequence
tatagtacaattattttgaga

SEQ ID NO: 51916 - DNA, 21 bp, Artificial sequence
  SiRNA target sequence
atagtacaattattttgagaa

SEQ ID NO: 51917 - DNA, 21 bp, Artificial sequence
  SiRNA target sequence
tagtacaattattttgagaaa

SEQ ID NO: 51918 - DNA, 21 bp, Artificial sequence
  SiRNA target sequence
agtacaattattttgagaaat

SEQ ID NO: 51919 - DNA, 21 bp, Artificial sequence
  SiRNA target sequence
gtacaattattttgagaaatt

SEQ ID NO: 51920 - DNA, 21 bp, Artificial sequence
  SiRNA target sequence
tacaattattttgagaaattt

SEQ ID NO: 51921 - DNA, 21 bp, Artificial sequence
  SiRNA target sequence
acaattattttgagaaattta

SEQ ID NO: 51922 - DNA, 21 bp, Artificial sequence
  SiRNA target sequence
caattattttgagaaatttat

SEQ ID NO: 51923 - DNA, 21 bp, Artificial sequence
  SiRNA target sequence
aattattttgagaaatttata

SEQ ID NO: 51924 - DNA, 21 bp, Artificial sequence
  SiRNA target sequence
attattttgagaaatttataa

SEQ ID NO: 51925 - DNA, 21 bp, Artificial sequence
  SiRNA target sequence
ttattttgagaaatttataat

SEQ ID NO: 51926 - DNA, 21 bp, Artificial sequence
  SiRNA target sequence
tattttgagaaatttataatt

SEQ ID NO: 51927 - DNA, 21 bp, Artificial sequence
  SiRNA target sequence
attttgagaaatttataattc

SEQ ID NO: 51928 - DNA, 21 bp, Artificial sequence
  SiRNA target sequence
ttttgagaaatttataattca

SEQ ID NO: 51929 - DNA, 21 bp, Artificial sequence
  SiRNA target sequence
tttgagaaatttataattcat

SEQ ID NO: 51930 - DNA, 21 bp, Artificial sequence
  SiRNA target sequence
ttgagaaatttataattcatt

SEQ ID NO: 51931 - DNA, 21 bp, Artificial sequence
  SiRNA target sequence
tgagaaatttataattcattg

SEQ ID NO: 51932 - DNA, 21 bp, Artificial sequence
  SiRNA target sequence
gagaaatttataattcattga

SEQ ID NO: 51933 - DNA, 21 bp, Artificial sequence
  SiRNA target sequence
agaaatttataattcattgat

SEQ ID NO: 51934 - DNA, 21 bp, Artificial sequence
  SiRNA target sequence
gaaatttataattcattgata

SEQ ID NO: 51935 - DNA, 21 bp, Artificial sequence
  SiRNA target sequence
aaatttataattcattgatat

SEQ ID NO: 51936 - DNA, 21 bp, Artificial sequence
  SiRNA target sequence
aatttataattcattgatata

SEQ ID NO: 51937 - DNA, 21 bp, Artificial sequence
  SiRNA target sequence
atttataattcattgatatat

SEQ ID NO: 51938 - DNA, 21 bp, Artificial sequence
  SiRNA target sequence
tttataattcattgatatatt

SEQ ID NO: 51939 - DNA, 21 bp, Artificial sequence
  SiRNA target sequence
ttataattcattgatatattc

SEQ ID NO: 51940 - DNA, 21 bp, Artificial sequence
  SiRNA target sequence
tataattcattgatatattct

SEQ ID NO: 51941 - DNA, 21 bp, Artificial sequence
  SiRNA target sequence
ataattcattgatatattctt

SEQ ID NO: 51942 - DNA, 21 bp, Artificial sequence
  SiRNA target sequence
taattcattgatatattctta

SEQ ID NO: 51943 - DNA, 21 bp, Artificial sequence
  SiRNA target sequence
aattcattgatatattcttaa

SEQ ID NO: 51944 - DNA, 21 bp, Artificial sequence
  SiRNA target sequence
attcattgatatattcttaaa

SEQ ID NO: 51945 - DNA, 21 bp, Artificial sequence
  SiRNA target sequence
ttcattgatatattcttaaaa

SEQ ID NO: 51946 - DNA, 21 bp, Artificial sequence
  SiRNA target sequence
tcattgatatattcttaaaag

SEQ ID NO: 51947 - DNA, 21 bp, Artificial sequence
  SiRNA target sequence
cattgatatattcttaaaagt

SEQ ID NO: 51948 - DNA, 21 bp, Artificial sequence
  SiRNA target sequence
attgatatattcttaaaagta

SEQ ID NO: 51949 - DNA, 21 bp, Artificial sequence
  SiRNA target sequence
ttgatatattcttaaaagtaa

SEQ ID NO: 51950 - DNA, 21 bp, Artificial sequence
  SiRNA target sequence
tgatatattcttaaaagtaat

SEQ ID NO: 51951 - DNA, 21 bp, Artificial sequence
  SiRNA target sequence
gatatattcttaaaagtaatc

SEQ ID NO: 51952 - DNA, 21 bp, Artificial sequence
  SiRNA target sequence
atatattcttaaaagtaatct

SEQ ID NO: 51953 - DNA, 21 bp, Artificial sequence
  SiRNA target sequence
tatattcttaaaagtaatcta

SEQ ID NO: 51954 - DNA, 21 bp, Artificial sequence
  SiRNA target sequence
atattcttaaaagtaatctat

SEQ ID NO: 51955 - DNA, 21 bp, Artificial sequence
  SiRNA target sequence
tattcttaaaagtaatctatt

SEQ ID NO: 51956 - DNA, 21 bp, Artificial sequence
  SiRNA target sequence
attcttaaaagtaatctatta

SEQ ID NO: 51957 - DNA, 21 bp, Artificial sequence
  SiRNA target sequence
ttcttaaaagtaatctattaa

SEQ ID NO: 51958 - DNA, 21 bp, Artificial sequence
  SiRNA target sequence
tcttaaaagtaatctattaac

SEQ ID NO: 51959 - DNA, 21 bp, Artificial sequence
  SiRNA target sequence
cttaaaagtaatctattaaca

SEQ ID NO: 51960 - DNA, 21 bp, Artificial sequence
  SiRNA target sequence
ttaaaagtaatctattaacat

SEQ ID NO: 51961 - DNA, 21 bp, Artificial sequence
  SiRNA target sequence
taaaagtaatctattaacatt

SEQ ID NO: 51962 - DNA, 21 bp, Artificial sequence
  SiRNA target sequence
aaaagtaatctattaacatta

SEQ ID NO: 51963 - DNA, 21 bp, Artificial sequence
  SiRNA target sequence
aaagtaatctattaacattaa

SEQ ID NO: 51964 - DNA, 21 bp, Artificial sequence
  SiRNA target sequence
aagtaatctattaacattaaa

SEQ ID NO: 51965 - DNA, 21 bp, Artificial sequence
  SiRNA target sequence
agtaatctattaacattaaat

SEQ ID NO: 51966 - DNA, 21 bp, Artificial sequence
  SiRNA target sequence
gtaatctattaacattaaatt

SEQ ID NO: 51967 - DNA, 21 bp, Artificial sequence
  SiRNA target sequence
taatctattaacattaaatta

SEQ ID NO: 51968 - DNA, 21 bp, Artificial sequence
  SiRNA target sequence
aatctattaacattaaattat

SEQ ID NO: 51969 - DNA, 21 bp, Artificial sequence
  SiRNA target sequence
atctattaacattaaattata

SEQ ID NO: 51970 - DNA, 21 bp, Artificial sequence
  SiRNA target sequence
tctattaacattaaattataa

SEQ ID NO: 51971 - DNA, 21 bp, Artificial sequence
  SiRNA target sequence
ctattaacattaaattataaa

SEQ ID NO: 51972 - DNA, 21 bp, Artificial sequence
  SiRNA target sequence
tattaacattaaattataaaa

SEQ ID NO: 51973 - DNA, 21 bp, Artificial sequence
  SiRNA target sequence
attaacattaaattataaaaa

SEQ ID NO: 51974 - DNA, 21 bp, Artificial sequence
  SiRNA target sequence
ttaacattaaattataaaaat

SEQ ID NO: 51975 - DNA, 21 bp, Artificial sequence
  SiRNA target sequence
taacattaaattataaaaatt

SEQ ID NO: 51976 - DNA, 21 bp, Artificial sequence
  SiRNA target sequence
aacattaaattataaaaattt

SEQ ID NO: 51977 - DNA, 21 bp, Artificial sequence
  SiRNA target sequence
acattaaattataaaaatttt

SEQ ID NO: 51978 - DNA, 21 bp, Artificial sequence
  SiRNA target sequence
cattaaattataaaaattttt

SEQ ID NO: 51979 - DNA, 21 bp, Artificial sequence
  SiRNA target sequence
attaaattataaaaattttta

SEQ ID NO: 51980 - DNA, 21 bp, Artificial sequence
  SiRNA target sequence
ttaaattataaaaatttttat

SEQ ID NO: 51981 - DNA, 21 bp, Artificial sequence
  SiRNA target sequence
taaattataaaaatttttatg

SEQ ID NO: 51982 - DNA, 21 bp, Artificial sequence
  SiRNA target sequence
aaattataaaaatttttatgt

SEQ ID NO: 51983 - DNA, 21 bp, Artificial sequence
  SiRNA target sequence
aattataaaaatttttatgta

SEQ ID NO: 51984 - DNA, 21 bp, Artificial sequence
  SiRNA target sequence
attataaaaatttttatgtac

SEQ ID NO: 51985 - DNA, 21 bp, Artificial sequence
  SiRNA target sequence
ttataaaaatttttatgtact

SEQ ID NO: 51986 - DNA, 21 bp, Artificial sequence
  SiRNA target sequence
tataaaaatttttatgtactt

SEQ ID NO: 51987 - DNA, 21 bp, Artificial sequence
  SiRNA target sequence
ataaaaatttttatgtacttt

SEQ ID NO: 51988 - DNA, 21 bp, Artificial sequence
  SiRNA target sequence
taaaaatttttatgtactttg

SEQ ID NO: 51989 - DNA, 21 bp, Artificial sequence
  SiRNA target sequence
aaaaatttttatgtactttgt

SEQ ID NO: 51990 - DNA, 21 bp, Artificial sequence
  SiRNA target sequence
aaaatttttatgtactttgta

SEQ ID NO: 51991 - DNA, 21 bp, Artificial sequence
  SiRNA target sequence
aaatttttatgtactttgtaa

SEQ ID NO: 51992 - DNA, 21 bp, Artificial sequence
  SiRNA target sequence
aatttttatgtactttgtaat

SEQ ID NO: 51993 - DNA, 21 bp, Artificial sequence
  SiRNA target sequence
atttttatgtactttgtaatt

SEQ ID NO: 51994 - DNA, 21 bp, Artificial sequence
  SiRNA target sequence
tttttatgtactttgtaatta

SEQ ID NO: 51995 - DNA, 21 bp, Artificial sequence
  SiRNA target sequence
ttttatgtactttgtaattac

SEQ ID NO: 51996 - DNA, 21 bp, Artificial sequence
  SiRNA target sequence
tttatgtactttgtaattaca

SEQ ID NO: 51997 - DNA, 21 bp, Artificial sequence
  SiRNA target sequence
ttatgtactttgtaattacat

SEQ ID NO: 51998 - DNA, 21 bp, Artificial sequence
  SiRNA target sequence
tatgtactttgtaattacatt

SEQ ID NO: 51999 - DNA, 21 bp, Artificial sequence
  SiRNA target sequence
atgtactttgtaattacatta

SEQ ID NO: 52000 - DNA, 21 bp, Artificial sequence
  SiRNA target sequence
tgtactttgtaattacattat

SEQ ID NO: 52001 - DNA, 21 bp, Artificial sequence
  SiRNA target sequence
gtactttgtaattacattata

SEQ ID NO: 52002 - DNA, 21 bp, Artificial sequence
  SiRNA target sequence
tactttgtaattacattataa

SEQ ID NO: 52003 - DNA, 21 bp, Artificial sequence
  SiRNA target sequence
actttgtaattacattataac

SEQ ID NO: 52004 - DNA, 21 bp, Artificial sequence
  SiRNA target sequence
ctttgtaattacattataaca

SEQ ID NO: 52005 - DNA, 21 bp, Artificial sequence
  SiRNA target sequence
tttgtaattacattataacac

SEQ ID NO: 52006 - DNA, 21 bp, Artificial sequence
  SiRNA target sequence
ttgtaattacattataacacg

SEQ ID NO: 52007 - DNA, 21 bp, Artificial sequence
  SiRNA target sequence
tgtaattacattataacacga

SEQ ID NO: 52008 - DNA, 21 bp, Artificial sequence
  SiRNA target sequence
gtaattacattataacacgat

SEQ ID NO: 52009 - DNA, 21 bp, Artificial sequence
  SiRNA target sequence
taattacattataacacgata

SEQ ID NO: 52010 - DNA, 21 bp, Artificial sequence
  SiRNA target sequence
aattacattataacacgataa

SEQ ID NO: 52011 - DNA, 21 bp, Artificial sequence
  SiRNA target sequence
attacattataacacgataaa

SEQ ID NO: 52012 - DNA, 21 bp, Artificial sequence
  SiRNA target sequence
ttacattataacacgataaaa

SEQ ID NO: 52013 - DNA, 21 bp, Artificial sequence
  SiRNA target sequence
tacattataacacgataaaaa

SEQ ID NO: 52014 - DNA, 21 bp, Artificial sequence
  SiRNA target sequence
acattataacacgataaaaat

SEQ ID NO: 52015 - DNA, 21 bp, Artificial sequence
  SiRNA target sequence
cattataacacgataaaaata

SEQ ID NO: 52016 - DNA, 21 bp, Artificial sequence
  SiRNA target sequence
attataacacgataaaaataa

SEQ ID NO: 52017 - DNA, 21 bp, Artificial sequence
  SiRNA target sequence
ttataacacgataaaaataat

SEQ ID NO: 52018 - DNA, 21 bp, Artificial sequence
  SiRNA target sequence
tataacacgataaaaataata

SEQ ID NO: 52019 - DNA, 21 bp, Artificial sequence
  SiRNA target sequence
ataacacgataaaaataataa

SEQ ID NO: 52020 - DNA, 21 bp, Artificial sequence
  SiRNA target sequence
taacacgataaaaataataat

SEQ ID NO: 52021 - DNA, 21 bp, Artificial sequence
  SiRNA target sequence
aacacgataaaaataataata

SEQ ID NO: 52022 - DNA, 21 bp, Artificial sequence
  SiRNA target sequence
acacgataaaaataataatac

SEQ ID NO: 52023 - DNA, 21 bp, Artificial sequence
  SiRNA target sequence
cacgataaaaataataataca

SEQ ID NO: 52024 - DNA, 21 bp, Artificial sequence
  SiRNA target sequence
acgataaaaataataatacac

SEQ ID NO: 52025 - DNA, 21 bp, Artificial sequence
  SiRNA target sequence
cgataaaaataataatacact

SEQ ID NO: 52026 - DNA, 21 bp, Artificial sequence
  SiRNA target sequence
gataaaaataataatacactt

SEQ ID NO: 52027 - DNA, 21 bp, Artificial sequence
  SiRNA target sequence
ataaaaataataatacacttt

SEQ ID NO: 52028 - DNA, 21 bp, Artificial sequence
  SiRNA target sequence
taaaaataataatacactttt

SEQ ID NO: 52029 - DNA, 21 bp, Artificial sequence
  SiRNA target sequence
aaaaataataatacacttttg

SEQ ID NO: 52030 - DNA, 21 bp, Artificial sequence
  SiRNA target sequence
aaaataataatacacttttgt

SEQ ID NO: 52031 - DNA, 21 bp, Artificial sequence
  SiRNA target sequence
aaataataatacacttttgta

SEQ ID NO: 52032 - DNA, 21 bp, Artificial sequence
  SiRNA target sequence
aataataatacacttttgtat

SEQ ID NO: 52033 - DNA, 21 bp, Artificial sequence
  SiRNA target sequence
ataataatacacttttgtatt

SEQ ID NO: 52034 - DNA, 21 bp, Artificial sequence
  SiRNA target sequence
taataatacacttttgtattt

SEQ ID NO: 52035 - DNA, 21 bp, Artificial sequence
  SiRNA target sequence
aataatacacttttgtattta

SEQ ID NO: 52036 - DNA, 21 bp, Artificial sequence
  SiRNA target sequence
ataatacacttttgtatttat

SEQ ID NO: 52037 - DNA, 21 bp, Artificial sequence
  SiRNA target sequence
taatacacttttgtatttatc

SEQ ID NO: 52038 - DNA, 21 bp, Artificial sequence
  SiRNA target sequence
aatacacttttgtatttatct

SEQ ID NO: 52039 - DNA, 21 bp, Artificial sequence
  SiRNA target sequence
atacacttttgtatttatcta

SEQ ID NO: 52040 - DNA, 21 bp, Artificial sequence
  SiRNA target sequence
tacacttttgtatttatctaa

SEQ ID NO: 52041 - DNA, 21 bp, Artificial sequence
  SiRNA target sequence
acacttttgtatttatctaat

SEQ ID NO: 52042 - DNA, 21 bp, Artificial sequence
  SiRNA target sequence
cacttttgtatttatctaata

SEQ ID NO: 52043 - DNA, 21 bp, Artificial sequence
  SiRNA target sequence
acttttgtatttatctaatag

SEQ ID NO: 52044 - DNA, 21 bp, Artificial sequence
  SiRNA target sequence
cttttgtatttatctaataga

SEQ ID NO: 52045 - DNA, 21 bp, Artificial sequence
  SiRNA target sequence
ttttgtatttatctaatagat

SEQ ID NO: 52046 - DNA, 21 bp, Artificial sequence
  SiRNA target sequence
tttgtatttatctaatagatt

SEQ ID NO: 52047 - DNA, 21 bp, Artificial sequence
  SiRNA target sequence
ttgtatttatctaatagattt

SEQ ID NO: 52048 - DNA, 21 bp, Artificial sequence
  SiRNA target sequence
tgtatttatctaatagattta

SEQ ID NO: 52049 - DNA, 21 bp, Artificial sequence
  SiRNA target sequence
gtatttatctaatagatttat

SEQ ID NO: 52050 - DNA, 21 bp, Artificial sequence
  SiRNA target sequence
tatttatctaatagatttata

SEQ ID NO: 52051 - DNA, 21 bp, Artificial sequence
  SiRNA target sequence
atttatctaatagatttatat

SEQ ID NO: 52052 - DNA, 21 bp, Artificial sequence
  SiRNA target sequence
tttatctaatagatttatata

SEQ ID NO: 52053 - DNA, 21 bp, Artificial sequence
  SiRNA target sequence
ttatctaatagatttatataa

SEQ ID NO: 52054 - DNA, 21 bp, Artificial sequence
  SiRNA target sequence
tatctaatagatttatataat

SEQ ID NO: 52055 - DNA, 21 bp, Artificial sequence
  SiRNA target sequence
atctaatagatttatataata

SEQ ID NO: 52056 - DNA, 21 bp, Artificial sequence
  SiRNA target sequence
tctaatagatttatataataa

SEQ ID NO: 52057 - DNA, 21 bp, Artificial sequence
  SiRNA target sequence
ctaatagatttatataataaa

SEQ ID NO: 52058 - DNA, 21 bp, Artificial sequence
  SiRNA target sequence
taatagatttatataataaac

SEQ ID NO: 52059 - DNA, 21 bp, Artificial sequence
  SiRNA target sequence
aatagatttatataataaaca

SEQ ID NO: 52060 - DNA, 21 bp, Artificial sequence
  SiRNA target sequence
atagatttatataataaacat

SEQ ID NO: 52061 - DNA, 21 bp, Artificial sequence
  SiRNA target sequence
tagatttatataataaacatt

SEQ ID NO: 52062 - DNA, 21 bp, Artificial sequence
  SiRNA target sequence
agatttatataataaacatta

SEQ ID NO: 52063 - DNA, 21 bp, Artificial sequence
  SiRNA target sequence
gatttatataataaacattaa

SEQ ID NO: 52064 - DNA, 21 bp, Artificial sequence
  SiRNA target sequence
atttatataataaacattaat

SEQ ID NO: 52065 - DNA, 21 bp, Artificial sequence
  SiRNA target sequence
tttatataataaacattaatg

SEQ ID NO: 52066 - DNA, 21 bp, Artificial sequence
  SiRNA target sequence
ttatataataaacattaatga

SEQ ID NO: 52067 - DNA, 21 bp, Artificial sequence
  SiRNA target sequence
tatataataaacattaatgat

SEQ ID NO: 52068 - DNA, 21 bp, Artificial sequence
  SiRNA target sequence
atataataaacattaatgatt

SEQ ID NO: 52069 - DNA, 21 bp, Artificial sequence
  SiRNA target sequence
tataataaacattaatgattc

SEQ ID NO: 52070 - DNA, 21 bp, Artificial sequence
  SiRNA target sequence
ataataaacattaatgattct

SEQ ID NO: 52071 - DNA, 21 bp, Artificial sequence
  SiRNA target sequence
taataaacattaatgattctt

SEQ ID NO: 52072 - DNA, 21 bp, Artificial sequence
  SiRNA target sequence
aataaacattaatgattcttt

SEQ ID NO: 52073 - DNA, 21 bp, Artificial sequence
  SiRNA target sequence
ataaacattaatgattctttt

SEQ ID NO: 52074 - DNA, 21 bp, Artificial sequence
  SiRNA target sequence
taaacattaatgattcttttt

SEQ ID NO: 52075 - DNA, 21 bp, Artificial sequence
  SiRNA target sequence
aaacattaatgattcttttta

SEQ ID NO: 52076 - DNA, 21 bp, Artificial sequence
  SiRNA target sequence
aacattaatgattctttttaa

SEQ ID NO: 52077 - DNA, 21 bp, Artificial sequence
  SiRNA target sequence
acattaatgattctttttaat

SEQ ID NO: 52078 - DNA, 21 bp, Artificial sequence
  SiRNA target sequence
cattaatgattctttttaatt

SEQ ID NO: 52079 - DNA, 21 bp, Artificial sequence
  SiRNA target sequence
attaatgattctttttaattg

SEQ ID NO: 52080 - DNA, 21 bp, Artificial sequence
  SiRNA target sequence
ttaatgattctttttaattgt

SEQ ID NO: 52081 - DNA, 21 bp, Artificial sequence
  SiRNA target sequence
taatgattctttttaattgtt

SEQ ID NO: 52082 - DNA, 21 bp, Artificial sequence
  SiRNA target sequence
aatgattctttttaattgtta

SEQ ID NO: 52083 - DNA, 21 bp, Artificial sequence
  SiRNA target sequence
atgattctttttaattgttac

SEQ ID NO: 52084 - DNA, 21 bp, Artificial sequence
  SiRNA target sequence
tgattctttttaattgttact

SEQ ID NO: 52085 - DNA, 21 bp, Artificial sequence
  SiRNA target sequence
gattctttttaattgttacta

SEQ ID NO: 52086 - DNA, 21 bp, Artificial sequence
  SiRNA target sequence
attctttttaattgttactaa

SEQ ID NO: 52087 - DNA, 21 bp, Artificial sequence
  SiRNA target sequence
ttctttttaattgttactaat

SEQ ID NO: 52088 - DNA, 21 bp, Artificial sequence
  SiRNA target sequence
tctttttaattgttactaatt

SEQ ID NO: 52089 - DNA, 21 bp, Artificial sequence
  SiRNA target sequence
ctttttaattgttactaattt

SEQ ID NO: 52090 - DNA, 21 bp, Artificial sequence
  SiRNA target sequence
tttttaattgttactaattta

SEQ ID NO: 52091 - DNA, 21 bp, Artificial sequence
  SiRNA target sequence
ttttaattgttactaatttat

SEQ ID NO: 52092 - DNA, 21 bp, Artificial sequence
  SiRNA target sequence
tttaattgttactaatttatg

SEQ ID NO: 52093 - DNA, 21 bp, Artificial sequence
  SiRNA target sequence
ttaattgttactaatttatgc

SEQ ID NO: 52094 - DNA, 21 bp, Artificial sequence
  SiRNA target sequence
taattgttactaatttatgcc

SEQ ID NO: 52095 - DNA, 21 bp, Artificial sequence
  SiRNA target sequence
aattgttactaatttatgcca

SEQ ID NO: 52096 - DNA, 21 bp, Artificial sequence
  SiRNA target sequence
attgttactaatttatgccat

SEQ ID NO: 52097 - DNA, 21 bp, Artificial sequence
  SiRNA target sequence
ttgttactaatttatgccata

SEQ ID NO: 52098 - DNA, 21 bp, Artificial sequence
  SiRNA target sequence
tgttactaatttatgccatat

SEQ ID NO: 52099 - DNA, 21 bp, Artificial sequence
  SiRNA target sequence
gttactaatttatgccatata

SEQ ID NO: 52100 - DNA, 21 bp, Artificial sequence
  SiRNA target sequence
ttactaatttatgccatatat

SEQ ID NO: 52101 - DNA, 21 bp, Artificial sequence
  SiRNA target sequence
tactaatttatgccatatatt

SEQ ID NO: 52102 - DNA, 21 bp, Artificial sequence
  SiRNA target sequence
actaatttatgccatatatta

SEQ ID NO: 52103 - DNA, 21 bp, Artificial sequence
  SiRNA target sequence
ctaatttatgccatatattat

SEQ ID NO: 52104 - DNA, 21 bp, Artificial sequence
  SiRNA target sequence
taatttatgccatatattata

SEQ ID NO: 52105 - DNA, 21 bp, Artificial sequence
  SiRNA target sequence
aatttatgccatatattatat

SEQ ID NO: 52106 - DNA, 21 bp, Artificial sequence
  SiRNA target sequence
atttatgccatatattatata

SEQ ID NO: 52107 - DNA, 21 bp, Artificial sequence
  SiRNA target sequence
tttatgccatatattatatac

SEQ ID NO: 52108 - DNA, 21 bp, Artificial sequence
  SiRNA target sequence
ttatgccatatattatataca

SEQ ID NO: 52109 - DNA, 21 bp, Artificial sequence
  SiRNA target sequence
tatgccatatattatatacat

SEQ ID NO: 52110 - DNA, 21 bp, Artificial sequence
  SiRNA target sequence
atgccatatattatatacatt

SEQ ID NO: 52111 - DNA, 21 bp, Artificial sequence
  SiRNA target sequence
tgccatatattatatacattt

SEQ ID NO: 52112 - DNA, 21 bp, Artificial sequence
  SiRNA target sequence
gccatatattatatacatttc

SEQ ID NO: 52113 - DNA, 21 bp, Artificial sequence
  SiRNA target sequence
ccatatattatatacatttct

SEQ ID NO: 52114 - DNA, 21 bp, Artificial sequence
  SiRNA target sequence
catatattatatacatttcta

SEQ ID NO: 52115 - DNA, 21 bp, Artificial sequence
  SiRNA target sequence
atatattatatacatttctaa

SEQ ID NO: 52116 - DNA, 21 bp, Artificial sequence
  SiRNA target sequence
tatattatatacatttctaaa

SEQ ID NO: 52117 - DNA, 21 bp, Artificial sequence
  SiRNA target sequence
atattatatacatttctaaaa

SEQ ID NO: 52118 - DNA, 21 bp, Artificial sequence
  SiRNA target sequence
tattatatacatttctaaaat

SEQ ID NO: 52119 - DNA, 21 bp, Artificial sequence
  SiRNA target sequence
attatatacatttctaaaatt

SEQ ID NO: 52120 - DNA, 21 bp, Artificial sequence
  SiRNA target sequence
ttatatacatttctaaaatta

SEQ ID NO: 52121 - DNA, 21 bp, Artificial sequence
  SiRNA target sequence
tatatacatttctaaaattaa

SEQ ID NO: 52122 - DNA, 21 bp, Artificial sequence
  SiRNA target sequence
atatacatttctaaaattaaa

SEQ ID NO: 52123 - DNA, 21 bp, Artificial sequence
  SiRNA target sequence
tatacatttctaaaattaaat

SEQ ID NO: 52124 - DNA, 21 bp, Artificial sequence
  SiRNA target sequence
atacatttctaaaattaaatc

SEQ ID NO: 52125 - DNA, 21 bp, Artificial sequence
  SiRNA target sequence
tacatttctaaaattaaatca

SEQ ID NO: 52126 - DNA, 21 bp, Artificial sequence
  SiRNA target sequence
acatttctaaaattaaatcaa

SEQ ID NO: 52127 - DNA, 21 bp, Artificial sequence
  SiRNA target sequence
catttctaaaattaaatcaaa

SEQ ID NO: 52128 - DNA, 21 bp, Artificial sequence
  SiRNA target sequence
atttctaaaattaaatcaaaa

SEQ ID NO: 52129 - DNA, 21 bp, Artificial sequence
  SiRNA target sequence
tttctaaaattaaatcaaaaa

SEQ ID NO: 52130 - DNA, 21 bp, Artificial sequence
  SiRNA target sequence
ttctaaaattaaatcaaaaaa

SEQ ID NO: 52131 - DNA, 21 bp, Artificial sequence
  SiRNA target sequence
tctaaaattaaatcaaaaaag

SEQ ID NO: 52132 - DNA, 21 bp, Artificial sequence
  SiRNA target sequence
ctaaaattaaatcaaaaaagt

SEQ ID NO: 52133 - DNA, 21 bp, Artificial sequence
  SiRNA target sequence
taaaattaaatcaaaaaagtt

SEQ ID NO: 52134 - DNA, 21 bp, Artificial sequence
  SiRNA target sequence
aaaattaaatcaaaaaagtta

SEQ ID NO: 52135 - DNA, 21 bp, Artificial sequence
  SiRNA target sequence
aaattaaatcaaaaaagttat

SEQ ID NO: 52136 - DNA, 21 bp, Artificial sequence
  SiRNA target sequence
aattaaatcaaaaaagttatt

SEQ ID NO: 52137 - DNA, 21 bp, Artificial sequence
  SiRNA target sequence
attaaatcaaaaaagttattt

SEQ ID NO: 52138 - DNA, 21 bp, Artificial sequence
  SiRNA target sequence
ttaaatcaaaaaagttattta

SEQ ID NO: 52139 - DNA, 21 bp, Artificial sequence
  SiRNA target sequence
taaatcaaaaaagttatttat

SEQ ID NO: 52140 - DNA, 21 bp, Artificial sequence
  SiRNA target sequence
aaatcaaaaaagttatttatt

SEQ ID NO: 52141 - DNA, 21 bp, Artificial sequence
  SiRNA target sequence
aatcaaaaaagttatttattc

SEQ ID NO: 52142 - DNA, 21 bp, Artificial sequence
  SiRNA target sequence
atcaaaaaagttatttattct

SEQ ID NO: 52143 - DNA, 21 bp, Artificial sequence
  SiRNA target sequence
tcaaaaaagttatttattctt

SEQ ID NO: 52144 - DNA, 21 bp, Artificial sequence
  SiRNA target sequence
caaaaaagttatttattcttg

SEQ ID NO: 52145 - DNA, 21 bp, Artificial sequence
  SiRNA target sequence
aaaaaagttatttattcttga

SEQ ID NO: 52146 - DNA, 21 bp, Artificial sequence
  SiRNA target sequence
aaaaagttatttattcttgag

SEQ ID NO: 52147 - DNA, 21 bp, Artificial sequence
  SiRNA target sequence
aaaagttatttattcttgagg

SEQ ID NO: 52148 - DNA, 21 bp, Artificial sequence
  SiRNA target sequence
aaagttatttattcttgagga

SEQ ID NO: 52149 - DNA, 21 bp, Artificial sequence
  SiRNA target sequence
aagttatttattcttgaggag

SEQ ID NO: 52150 - DNA, 21 bp, Artificial sequence
  SiRNA target sequence
agttatttattcttgaggagc

SEQ ID NO: 52151 - DNA, 21 bp, Artificial sequence
  SiRNA target sequence
gttatttattcttgaggagca

SEQ ID NO: 52152 - DNA, 21 bp, Artificial sequence
  SiRNA target sequence
ttatttattcttgaggagcaa

SEQ ID NO: 52153 - DNA, 21 bp, Artificial sequence
  SiRNA target sequence
tatttattcttgaggagcaat

SEQ ID NO: 52154 - DNA, 21 bp, Artificial sequence
  SiRNA target sequence
atttattcttgaggagcaatt

SEQ ID NO: 52155 - DNA, 21 bp, Artificial sequence
  SiRNA target sequence
tttattcttgaggagcaattt

SEQ ID NO: 52156 - DNA, 21 bp, Artificial sequence
  SiRNA target sequence
ttattcttgaggagcaatttt

SEQ ID NO: 52157 - DNA, 21 bp, Artificial sequence
  SiRNA target sequence
tattcttgaggagcaattttt

SEQ ID NO: 52158 - DNA, 21 bp, Artificial sequence
  SiRNA target sequence
attcttgaggagcaatttttt

SEQ ID NO: 52159 - DNA, 21 bp, Artificial sequence
  SiRNA target sequence
ttcttgaggagcaattttttc

SEQ ID NO: 52160 - DNA, 21 bp, Artificial sequence
  SiRNA target sequence
tcttgaggagcaattttttct

SEQ ID NO: 52161 - DNA, 21 bp, Artificial sequence
  SiRNA target sequence
cttgaggagcaattttttctt

SEQ ID NO: 52162 - DNA, 21 bp, Artificial sequence
  SiRNA target sequence
ttgaggagcaattttttctta

SEQ ID NO: 52163 - DNA, 21 bp, Artificial sequence
  SiRNA target sequence
tgaggagcaattttttcttat

SEQ ID NO: 52164 - DNA, 21 bp, Artificial sequence
  SiRNA target sequence
gaggagcaattttttcttatt

SEQ ID NO: 52165 - DNA, 21 bp, Artificial sequence
  SiRNA target sequence
aggagcaattttttcttattt

SEQ ID NO: 52166 - DNA, 21 bp, Artificial sequence
  SiRNA target sequence
ggagcaattttttcttattta

SEQ ID NO: 52167 - DNA, 21 bp, Artificial sequence
  SiRNA target sequence
gagcaattttttcttatttaa

SEQ ID NO: 52168 - DNA, 21 bp, Artificial sequence
  SiRNA target sequence
agcaattttttcttatttaaa

SEQ ID NO: 52169 - DNA, 21 bp, Artificial sequence
  SiRNA target sequence
gcaattttttcttatttaaaa

SEQ ID NO: 52170 - DNA, 21 bp, Artificial sequence
  SiRNA target sequence
caattttttcttatttaaaaa

SEQ ID NO: 52171 - DNA, 21 bp, Artificial sequence
  SiRNA target sequence
aattttttcttatttaaaaat

SEQ ID NO: 52172 - DNA, 21 bp, Artificial sequence
  SiRNA target sequence
attttttcttatttaaaaatt

SEQ ID NO: 52173 - DNA, 21 bp, Artificial sequence
  SiRNA target sequence
ttttttcttatttaaaaattt

SEQ ID NO: 52174 - DNA, 21 bp, Artificial sequence
  SiRNA target sequence
tttttcttatttaaaaatttt

SEQ ID NO: 52175 - DNA, 21 bp, Artificial sequence
  SiRNA target sequence
ttttcttatttaaaaattttc

SEQ ID NO: 52176 - DNA, 21 bp, Artificial sequence
  SiRNA target sequence
tttcttatttaaaaattttct

SEQ ID NO: 52177 - DNA, 21 bp, Artificial sequence
  SiRNA target sequence
ttcttatttaaaaattttcta

SEQ ID NO: 52178 - DNA, 21 bp, Artificial sequence
  SiRNA target sequence
tcttatttaaaaattttctaa

SEQ ID NO: 52179 - DNA, 21 bp, Artificial sequence
  SiRNA target sequence
cttatttaaaaattttctaat

SEQ ID NO: 52180 - DNA, 21 bp, Artificial sequence
  SiRNA target sequence
ttatttaaaaattttctaatc

SEQ ID NO: 52181 - DNA, 21 bp, Artificial sequence
  SiRNA target sequence
tatttaaaaattttctaatct

SEQ ID NO: 52182 - DNA, 21 bp, Artificial sequence
  SiRNA target sequence
atttaaaaattttctaatctg

SEQ ID NO: 52183 - DNA, 21 bp, Artificial sequence
  SiRNA target sequence
tttaaaaattttctaatctgt

SEQ ID NO: 52184 - DNA, 21 bp, Artificial sequence
  SiRNA target sequence
ttaaaaattttctaatctgta

SEQ ID NO: 52185 - DNA, 21 bp, Artificial sequence
  SiRNA target sequence
taaaaattttctaatctgtaa

SEQ ID NO: 52186 - DNA, 21 bp, Artificial sequence
  SiRNA target sequence
aaaaattttctaatctgtaaa

SEQ ID NO: 52187 - DNA, 21 bp, Artificial sequence
  SiRNA target sequence
aaaattttctaatctgtaaat

SEQ ID NO: 52188 - DNA, 21 bp, Artificial sequence
  SiRNA target sequence
aaattttctaatctgtaaatt

SEQ ID NO: 52189 - DNA, 21 bp, Artificial sequence
  SiRNA target sequence
aattttctaatctgtaaatta

SEQ ID NO: 52190 - DNA, 21 bp, Artificial sequence
  SiRNA target sequence
attttctaatctgtaaattag

SEQ ID NO: 52191 - DNA, 21 bp, Artificial sequence
  SiRNA target sequence
ttttctaatctgtaaattagt

SEQ ID NO: 52192 - DNA, 21 bp, Artificial sequence
  SiRNA target sequence
tttctaatctgtaaattagtg

SEQ ID NO: 52193 - DNA, 21 bp, Artificial sequence
  SiRNA target sequence
ttctaatctgtaaattagtga

SEQ ID NO: 52194 - DNA, 21 bp, Artificial sequence
  SiRNA target sequence
tctaatctgtaaattagtgat

SEQ ID NO: 52195 - DNA, 21 bp, Artificial sequence
  SiRNA target sequence
ctaatctgtaaattagtgatt

SEQ ID NO: 52196 - DNA, 21 bp, Artificial sequence
  SiRNA target sequence
taatctgtaaattagtgattg

SEQ ID NO: 52197 - DNA, 21 bp, Artificial sequence
  SiRNA target sequence
aatctgtaaattagtgattga

SEQ ID NO: 52198 - DNA, 21 bp, Artificial sequence
  SiRNA target sequence
atctgtaaattagtgattgat

SEQ ID NO: 52199 - DNA, 21 bp, Artificial sequence
  SiRNA target sequence
tctgtaaattagtgattgatc

SEQ ID NO: 52200 - DNA, 21 bp, Artificial sequence
  SiRNA target sequence
ctgtaaattagtgattgatca

SEQ ID NO: 52201 - DNA, 21 bp, Artificial sequence
  SiRNA target sequence
tgtaaattagtgattgatcaa

SEQ ID NO: 52202 - DNA, 21 bp, Artificial sequence
  SiRNA target sequence
gtaaattagtgattgatcaat

SEQ ID NO: 52203 - DNA, 21 bp, Artificial sequence
  SiRNA target sequence
taaattagtgattgatcaata

SEQ ID NO: 52204 - DNA, 21 bp, Artificial sequence
  SiRNA target sequence
aaattagtgattgatcaataa

SEQ ID NO: 52205 - DNA, 21 bp, Artificial sequence
  SiRNA target sequence
aattagtgattgatcaataaa

SEQ ID NO: 52206 - DNA, 21 bp, Artificial sequence
  SiRNA target sequence
attagtgattgatcaataaat

SEQ ID NO: 52207 - DNA, 21 bp, Artificial sequence
  SiRNA target sequence
ttagtgattgatcaataaatt

SEQ ID NO: 52208 - DNA, 21 bp, Artificial sequence
  SiRNA target sequence
tagtgattgatcaataaatta

SEQ ID NO: 52209 - DNA, 21 bp, Artificial sequence
  SiRNA target sequence
agtgattgatcaataaattac

SEQ ID NO: 52210 - DNA, 21 bp, Artificial sequence
  SiRNA target sequence
gtgattgatcaataaattact

SEQ ID NO: 52211 - DNA, 21 bp, Artificial sequence
  SiRNA target sequence
tgattgatcaataaattactg

SEQ ID NO: 52212 - DNA, 21 bp, Artificial sequence
  SiRNA target sequence
gattgatcaataaattactga

SEQ ID NO: 52213 - DNA, 21 bp, Artificial sequence
  SiRNA target sequence
attgatcaataaattactgat

SEQ ID NO: 52214 - DNA, 21 bp, Artificial sequence
  SiRNA target sequence
ttgatcaataaattactgatt

SEQ ID NO: 52215 - DNA, 21 bp, Artificial sequence
  SiRNA target sequence
tgatcaataaattactgattt

SEQ ID NO: 52216 - DNA, 21 bp, Artificial sequence
  SiRNA target sequence
gatcaataaattactgattta

SEQ ID NO: 52217 - DNA, 21 bp, Artificial sequence
  SiRNA target sequence
atcaataaattactgatttat

SEQ ID NO: 52218 - DNA, 21 bp, Artificial sequence
  SiRNA target sequence
tcaataaattactgatttatt

SEQ ID NO: 52219 - DNA, 21 bp, Artificial sequence
  SiRNA target sequence
caataaattactgatttatta

SEQ ID NO: 52220 - DNA, 21 bp, Artificial sequence
  SiRNA target sequence
aataaattactgatttattaa

SEQ ID NO: 52221 - DNA, 21 bp, Artificial sequence
  SiRNA target sequence
ataaattactgatttattaaa

SEQ ID NO: 52222 - DNA, 21 bp, Artificial sequence
  SiRNA target sequence
taaattactgatttattaaat

SEQ ID NO: 52223 - DNA, 21 bp, Artificial sequence
  SiRNA target sequence
aaattactgatttattaaatg

SEQ ID NO: 52224 - DNA, 21 bp, Artificial sequence
  SiRNA target sequence
aattactgatttattaaatga

SEQ ID NO: 52225 - DNA, 21 bp, Artificial sequence
  SiRNA target sequence
attactgatttattaaatgat

SEQ ID NO: 52226 - DNA, 21 bp, Artificial sequence
  SiRNA target sequence
ttactgatttattaaatgatt

SEQ ID NO: 52227 - DNA, 21 bp, Artificial sequence
  SiRNA target sequence
tactgatttattaaatgattt

SEQ ID NO: 52228 - DNA, 21 bp, Artificial sequence
  SiRNA target sequence
actgatttattaaatgatttt

SEQ ID NO: 52229 - DNA, 21 bp, Artificial sequence
  SiRNA target sequence
ctgatttattaaatgattttt

SEQ ID NO: 52230 - DNA, 21 bp, Artificial sequence
  SiRNA target sequence
tgatttattaaatgatttttt

SEQ ID NO: 52231 - DNA, 21 bp, Artificial sequence
  SiRNA target sequence
gatttattaaatgattttttt

SEQ ID NO: 52232 - DNA, 21 bp, Artificial sequence
  SiRNA target sequence
atttattaaatgatttttttg

SEQ ID NO: 52233 - DNA, 21 bp, Artificial sequence
  SiRNA target sequence
tttattaaatgatttttttga

SEQ ID NO: 52234 - DNA, 21 bp, Artificial sequence
  SiRNA target sequence
ttattaaatgatttttttgaa

SEQ ID NO: 52235 - DNA, 21 bp, Artificial sequence
  SiRNA target sequence
tattaaatgatttttttgaac

SEQ ID NO: 52236 - DNA, 21 bp, Artificial sequence
  SiRNA target sequence
attaaatgatttttttgaacc

SEQ ID NO: 52237 - DNA, 21 bp, Artificial sequence
  SiRNA target sequence
ttaaatgatttttttgaaccc

SEQ ID NO: 52238 - DNA, 21 bp, Artificial sequence
  SiRNA target sequence
taaatgatttttttgaaccct

SEQ ID NO: 52239 - DNA, 21 bp, Artificial sequence
  SiRNA target sequence
aaatgatttttttgaaccctt

SEQ ID NO: 52240 - DNA, 21 bp, Artificial sequence
  SiRNA target sequence
aatgatttttttgaacccttg

SEQ ID NO: 52241 - DNA, 21 bp, Artificial sequence
  SiRNA target sequence
atgatttttttgaacccttgt

SEQ ID NO: 52242 - DNA, 21 bp, Artificial sequence
  SiRNA target sequence
tgatttttttgaacccttgtt

SEQ ID NO: 52243 - DNA, 21 bp, Artificial sequence
  SiRNA target sequence
gatttttttgaacccttgtta

SEQ ID NO: 52244 - DNA, 21 bp, Artificial sequence
  SiRNA target sequence
atttttttgaacccttgttaa

SEQ ID NO: 52245 - DNA, 21 bp, Artificial sequence
  SiRNA target sequence
tttttttgaacccttgttaaa

SEQ ID NO: 52246 - DNA, 21 bp, Artificial sequence
  SiRNA target sequence
ttttttgaacccttgttaaaa

SEQ ID NO: 52247 - DNA, 21 bp, Artificial sequence
  SiRNA target sequence
tttttgaacccttgttaaaaa

SEQ ID NO: 52248 - DNA, 21 bp, Artificial sequence
  SiRNA target sequence
ttttgaacccttgttaaaaaa

SEQ ID NO: 52249 - DNA, 21 bp, Artificial sequence
  SiRNA target sequence
tttgaacccttgttaaaaaat

SEQ ID NO: 52250 - DNA, 21 bp, Artificial sequence
  SiRNA target sequence
ttgaacccttgttaaaaaatt

SEQ ID NO: 52251 - DNA, 21 bp, Artificial sequence
  SiRNA target sequence
tgaacccttgttaaaaaatta

SEQ ID NO: 52252 - DNA, 21 bp, Artificial sequence
  SiRNA target sequence
gaacccttgttaaaaaattat

SEQ ID NO: 52253 - DNA, 21 bp, Artificial sequence
  SiRNA target sequence
aacccttgttaaaaaattatt

SEQ ID NO: 52254 - DNA, 21 bp, Artificial sequence
  SiRNA target sequence
acccttgttaaaaaattattt

SEQ ID NO: 52255 - DNA, 21 bp, Artificial sequence
  SiRNA target sequence
cccttgttaaaaaattattta

SEQ ID NO: 52256 - DNA, 21 bp, Artificial sequence
  SiRNA target sequence
ccttgttaaaaaattatttat

SEQ ID NO: 52257 - DNA, 21 bp, Artificial sequence
  SiRNA target sequence
cttgttaaaaaattatttatt

SEQ ID NO: 52258 - DNA, 21 bp, Artificial sequence
  SiRNA target sequence
ttgttaaaaaattatttattt

SEQ ID NO: 52259 - DNA, 21 bp, Artificial sequence
  SiRNA target sequence
tgttaaaaaattatttatttt

SEQ ID NO: 52260 - DNA, 21 bp, Artificial sequence
  SiRNA target sequence
gttaaaaaattatttatttta

SEQ ID NO: 52261 - DNA, 21 bp, Artificial sequence
  SiRNA target sequence
ttaaaaaattatttattttaa

SEQ ID NO: 52262 - DNA, 21 bp, Artificial sequence
  SiRNA target sequence
taaaaaattatttattttaat

SEQ ID NO: 52263 - DNA, 21 bp, Artificial sequence
  SiRNA target sequence
aaaaaattatttattttaatt

SEQ ID NO: 52264 - DNA, 21 bp, Artificial sequence
  SiRNA target sequence
aaaaattatttattttaattt

SEQ ID NO: 52265 - DNA, 21 bp, Artificial sequence
  SiRNA target sequence
aaaattatttattttaatttg

SEQ ID NO: 52266 - DNA, 21 bp, Artificial sequence
  SiRNA target sequence
aaattatttattttaatttga

SEQ ID NO: 52267 - DNA, 21 bp, Artificial sequence
  SiRNA target sequence
aattatttattttaatttgat

SEQ ID NO: 52268 - DNA, 21 bp, Artificial sequence
  SiRNA target sequence
attatttattttaatttgata

SEQ ID NO: 52269 - DNA, 21 bp, Artificial sequence
  SiRNA target sequence
ttatttattttaatttgataa

SEQ ID NO: 52270 - DNA, 21 bp, Artificial sequence
  SiRNA target sequence
tatttattttaatttgataat

SEQ ID NO: 52271 - DNA, 21 bp, Artificial sequence
  SiRNA target sequence
atttattttaatttgataata

SEQ ID NO: 52272 - DNA, 21 bp, Artificial sequence
  SiRNA target sequence
tttattttaatttgataatat

SEQ ID NO: 52273 - DNA, 21 bp, Artificial sequence
  SiRNA target sequence
ttattttaatttgataatata

SEQ ID NO: 52274 - DNA, 21 bp, Artificial sequence
  SiRNA target sequence
tattttaatttgataatatat

SEQ ID NO: 52275 - DNA, 21 bp, Artificial sequence
  SiRNA target sequence
attttaatttgataatatatc

SEQ ID NO: 52276 - DNA, 21 bp, Artificial sequence
  SiRNA target sequence
ttttaatttgataatatatca

SEQ ID NO: 52277 - DNA, 21 bp, Artificial sequence
  SiRNA target sequence
tttaatttgataatatatcaa

SEQ ID NO: 52278 - DNA, 21 bp, Artificial sequence
  SiRNA target sequence
ttaatttgataatatatcaat

SEQ ID NO: 52279 - DNA, 21 bp, Artificial sequence
  SiRNA target sequence
taatttgataatatatcaata

SEQ ID NO: 52280 - DNA, 21 bp, Artificial sequence
  SiRNA target sequence
aatttgataatatatcaatat

SEQ ID NO: 52281 - DNA, 21 bp, Artificial sequence
  SiRNA target sequence
atttgataatatatcaatatg

SEQ ID NO: 52282 - DNA, 21 bp, Artificial sequence
  SiRNA target sequence
tttgataatatatcaatatgt

SEQ ID NO: 52283 - DNA, 21 bp, Artificial sequence
  SiRNA target sequence
ttgataatatatcaatatgtt

SEQ ID NO: 52284 - DNA, 21 bp, Artificial sequence
  SiRNA target sequence
tgataatatatcaatatgttt

SEQ ID NO: 52285 - DNA, 21 bp, Artificial sequence
  SiRNA target sequence
gataatatatcaatatgtttt

SEQ ID NO: 52286 - DNA, 21 bp, Artificial sequence
  SiRNA target sequence
ataatatatcaatatgttttg

SEQ ID NO: 52287 - DNA, 21 bp, Artificial sequence
  SiRNA target sequence
taatatatcaatatgttttgt

SEQ ID NO: 52288 - DNA, 21 bp, Artificial sequence
  SiRNA target sequence
aatatatcaatatgttttgta

SEQ ID NO: 52289 - DNA, 21 bp, Artificial sequence
  SiRNA target sequence
atatatcaatatgttttgtac

SEQ ID NO: 52290 - DNA, 21 bp, Artificial sequence
  SiRNA target sequence
tatatcaatatgttttgtact

SEQ ID NO: 52291 - DNA, 21 bp, Artificial sequence
  SiRNA target sequence
atatcaatatgttttgtactt

SEQ ID NO: 52292 - DNA, 21 bp, Artificial sequence
  SiRNA target sequence
tatcaatatgttttgtacttt

SEQ ID NO: 52293 - DNA, 21 bp, Artificial sequence
  SiRNA target sequence
atcaatatgttttgtacttta

SEQ ID NO: 52294 - DNA, 21 bp, Artificial sequence
  SiRNA target sequence
tcaatatgttttgtactttat

SEQ ID NO: 52295 - DNA, 21 bp, Artificial sequence
  SiRNA target sequence
caatatgttttgtactttatt

SEQ ID NO: 52296 - DNA, 21 bp, Artificial sequence
  SiRNA target sequence
aatatgttttgtactttattt

SEQ ID NO: 52297 - DNA, 21 bp, Artificial sequence
  SiRNA target sequence
atatgttttgtactttatttt

SEQ ID NO: 52298 - DNA, 21 bp, Artificial sequence
  SiRNA target sequence
tatgttttgtactttattttt

SEQ ID NO: 52299 - DNA, 21 bp, Artificial sequence
  SiRNA target sequence
atgttttgtactttattttta

SEQ ID NO: 52300 - DNA, 21 bp, Artificial sequence
  SiRNA target sequence
tgttttgtactttatttttat

SEQ ID NO: 52301 - DNA, 21 bp, Artificial sequence
  SiRNA target sequence
gttttgtactttatttttatt

SEQ ID NO: 52302 - DNA, 21 bp, Artificial sequence
  SiRNA target sequence
ttttgtactttatttttatta

SEQ ID NO: 52303 - DNA, 21 bp, Artificial sequence
  SiRNA target sequence
tttgtactttatttttattat

SEQ ID NO: 52304 - DNA, 21 bp, Artificial sequence
  SiRNA target sequence
ttgtactttatttttattata

SEQ ID NO: 52305 - DNA, 21 bp, Artificial sequence
  SiRNA target sequence
tgtactttatttttattatag

SEQ ID NO: 52306 - DNA, 21 bp, Artificial sequence
  SiRNA target sequence
gtactttatttttattatagt

SEQ ID NO: 52307 - DNA, 21 bp, Artificial sequence
  SiRNA target sequence
tactttatttttattatagtt

SEQ ID NO: 52308 - DNA, 21 bp, Artificial sequence
  SiRNA target sequence
actttatttttattatagttt

SEQ ID NO: 52309 - DNA, 21 bp, Artificial sequence
  SiRNA target sequence
ctttatttttattatagtttt

SEQ ID NO: 52310 - DNA, 21 bp, Artificial sequence
  SiRNA target sequence
tttatttttattatagttttc

SEQ ID NO: 52311 - DNA, 21 bp, Artificial sequence
  SiRNA target sequence
ttatttttattatagttttca

SEQ ID NO: 52312 - DNA, 21 bp, Artificial sequence
  SiRNA target sequence
tatttttattatagttttcat

SEQ ID NO: 52313 - DNA, 21 bp, Artificial sequence
  SiRNA target sequence
atttttattatagttttcata

SEQ ID NO: 52314 - DNA, 21 bp, Artificial sequence
  SiRNA target sequence
tttttattatagttttcatat

SEQ ID NO: 52315 - DNA, 21 bp, Artificial sequence
  SiRNA target sequence
ttttattatagttttcatata

SEQ ID NO: 52316 - DNA, 21 bp, Artificial sequence
  SiRNA target sequence
tttattatagttttcatatat

SEQ ID NO: 52317 - DNA, 21 bp, Artificial sequence
  SiRNA target sequence
ttattatagttttcatatatt

SEQ ID NO: 52318 - DNA, 21 bp, Artificial sequence
  SiRNA target sequence
tattatagttttcatatatta

SEQ ID NO: 52319 - DNA, 21 bp, Artificial sequence
  SiRNA target sequence
attatagttttcatatattat

SEQ ID NO: 52320 - DNA, 21 bp, Artificial sequence
  SiRNA target sequence
ttatagttttcatatattata

SEQ ID NO: 52321 - DNA, 21 bp, Artificial sequence
  SiRNA target sequence
tatagttttcatatattatat

SEQ ID NO: 52322 - DNA, 21 bp, Artificial sequence
  SiRNA target sequence
atagttttcatatattatatc

SEQ ID NO: 52323 - DNA, 21 bp, Artificial sequence
  SiRNA target sequence
tagttttcatatattatatct

SEQ ID NO: 52324 - DNA, 21 bp, Artificial sequence
  SiRNA target sequence
agttttcatatattatatctg

SEQ ID NO: 52325 - DNA, 21 bp, Artificial sequence
  SiRNA target sequence
gttttcatatattatatctgt

SEQ ID NO: 52326 - DNA, 21 bp, Artificial sequence
  SiRNA target sequence
ttttcatatattatatctgtg

SEQ ID NO: 52327 - DNA, 21 bp, Artificial sequence
  SiRNA target sequence
tttcatatattatatctgtgg

SEQ ID NO: 52328 - DNA, 21 bp, Artificial sequence
  SiRNA target sequence
ttcatatattatatctgtgga

SEQ ID NO: 52329 - DNA, 21 bp, Artificial sequence
  SiRNA target sequence
tcatatattatatctgtggaa

SEQ ID NO: 52330 - DNA, 21 bp, Artificial sequence
  SiRNA target sequence
catatattatatctgtggaat

SEQ ID NO: 52331 - DNA, 21 bp, Artificial sequence
  SiRNA target sequence
atatattatatctgtggaatg

SEQ ID NO: 52332 - DNA, 21 bp, Artificial sequence
  SiRNA target sequence
tatattatatctgtggaatgt

SEQ ID NO: 52333 - DNA, 21 bp, Artificial sequence
  SiRNA target sequence
atattatatctgtggaatgtg

SEQ ID NO: 52334 - DNA, 21 bp, Artificial sequence
  SiRNA target sequence
tattatatctgtggaatgtgt

SEQ ID NO: 52335 - DNA, 21 bp, Artificial sequence
  SiRNA target sequence
attatatctgtggaatgtgtt

SEQ ID NO: 52336 - DNA, 21 bp, Artificial sequence
  SiRNA target sequence
ttatatctgtggaatgtgttc

SEQ ID NO: 52337 - DNA, 21 bp, Artificial sequence
  SiRNA target sequence
tatatctgtggaatgtgttct

SEQ ID NO: 52338 - DNA, 21 bp, Artificial sequence
  SiRNA target sequence
atatctgtggaatgtgttctt

SEQ ID NO: 52339 - DNA, 21 bp, Artificial sequence
  SiRNA target sequence
tatctgtggaatgtgttcttt

SEQ ID NO: 52340 - DNA, 21 bp, Artificial sequence
  SiRNA target sequence
atctgtggaatgtgttcttta

SEQ ID NO: 52341 - DNA, 21 bp, Artificial sequence
  SiRNA target sequence
tctgtggaatgtgttctttag

SEQ ID NO: 52342 - DNA, 21 bp, Artificial sequence
  SiRNA target sequence
ctgtggaatgtgttctttaga

SEQ ID NO: 52343 - DNA, 21 bp, Artificial sequence
  SiRNA target sequence
tgtggaatgtgttctttagaa

SEQ ID NO: 52344 - DNA, 21 bp, Artificial sequence
  SiRNA target sequence
gtggaatgtgttctttagaaa

SEQ ID NO: 52345 - DNA, 21 bp, Artificial sequence
  SiRNA target sequence
tggaatgtgttctttagaaat

SEQ ID NO: 52346 - DNA, 21 bp, Artificial sequence
  SiRNA target sequence
ggaatgtgttctttagaaatt

SEQ ID NO: 52347 - DNA, 21 bp, Artificial sequence
  SiRNA target sequence
gaatgtgttctttagaaattt

SEQ ID NO: 52348 - DNA, 21 bp, Artificial sequence
  SiRNA target sequence
aatgtgttctttagaaattta

SEQ ID NO: 52349 - DNA, 21 bp, Artificial sequence
  SiRNA target sequence
atgtgttctttagaaatttat

SEQ ID NO: 52350 - DNA, 21 bp, Artificial sequence
  SiRNA target sequence
tgtgttctttagaaatttatt

SEQ ID NO: 52351 - DNA, 21 bp, Artificial sequence
  SiRNA target sequence
gtgttctttagaaatttattg

SEQ ID NO: 52352 - DNA, 21 bp, Artificial sequence
  SiRNA target sequence
tgttctttagaaatttattgt

SEQ ID NO: 52353 - DNA, 21 bp, Artificial sequence
  SiRNA target sequence
gttctttagaaatttattgtt

SEQ ID NO: 52354 - DNA, 21 bp, Artificial sequence
  SiRNA target sequence
ttctttagaaatttattgttt

SEQ ID NO: 52355 - DNA, 21 bp, Artificial sequence
  SiRNA target sequence
tctttagaaatttattgtttc

SEQ ID NO: 52356 - DNA, 21 bp, Artificial sequence
  SiRNA target sequence
ctttagaaatttattgtttct

SEQ ID NO: 52357 - DNA, 21 bp, Artificial sequence
  SiRNA target sequence
tttagaaatttattgtttcta

SEQ ID NO: 52358 - DNA, 21 bp, Artificial sequence
  SiRNA target sequence
ttagaaatttattgtttctaa

SEQ ID NO: 52359 - DNA, 21 bp, Artificial sequence
  SiRNA target sequence
tagaaatttattgtttctaat

SEQ ID NO: 52360 - DNA, 21 bp, Artificial sequence
  SiRNA target sequence
agaaatttattgtttctaatt

SEQ ID NO: 52361 - DNA, 21 bp, Artificial sequence
  SiRNA target sequence
gaaatttattgtttctaatta

SEQ ID NO: 52362 - DNA, 21 bp, Artificial sequence
  SiRNA target sequence
aaatttattgtttctaattat

SEQ ID NO: 52363 - DNA, 21 bp, Artificial sequence
  SiRNA target sequence
aatttattgtttctaattatt

SEQ ID NO: 52364 - DNA, 21 bp, Artificial sequence
  SiRNA target sequence
atttattgtttctaattattt

SEQ ID NO: 52365 - DNA, 21 bp, Artificial sequence
  SiRNA target sequence
tttattgtttctaattatttt

SEQ ID NO: 52366 - DNA, 21 bp, Artificial sequence
  SiRNA target sequence
ttattgtttctaattattttc

SEQ ID NO: 52367 - DNA, 21 bp, Artificial sequence
  SiRNA target sequence
tattgtttctaattattttct

SEQ ID NO: 52368 - DNA, 21 bp, Artificial sequence
  SiRNA target sequence
attgtttctaattattttctt

SEQ ID NO: 52369 - DNA, 21 bp, Artificial sequence
  SiRNA target sequence
ttgtttctaattattttcttt

SEQ ID NO: 52370 - DNA, 21 bp, Artificial sequence
  SiRNA target sequence
tgtttctaattattttctttt

SEQ ID NO: 52371 - DNA, 21 bp, Artificial sequence
  SiRNA target sequence
gtttctaattattttctttta

SEQ ID NO: 52372 - DNA, 21 bp, Artificial sequence
  SiRNA target sequence
tttctaattattttcttttat

SEQ ID NO: 52373 - DNA, 21 bp, Artificial sequence
  SiRNA target sequence
ttctaattattttcttttata

SEQ ID NO: 52374 - DNA, 21 bp, Artificial sequence
  SiRNA target sequence
tctaattattttcttttatat

SEQ ID NO: 52375 - DNA, 21 bp, Artificial sequence
  SiRNA target sequence
ctaattattttcttttatata

SEQ ID NO: 52376 - DNA, 21 bp, Artificial sequence
  SiRNA target sequence
taattattttcttttatatac

SEQ ID NO: 52377 - DNA, 21 bp, Artificial sequence
  SiRNA target sequence
aattattttcttttatatact

SEQ ID NO: 52378 - DNA, 21 bp, Artificial sequence
  SiRNA target sequence
attattttcttttatatactg

SEQ ID NO: 52379 - DNA, 21 bp, Artificial sequence
  SiRNA target sequence
ttattttcttttatatactga

SEQ ID NO: 52380 - DNA, 21 bp, Artificial sequence
  SiRNA target sequence
tattttcttttatatactgac

SEQ ID NO: 52381 - DNA, 21 bp, Artificial sequence
  SiRNA target sequence
attttcttttatatactgacc

SEQ ID NO: 52382 - DNA, 21 bp, Artificial sequence
  SiRNA target sequence
ttttcttttatatactgacct

SEQ ID NO: 52383 - DNA, 21 bp, Artificial sequence
  SiRNA target sequence
tttcttttatatactgacctt

SEQ ID NO: 52384 - DNA, 21 bp, Artificial sequence
  SiRNA target sequence
ttcttttatatactgaccttt

SEQ ID NO: 52385 - DNA, 21 bp, Artificial sequence
  SiRNA target sequence
tcttttatatactgaccttta

SEQ ID NO: 52386 - DNA, 21 bp, Artificial sequence
  SiRNA target sequence
cttttatatactgacctttat

SEQ ID NO: 52387 - DNA, 21 bp, Artificial sequence
  SiRNA target sequence
ttttatatactgacctttatg

SEQ ID NO: 52388 - DNA, 21 bp, Artificial sequence
  SiRNA target sequence
tttatatactgacctttatgg

SEQ ID NO: 52389 - DNA, 21 bp, Artificial sequence
  SiRNA target sequence
ttatatactgacctttatggt

SEQ ID NO: 52390 - DNA, 21 bp, Artificial sequence
  SiRNA target sequence
tatatactgacctttatggtt

SEQ ID NO: 52391 - DNA, 21 bp, Artificial sequence
  SiRNA target sequence
atatactgacctttatggtta

SEQ ID NO: 52392 - DNA, 21 bp, Artificial sequence
  SiRNA target sequence
tatactgacctttatggttat

SEQ ID NO: 52393 - DNA, 21 bp, Artificial sequence
  SiRNA target sequence
atactgacctttatggttata

SEQ ID NO: 52394 - DNA, 21 bp, Artificial sequence
  SiRNA target sequence
tactgacctttatggttatat

SEQ ID NO: 52395 - DNA, 21 bp, Artificial sequence
  SiRNA target sequence
actgacctttatggttatata

SEQ ID NO: 52396 - DNA, 21 bp, Artificial sequence
  SiRNA target sequence
ctgacctttatggttatatat

SEQ ID NO: 52397 - DNA, 21 bp, Artificial sequence
  SiRNA target sequence
tgacctttatggttatatata

SEQ ID NO: 52398 - DNA, 21 bp, Artificial sequence
  SiRNA target sequence
gacctttatggttatatataa

SEQ ID NO: 52399 - DNA, 21 bp, Artificial sequence
  SiRNA target sequence
acctttatggttatatataat

SEQ ID NO: 52400 - DNA, 21 bp, Artificial sequence
  SiRNA target sequence
cctttatggttatatataatg

SEQ ID NO: 52401 - DNA, 21 bp, Artificial sequence
  SiRNA target sequence
ctttatggttatatataatgt

SEQ ID NO: 52402 - DNA, 21 bp, Artificial sequence
  SiRNA target sequence
tttatggttatatataatgtt

SEQ ID NO: 52403 - DNA, 21 bp, Artificial sequence
  SiRNA target sequence
ttatggttatatataatgttg

SEQ ID NO: 52404 - DNA, 21 bp, Artificial sequence
  SiRNA target sequence
tatggttatatataatgttgt

SEQ ID NO: 52405 - DNA, 21 bp, Artificial sequence
  SiRNA target sequence
atggttatatataatgttgta

SEQ ID NO: 52406 - DNA, 21 bp, Artificial sequence
  SiRNA target sequence
tggttatatataatgttgtat

SEQ ID NO: 52407 - DNA, 21 bp, Artificial sequence
  SiRNA target sequence
ggttatatataatgttgtata

SEQ ID NO: 52408 - DNA, 21 bp, Artificial sequence
  SiRNA target sequence
gttatatataatgttgtatac

SEQ ID NO: 52409 - DNA, 21 bp, Artificial sequence
  SiRNA target sequence
ttatatataatgttgtataca

SEQ ID NO: 52410 - DNA, 21 bp, Artificial sequence
  SiRNA target sequence
tatatataatgttgtatacac

SEQ ID NO: 52411 - DNA, 21 bp, Artificial sequence
  SiRNA target sequence
atatataatgttgtatacaca

SEQ ID NO: 52412 - DNA, 21 bp, Artificial sequence
  SiRNA target sequence
tatataatgttgtatacacac

SEQ ID NO: 52413 - DNA, 21 bp, Artificial sequence
  SiRNA target sequence
atataatgttgtatacacaca

SEQ ID NO: 52414 - DNA, 21 bp, Artificial sequence
  SiRNA target sequence
tataatgttgtatacacacac

SEQ ID NO: 52415 - DNA, 21 bp, Artificial sequence
  SiRNA target sequence
ataatgttgtatacacacacc

SEQ ID NO: 52416 - DNA, 21 bp, Artificial sequence
  SiRNA target sequence
taatgttgtatacacacacca

SEQ ID NO: 52417 - DNA, 21 bp, Artificial sequence
  SiRNA target sequence
aatgttgtatacacacaccag

SEQ ID NO: 52418 - DNA, 21 bp, Artificial sequence
  SiRNA target sequence
atgttgtatacacacaccagg

SEQ ID NO: 52419 - DNA, 21 bp, Artificial sequence
  SiRNA target sequence
tgttgtatacacacaccaggt

SEQ ID NO: 52420 - DNA, 21 bp, Artificial sequence
  SiRNA target sequence
gttgtatacacacaccaggtt

SEQ ID NO: 52421 - DNA, 21 bp, Artificial sequence
  SiRNA target sequence
ttgtatacacacaccaggttg

SEQ ID NO: 52422 - DNA, 21 bp, Artificial sequence
  SiRNA target sequence
tgtatacacacaccaggttga

SEQ ID NO: 52423 - DNA, 21 bp, Artificial sequence
  SiRNA target sequence
gtatacacacaccaggttgat

SEQ ID NO: 52424 - DNA, 21 bp, Artificial sequence
  SiRNA target sequence
tatacacacaccaggttgatt

SEQ ID NO: 52425 - DNA, 21 bp, Artificial sequence
  SiRNA target sequence
atacacacaccaggttgattc

SEQ ID NO: 52426 - DNA, 21 bp, Artificial sequence
  SiRNA target sequence
tacacacaccaggttgattct

SEQ ID NO: 52427 - DNA, 21 bp, Artificial sequence
  SiRNA target sequence
acacacaccaggttgattctg

SEQ ID NO: 52428 - DNA, 21 bp, Artificial sequence
  SiRNA target sequence
cacacaccaggttgattctgc

SEQ ID NO: 52429 - DNA, 21 bp, Artificial sequence
  SiRNA target sequence
acacaccaggttgattctgcc

SEQ ID NO: 52430 - DNA, 21 bp, Artificial sequence
  SiRNA target sequence
cacaccaggttgattctgcct

SEQ ID NO: 52431 - DNA, 21 bp, Artificial sequence
  SiRNA target sequence
acaccaggttgattctgcctg

SEQ ID NO: 52432 - DNA, 21 bp, Artificial sequence
  SiRNA target sequence
caccaggttgattctgcctga

SEQ ID NO: 52433 - DNA, 21 bp, Artificial sequence
  SiRNA target sequence
accaggttgattctgcctgac

SEQ ID NO: 52434 - DNA, 21 bp, Artificial sequence
  SiRNA target sequence
ccaggttgattctgcctgacg

SEQ ID NO: 52435 - DNA, 21 bp, Artificial sequence
  SiRNA target sequence
caggttgattctgcctgacgt

SEQ ID NO: 52436 - DNA, 21 bp, Artificial sequence
  SiRNA target sequence
gcttaacttcggagagctgac

SEQ ID NO: 52437 - DNA, 21 bp, Artificial sequence
  SiRNA target sequence
cttaacttcggagagctgacg

SEQ ID NO: 52438 - DNA, 21 bp, Artificial sequence
  SiRNA target sequence
ttaacttcggagagctgacga

SEQ ID NO: 52439 - DNA, 21 bp, Artificial sequence
  SiRNA target sequence
taacttcggagagctgacgag

SEQ ID NO: 52440 - DNA, 21 bp, Artificial sequence
  SiRNA target sequence
aacttcggagagctgacgagt

SEQ ID NO: 52441 - DNA, 21 bp, Artificial sequence
  SiRNA target sequence
acttcggagagctgacgagtt

SEQ ID NO: 52442 - DNA, 21 bp, Artificial sequence
  SiRNA target sequence
cttcggagagctgacgagttc

SEQ ID NO: 52443 - DNA, 21 bp, Artificial sequence
  SiRNA target sequence
ttcggagagctgacgagttcc

SEQ ID NO: 52444 - DNA, 21 bp, Artificial sequence
  SiRNA target sequence
tcggagagctgacgagttccg

SEQ ID NO: 52445 - DNA, 21 bp, Artificial sequence
  SiRNA target sequence
cggagagctgacgagttccgg

SEQ ID NO: 52446 - DNA, 21 bp, Artificial sequence
  SiRNA target sequence
ggagagctgacgagttccggt

SEQ ID NO: 52447 - DNA, 21 bp, Artificial sequence
  SiRNA target sequence
gagagctgacgagttccggtg

SEQ ID NO: 52448 - DNA, 21 bp, Artificial sequence
  SiRNA target sequence
agagctgacgagttccggtgt

SEQ ID NO: 52449 - DNA, 21 bp, Artificial sequence
  SiRNA target sequence
gagctgacgagttccggtgtt

SEQ ID NO: 52450 - DNA, 21 bp, Artificial sequence
  SiRNA target sequence
agctgacgagttccggtgttt

SEQ ID NO: 52451 - DNA, 21 bp, Artificial sequence
  SiRNA target sequence
gctgacgagttccggtgtttt

SEQ ID NO: 52452 - DNA, 21 bp, Artificial sequence
  SiRNA target sequence
ctgacgagttccggtgtttta

SEQ ID NO: 52453 - DNA, 21 bp, Artificial sequence
  SiRNA target sequence
tgacgagttccggtgttttac

SEQ ID NO: 52454 - DNA, 21 bp, Artificial sequence
  SiRNA target sequence
gacgagttccggtgttttaca

SEQ ID NO: 52455 - DNA, 21 bp, Artificial sequence
  SiRNA target sequence
acgagttccggtgttttacag

SEQ ID NO: 52456 - DNA, 21 bp, Artificial sequence
  SiRNA target sequence
cgagttccggtgttttacagt

SEQ ID NO: 52457 - DNA, 21 bp, Artificial sequence
  SiRNA target sequence
gagttccggtgttttacagta

SEQ ID NO: 52458 - DNA, 21 bp, Artificial sequence
  SiRNA target sequence
agttccggtgttttacagtag

SEQ ID NO: 52459 - DNA, 21 bp, Artificial sequence
  SiRNA target sequence
gttccggtgttttacagtaga

SEQ ID NO: 52460 - DNA, 21 bp, Artificial sequence
  SiRNA target sequence
ttccggtgttttacagtagat

SEQ ID NO: 52461 - DNA, 21 bp, Artificial sequence
  SiRNA target sequence
tccggtgttttacagtagata

SEQ ID NO: 52462 - DNA, 21 bp, Artificial sequence
  SiRNA target sequence
ccggtgttttacagtagatat

SEQ ID NO: 52463 - DNA, 21 bp, Artificial sequence
  SiRNA target sequence
cggtgttttacagtagatatg

SEQ ID NO: 52464 - DNA, 21 bp, Artificial sequence
  SiRNA target sequence
ggtgttttacagtagatatgg

SEQ ID NO: 52465 - DNA, 21 bp, Artificial sequence
  SiRNA target sequence
gtgttttacagtagatatggc

SEQ ID NO: 52466 - DNA, 21 bp, Artificial sequence
  SiRNA target sequence
tgttttacagtagatatggcc

SEQ ID NO: 52467 - DNA, 21 bp, Artificial sequence
  SiRNA target sequence
gttttacagtagatatggccg

SEQ ID NO: 52468 - DNA, 21 bp, Artificial sequence
  SiRNA target sequence
ttttacagtagatatggccgt

SEQ ID NO: 52469 - DNA, 21 bp, Artificial sequence
  SiRNA target sequence
tttacagtagatatggccgta

SEQ ID NO: 52470 - DNA, 21 bp, Artificial sequence
  SiRNA target sequence
ttacagtagatatggccgtag

SEQ ID NO: 52471 - DNA, 21 bp, Artificial sequence
  SiRNA target sequence
tacagtagatatggccgtagc

SEQ ID NO: 52472 - DNA, 21 bp, Artificial sequence
  SiRNA target sequence
acagtagatatggccgtagct

SEQ ID NO: 52473 - DNA, 21 bp, Artificial sequence
  SiRNA target sequence
cagtagatatggccgtagcta

SEQ ID NO: 52474 - DNA, 21 bp, Artificial sequence
  SiRNA target sequence
agtagatatggccgtagctaa

SEQ ID NO: 52475 - DNA, 21 bp, Artificial sequence
  SiRNA target sequence
gtagatatggccgtagctaaa

SEQ ID NO: 52476 - DNA, 21 bp, Artificial sequence
  SiRNA target sequence
tagatatggccgtagctaaat

SEQ ID NO: 52477 - DNA, 21 bp, Artificial sequence
  SiRNA target sequence
agatatggccgtagctaaatg

SEQ ID NO: 52478 - DNA, 21 bp, Artificial sequence
  SiRNA target sequence
gatatggccgtagctaaatgc

SEQ ID NO: 52479 - DNA, 21 bp, Artificial sequence
  SiRNA target sequence
atatggccgtagctaaatgcc

SEQ ID NO: 52480 - DNA, 21 bp, Artificial sequence
  SiRNA target sequence
tatggccgtagctaaatgccg

SEQ ID NO: 52481 - DNA, 21 bp, Artificial sequence
  SiRNA target sequence
atggccgtagctaaatgccgc

SEQ ID NO: 52482 - DNA, 21 bp, Artificial sequence
  SiRNA target sequence
tggccgtagctaaatgccgca

SEQ ID NO: 52483 - DNA, 21 bp, Artificial sequence
  SiRNA target sequence
ggccgtagctaaatgccgcat

SEQ ID NO: 52484 - DNA, 21 bp, Artificial sequence
  SiRNA target sequence
gccgtagctaaatgccgcata

SEQ ID NO: 52485 - DNA, 21 bp, Artificial sequence
  SiRNA target sequence
ccgtagctaaatgccgcatag

SEQ ID NO: 52486 - DNA, 21 bp, Artificial sequence
  SiRNA target sequence
cgtagctaaatgccgcataga

SEQ ID NO: 52487 - DNA, 21 bp, Artificial sequence
  SiRNA target sequence
gtagctaaatgccgcatagat

SEQ ID NO: 52488 - DNA, 21 bp, Artificial sequence
  SiRNA target sequence
tagctaaatgccgcatagatt

SEQ ID NO: 52489 - DNA, 21 bp, Artificial sequence
  SiRNA target sequence
agctaaatgccgcatagatta

SEQ ID NO: 52490 - DNA, 21 bp, Artificial sequence
  SiRNA target sequence
gctaaatgccgcatagattaa

SEQ ID NO: 52491 - DNA, 21 bp, Artificial sequence
  SiRNA target sequence
ctaaatgccgcatagattaaa

SEQ ID NO: 52492 - DNA, 21 bp, Artificial sequence
  SiRNA target sequence
taaatgccgcatagattaaat

SEQ ID NO: 52493 - DNA, 21 bp, Artificial sequence
  SiRNA target sequence
aaatgccgcatagattaaatt

SEQ ID NO: 52494 - DNA, 21 bp, Artificial sequence
  SiRNA target sequence
aatgccgcatagattaaattt

SEQ ID NO: 52495 - DNA, 21 bp, Artificial sequence
  SiRNA target sequence
atgccgcatagattaaatttt

SEQ ID NO: 52496 - DNA, 21 bp, Artificial sequence
  SiRNA target sequence
tgccgcatagattaaatttta

SEQ ID NO: 52497 - DNA, 21 bp, Artificial sequence
  SiRNA target sequence
gccgcatagattaaattttat

SEQ ID NO: 52498 - DNA, 21 bp, Artificial sequence
  SiRNA target sequence
ccgcatagattaaattttatt

SEQ ID NO: 52499 - DNA, 21 bp, Artificial sequence
  SiRNA target sequence
cgcatagattaaattttatta

SEQ ID NO: 52500 - DNA, 21 bp, Artificial sequence
  SiRNA target sequence
gcatagattaaattttattaa

SEQ ID NO: 52501 - DNA, 21 bp, Artificial sequence
  SiRNA target sequence
catagattaaattttattaaa

SEQ ID NO: 52502 - DNA, 21 bp, Artificial sequence
  SiRNA target sequence
atagattaaattttattaaac

SEQ ID NO: 52503 - DNA, 21 bp, Artificial sequence
  SiRNA target sequence
tagattaaattttattaaact

SEQ ID NO: 52504 - DNA, 21 bp, Artificial sequence
  SiRNA target sequence
agattaaattttattaaacta

SEQ ID NO: 52505 - DNA, 21 bp, Artificial sequence
  SiRNA target sequence
gattaaattttattaaactaa

SEQ ID NO: 52506 - DNA, 21 bp, Artificial sequence
  SiRNA target sequence
attaaattttattaaactaat

SEQ ID NO: 52507 - DNA, 21 bp, Artificial sequence
  SiRNA target sequence
ttaaattttattaaactaatt

SEQ ID NO: 52508 - DNA, 21 bp, Artificial sequence
  SiRNA target sequence
taaattttattaaactaattt

SEQ ID NO: 52509 - DNA, 21 bp, Artificial sequence
  SiRNA target sequence
aaattttattaaactaattta

SEQ ID NO: 52510 - DNA, 21 bp, Artificial sequence
  SiRNA target sequence
aattttattaaactaatttat

SEQ ID NO: 52511 - DNA, 21 bp, Artificial sequence
  SiRNA target sequence
attttattaaactaatttatt

SEQ ID NO: 52512 - DNA, 21 bp, Artificial sequence
  SiRNA target sequence
ttttattaaactaatttattg

SEQ ID NO: 52513 - DNA, 21 bp, Artificial sequence
  SiRNA target sequence
tttattaaactaatttattga

SEQ ID NO: 52514 - DNA, 21 bp, Artificial sequence
  SiRNA target sequence
ttattaaactaatttattgaa

SEQ ID NO: 52515 - DNA, 21 bp, Artificial sequence
  SiRNA target sequence
tattaaactaatttattgaaa

SEQ ID NO: 52516 - DNA, 21 bp, Artificial sequence
  SiRNA target sequence
attaaactaatttattgaaaa

SEQ ID NO: 52517 - DNA, 21 bp, Artificial sequence
  SiRNA target sequence
ttaaactaatttattgaaaaa

SEQ ID NO: 52518 - DNA, 21 bp, Artificial sequence
  SiRNA target sequence
taaactaatttattgaaaaaa

SEQ ID NO: 52519 - DNA, 21 bp, Artificial sequence
  SiRNA target sequence
aaactaatttattgaaaaaat

SEQ ID NO: 52520 - DNA, 21 bp, Artificial sequence
  SiRNA target sequence
aactaatttattgaaaaaata

SEQ ID NO: 52521 - DNA, 21 bp, Artificial sequence
  SiRNA target sequence
actaatttattgaaaaaatag

SEQ ID NO: 52522 - DNA, 21 bp, Artificial sequence
  SiRNA target sequence
ctaatttattgaaaaaatagt

SEQ ID NO: 52523 - DNA, 21 bp, Artificial sequence
  SiRNA target sequence
taatttattgaaaaaatagtt

SEQ ID NO: 52524 - DNA, 21 bp, Artificial sequence
  SiRNA target sequence
aatttattgaaaaaatagttt

SEQ ID NO: 52525 - DNA, 21 bp, Artificial sequence
  SiRNA target sequence
atttattgaaaaaatagtttt

SEQ ID NO: 52526 - DNA, 21 bp, Artificial sequence
  SiRNA target sequence
tttattgaaaaaatagttttc

SEQ ID NO: 52527 - DNA, 21 bp, Artificial sequence
  SiRNA target sequence
ttattgaaaaaatagttttca

SEQ ID NO: 52528 - DNA, 21 bp, Artificial sequence
  SiRNA target sequence
tattgaaaaaatagttttcat

SEQ ID NO: 52529 - DNA, 21 bp, Artificial sequence
  SiRNA target sequence
attgaaaaaatagttttcata

SEQ ID NO: 52530 - DNA, 21 bp, Artificial sequence
  SiRNA target sequence
ttgaaaaaatagttttcatat

SEQ ID NO: 52531 - DNA, 21 bp, Artificial sequence
  SiRNA target sequence
tgaaaaaatagttttcatatt

SEQ ID NO: 52532 - DNA, 21 bp, Artificial sequence
  SiRNA target sequence
gaaaaaatagttttcatatta

SEQ ID NO: 52533 - DNA, 21 bp, Artificial sequence
  SiRNA target sequence
aaaaaatagttttcatattat

SEQ ID NO: 52534 - DNA, 21 bp, Artificial sequence
  SiRNA target sequence
aaaaatagttttcatattatt

SEQ ID NO: 52535 - DNA, 21 bp, Artificial sequence
  SiRNA target sequence
aaaatagttttcatattattt

SEQ ID NO: 52536 - DNA, 21 bp, Artificial sequence
  SiRNA target sequence
aaatagttttcatattatttt

SEQ ID NO: 52537 - DNA, 21 bp, Artificial sequence
  SiRNA target sequence
aatagttttcatattattttt

SEQ ID NO: 52538 - DNA, 21 bp, Artificial sequence
  SiRNA target sequence
atagttttcatattattttta

SEQ ID NO: 52539 - DNA, 21 bp, Artificial sequence
  SiRNA target sequence
tagttttcatattatttttaa

SEQ ID NO: 52540 - DNA, 21 bp, Artificial sequence
  SiRNA target sequence
agttttcatattatttttaaa

SEQ ID NO: 52541 - DNA, 21 bp, Artificial sequence
  SiRNA target sequence
gttttcatattatttttaaat

SEQ ID NO: 52542 - DNA, 21 bp, Artificial sequence
  SiRNA target sequence
ttttcatattatttttaaatt

SEQ ID NO: 52543 - DNA, 21 bp, Artificial sequence
  SiRNA target sequence
tttcatattatttttaaattt

SEQ ID NO: 52544 - DNA, 21 bp, Artificial sequence
  SiRNA target sequence
ttcatattatttttaaatttt

SEQ ID NO: 52545 - DNA, 21 bp, Artificial sequence
  SiRNA target sequence
tcatattatttttaaattttc

SEQ ID NO: 52546 - DNA, 21 bp, Artificial sequence
  SiRNA target sequence
catattatttttaaattttca

SEQ ID NO: 52547 - DNA, 21 bp, Artificial sequence
  SiRNA target sequence
atattatttttaaattttcaa

SEQ ID NO: 52548 - DNA, 21 bp, Artificial sequence
  SiRNA target sequence
tattatttttaaattttcaaa

SEQ ID NO: 52549 - DNA, 21 bp, Artificial sequence
  SiRNA target sequence
attatttttaaattttcaaac

SEQ ID NO: 52550 - DNA, 21 bp, Artificial sequence
  SiRNA target sequence
ttatttttaaattttcaaact

SEQ ID NO: 52551 - DNA, 21 bp, Artificial sequence
  SiRNA target sequence
tatttttaaattttcaaactt

SEQ ID NO: 52552 - DNA, 21 bp, Artificial sequence
  SiRNA target sequence
atttttaaattttcaaacttt

SEQ ID NO: 52553 - DNA, 21 bp, Artificial sequence
  SiRNA target sequence
tttttaaattttcaaactttt

SEQ ID NO: 52554 - DNA, 21 bp, Artificial sequence
  SiRNA target sequence
ttttaaattttcaaactttta

SEQ ID NO: 52555 - DNA, 21 bp, Artificial sequence
  SiRNA target sequence
tttaaattttcaaacttttaa

SEQ ID NO: 52556 - DNA, 21 bp, Artificial sequence
  SiRNA target sequence
ttaaattttcaaacttttaaa

SEQ ID NO: 52557 - DNA, 21 bp, Artificial sequence
  SiRNA target sequence
taaattttcaaacttttaaat

SEQ ID NO: 52558 - DNA, 21 bp, Artificial sequence
  SiRNA target sequence
aaattttcaaacttttaaatt

SEQ ID NO: 52559 - DNA, 21 bp, Artificial sequence
  SiRNA target sequence
aattttcaaacttttaaatta

SEQ ID NO: 52560 - DNA, 21 bp, Artificial sequence
  SiRNA target sequence
attttcaaacttttaaattat

SEQ ID NO: 52561 - DNA, 21 bp, Artificial sequence
  SiRNA target sequence
ttttcaaacttttaaattata

SEQ ID NO: 52562 - DNA, 21 bp, Artificial sequence
  SiRNA target sequence
tttcaaacttttaaattatag

SEQ ID NO: 52563 - DNA, 21 bp, Artificial sequence
  SiRNA target sequence
ttcaaacttttaaattatagt

SEQ ID NO: 52564 - DNA, 21 bp, Artificial sequence
  SiRNA target sequence
tcaaacttttaaattatagta

SEQ ID NO: 52565 - DNA, 21 bp, Artificial sequence
  SiRNA target sequence
caaacttttaaattatagtac

SEQ ID NO: 52566 - DNA, 21 bp, Artificial sequence
  SiRNA target sequence
aaacttttaaattatagtaca

SEQ ID NO: 52567 - DNA, 21 bp, Artificial sequence
  SiRNA target sequence
aacttttaaattatagtacaa

SEQ ID NO: 52568 - DNA, 21 bp, Artificial sequence
  SiRNA target sequence
acttttaaattatagtacaat

SEQ ID NO: 52569 - DNA, 21 bp, Artificial sequence
  SiRNA target sequence
cttttaaattatagtacaatt

SEQ ID NO: 52570 - DNA, 21 bp, Artificial sequence
  SiRNA target sequence
ttttaaattatagtacaatta

SEQ ID NO: 52571 - DNA, 21 bp, Artificial sequence
  SiRNA target sequence
tttaaattatagtacaattat

SEQ ID NO: 52572 - DNA, 21 bp, Artificial sequence
  SiRNA target sequence
ttaaattatagtacaattatt

SEQ ID NO: 52573 - DNA, 21 bp, Artificial sequence
  SiRNA target sequence
taaattatagtacaattattt

SEQ ID NO: 52574 - DNA, 21 bp, Artificial sequence
  SiRNA target sequence
aaattatagtacaattatttt

SEQ ID NO: 52575 - DNA, 21 bp, Artificial sequence
  SiRNA target sequence
aattatagtacaattattttg

SEQ ID NO: 52576 - DNA, 21 bp, Artificial sequence
  SiRNA target sequence
attatagtacaattattttga

SEQ ID NO: 52577 - DNA, 21 bp, Artificial sequence
  SiRNA target sequence
ttatagtacaattattttgag

SEQ ID NO: 52578 - DNA, 21 bp, Artificial sequence
  SiRNA target sequence
tatagtacaattattttgaga

SEQ ID NO: 52579 - DNA, 21 bp, Artificial sequence
  SiRNA target sequence
atagtacaattattttgagaa

SEQ ID NO: 52580 - DNA, 21 bp, Artificial sequence
  SiRNA target sequence
tagtacaattattttgagaaa

SEQ ID NO: 52581 - DNA, 21 bp, Artificial sequence
  SiRNA target sequence
agtacaattattttgagaaat

SEQ ID NO: 52582 - DNA, 21 bp, Artificial sequence
  SiRNA target sequence
gtacaattattttgagaaatt

SEQ ID NO: 52583 - DNA, 21 bp, Artificial sequence
  SiRNA target sequence
tacaattattttgagaaattt

SEQ ID NO: 52584 - DNA, 21 bp, Artificial sequence
  SiRNA target sequence
acaattattttgagaaattta

SEQ ID NO: 52585 - DNA, 21 bp, Artificial sequence
  SiRNA target sequence
caattattttgagaaatttat

SEQ ID NO: 52586 - DNA, 21 bp, Artificial sequence
  SiRNA target sequence
aattattttgagaaatttata

SEQ ID NO: 52587 - DNA, 21 bp, Artificial sequence
  SiRNA target sequence
attattttgagaaatttataa

SEQ ID NO: 52588 - DNA, 21 bp, Artificial sequence
  SiRNA target sequence
ttattttgagaaatttataat

SEQ ID NO: 52589 - DNA, 21 bp, Artificial sequence
  SiRNA target sequence
tattttgagaaatttataatt

SEQ ID NO: 52590 - DNA, 21 bp, Artificial sequence
  SiRNA target sequence
attttgagaaatttataattc

SEQ ID NO: 52591 - DNA, 21 bp, Artificial sequence
  SiRNA target sequence
ttttgagaaatttataattca

SEQ ID NO: 52592 - DNA, 21 bp, Artificial sequence
  SiRNA target sequence
tttgagaaatttataattcac

SEQ ID NO: 52593 - DNA, 21 bp, Artificial sequence
  SiRNA target sequence
ttgagaaatttataattcact

SEQ ID NO: 52594 - DNA, 21 bp, Artificial sequence
  SiRNA target sequence
tgagaaatttataattcactg

SEQ ID NO: 52595 - DNA, 21 bp, Artificial sequence
  SiRNA target sequence
gagaaatttataattcactga

SEQ ID NO: 52596 - DNA, 21 bp, Artificial sequence
  SiRNA target sequence
agaaatttataattcactgat

SEQ ID NO: 52597 - DNA, 21 bp, Artificial sequence
  SiRNA target sequence
gaaatttataattcactgata

SEQ ID NO: 52598 - DNA, 21 bp, Artificial sequence
  SiRNA target sequence
aaatttataattcactgatat

SEQ ID NO: 52599 - DNA, 21 bp, Artificial sequence
  SiRNA target sequence
aatttataattcactgatata

SEQ ID NO: 52600 - DNA, 21 bp, Artificial sequence
  SiRNA target sequence
atttataattcactgatatat

SEQ ID NO: 52601 - DNA, 21 bp, Artificial sequence
  SiRNA target sequence
tttataattcactgatatatt

SEQ ID NO: 52602 - DNA, 21 bp, Artificial sequence
  SiRNA target sequence
ttataattcactgatatattc

SEQ ID NO: 52603 - DNA, 21 bp, Artificial sequence
  SiRNA target sequence
tataattcactgatatattct

SEQ ID NO: 52604 - DNA, 21 bp, Artificial sequence
  SiRNA target sequence
ataattcactgatatattctt

SEQ ID NO: 52605 - DNA, 21 bp, Artificial sequence
  SiRNA target sequence
taattcactgatatattctta

SEQ ID NO: 52606 - DNA, 21 bp, Artificial sequence
  SiRNA target sequence
aattcactgatatattcttaa

SEQ ID NO: 52607 - DNA, 21 bp, Artificial sequence
  SiRNA target sequence
attcactgatatattcttaaa

SEQ ID NO: 52608 - DNA, 21 bp, Artificial sequence
  SiRNA target sequence
ttcactgatatattcttaaaa

SEQ ID NO: 52609 - DNA, 21 bp, Artificial sequence
  SiRNA target sequence
tcactgatatattcttaaaag

SEQ ID NO: 52610 - DNA, 21 bp, Artificial sequence
  SiRNA target sequence
cactgatatattcttaaaagt

SEQ ID NO: 52611 - DNA, 21 bp, Artificial sequence
  SiRNA target sequence
actgatatattcttaaaagta

SEQ ID NO: 52612 - DNA, 21 bp, Artificial sequence
  SiRNA target sequence
ctgatatattcttaaaagtaa

SEQ ID NO: 52613 - DNA, 21 bp, Artificial sequence
  SiRNA target sequence
tgatatattcttaaaagtaat

SEQ ID NO: 52614 - DNA, 21 bp, Artificial sequence
  SiRNA target sequence
gatatattcttaaaagtaatc

SEQ ID NO: 52615 - DNA, 21 bp, Artificial sequence
  SiRNA target sequence
atatattcttaaaagtaatct

SEQ ID NO: 52616 - DNA, 21 bp, Artificial sequence
  SiRNA target sequence
tatattcttaaaagtaatcta

SEQ ID NO: 52617 - DNA, 21 bp, Artificial sequence
  SiRNA target sequence
atattcttaaaagtaatctat

SEQ ID NO: 52618 - DNA, 21 bp, Artificial sequence
  SiRNA target sequence
tattcttaaaagtaatctatt

SEQ ID NO: 52619 - DNA, 21 bp, Artificial sequence
  SiRNA target sequence
attcttaaaagtaatctatta

SEQ ID NO: 52620 - DNA, 21 bp, Artificial sequence
  SiRNA target sequence
ttcttaaaagtaatctattaa

SEQ ID NO: 52621 - DNA, 21 bp, Artificial sequence
  SiRNA target sequence
tcttaaaagtaatctattaac

SEQ ID NO: 52622 - DNA, 21 bp, Artificial sequence
  SiRNA target sequence
cttaaaagtaatctattaaca

SEQ ID NO: 52623 - DNA, 21 bp, Artificial sequence
  SiRNA target sequence
ttaaaagtaatctattaacat

SEQ ID NO: 52624 - DNA, 21 bp, Artificial sequence
  SiRNA target sequence
taaaagtaatctattaacatt

SEQ ID NO: 52625 - DNA, 21 bp, Artificial sequence
  SiRNA target sequence
aaaagtaatctattaacatta

SEQ ID NO: 52626 - DNA, 21 bp, Artificial sequence
  SiRNA target sequence
aaagtaatctattaacattaa

SEQ ID NO: 52627 - DNA, 21 bp, Artificial sequence
  SiRNA target sequence
aagtaatctattaacattaaa

SEQ ID NO: 52628 - DNA, 21 bp, Artificial sequence
  SiRNA target sequence
agtaatctattaacattaaat

SEQ ID NO: 52629 - DNA, 21 bp, Artificial sequence
  SiRNA target sequence
gtaatctattaacattaaatt

SEQ ID NO: 52630 - DNA, 21 bp, Artificial sequence
  SiRNA target sequence
taatctattaacattaaatta

SEQ ID NO: 52631 - DNA, 21 bp, Artificial sequence
  SiRNA target sequence
aatctattaacattaaattat

SEQ ID NO: 52632 - DNA, 21 bp, Artificial sequence
  SiRNA target sequence
atctattaacattaaattata

SEQ ID NO: 52633 - DNA, 21 bp, Artificial sequence
  SiRNA target sequence
tctattaacattaaattataa

SEQ ID NO: 52634 - DNA, 21 bp, Artificial sequence
  SiRNA target sequence
ctattaacattaaattataaa

SEQ ID NO: 52635 - DNA, 21 bp, Artificial sequence
  SiRNA target sequence
tattaacattaaattataaaa

SEQ ID NO: 52636 - DNA, 21 bp, Artificial sequence
  SiRNA target sequence
attaacattaaattataaaaa

SEQ ID NO: 52637 - DNA, 21 bp, Artificial sequence
  SiRNA target sequence
ttaacattaaattataaaaat

SEQ ID NO: 52638 - DNA, 21 bp, Artificial sequence
  SiRNA target sequence
taacattaaattataaaaatt

SEQ ID NO: 52639 - DNA, 21 bp, Artificial sequence
  SiRNA target sequence
aacattaaattataaaaattt

SEQ ID NO: 52640 - DNA, 21 bp, Artificial sequence
  SiRNA target sequence
acattaaattataaaaatttt

SEQ ID NO: 52641 - DNA, 21 bp, Artificial sequence
  SiRNA target sequence
cattaaattataaaaattttt

SEQ ID NO: 52642 - DNA, 21 bp, Artificial sequence
  SiRNA target sequence
attaaattataaaaatttttt

SEQ ID NO: 52643 - DNA, 21 bp, Artificial sequence
  SiRNA target sequence
ttaaattataaaaattttttg

SEQ ID NO: 52644 - DNA, 21 bp, Artificial sequence
  SiRNA target sequence
taaattataaaaattttttgt

SEQ ID NO: 52645 - DNA, 21 bp, Artificial sequence
  SiRNA target sequence
aaattataaaaattttttgta

SEQ ID NO: 52646 - DNA, 21 bp, Artificial sequence
  SiRNA target sequence
aattataaaaattttttgtac

SEQ ID NO: 52647 - DNA, 21 bp, Artificial sequence
  SiRNA target sequence
attataaaaattttttgtact

SEQ ID NO: 52648 - DNA, 21 bp, Artificial sequence
  SiRNA target sequence
ttataaaaattttttgtactt

SEQ ID NO: 52649 - DNA, 21 bp, Artificial sequence
  SiRNA target sequence
tataaaaattttttgtacttt

SEQ ID NO: 52650 - DNA, 21 bp, Artificial sequence
  SiRNA target sequence
ataaaaattttttgtactttg

SEQ ID NO: 52651 - DNA, 21 bp, Artificial sequence
  SiRNA target sequence
taaaaattttttgtactttgt

SEQ ID NO: 52652 - DNA, 21 bp, Artificial sequence
  SiRNA target sequence
aaaaattttttgtactttgta

SEQ ID NO: 52653 - DNA, 21 bp, Artificial sequence
  SiRNA target sequence
aaaattttttgtactttgtaa

SEQ ID NO: 52654 - DNA, 21 bp, Artificial sequence
  SiRNA target sequence
aaattttttgtactttgtaat

SEQ ID NO: 52655 - DNA, 21 bp, Artificial sequence
  SiRNA target sequence
aattttttgtactttgtaatt

SEQ ID NO: 52656 - DNA, 21 bp, Artificial sequence
  SiRNA target sequence
attttttgtactttgtaatta

SEQ ID NO: 52657 - DNA, 21 bp, Artificial sequence
  SiRNA target sequence
ttttttgtactttgtaattac

SEQ ID NO: 52658 - DNA, 21 bp, Artificial sequence
  SiRNA target sequence
tttttgtactttgtaattaca

SEQ ID NO: 52659 - DNA, 21 bp, Artificial sequence
  SiRNA target sequence
ttttgtactttgtaattacat

SEQ ID NO: 52660 - DNA, 21 bp, Artificial sequence
  SiRNA target sequence
tttgtactttgtaattacatt

SEQ ID NO: 52661 - DNA, 21 bp, Artificial sequence
  SiRNA target sequence
ttgtactttgtaattacatta

SEQ ID NO: 52662 - DNA, 21 bp, Artificial sequence
  SiRNA target sequence
tgtactttgtaattacattat

SEQ ID NO: 52663 - DNA, 21 bp, Artificial sequence
  SiRNA target sequence
gtactttgtaattacattata

SEQ ID NO: 52664 - DNA, 21 bp, Artificial sequence
  SiRNA target sequence
tactttgtaattacattataa

SEQ ID NO: 52665 - DNA, 21 bp, Artificial sequence
  SiRNA target sequence
actttgtaattacattataac

SEQ ID NO: 52666 - DNA, 21 bp, Artificial sequence
  SiRNA target sequence
ctttgtaattacattataaca

SEQ ID NO: 52667 - DNA, 21 bp, Artificial sequence
  SiRNA target sequence
tttgtaattacattataacac

SEQ ID NO: 52668 - DNA, 21 bp, Artificial sequence
  SiRNA target sequence
ttgtaattacattataacacg

SEQ ID NO: 52669 - DNA, 21 bp, Artificial sequence
  SiRNA target sequence
tgtaattacattataacacga

SEQ ID NO: 52670 - DNA, 21 bp, Artificial sequence
  SiRNA target sequence
gtaattacattataacacgat

SEQ ID NO: 52671 - DNA, 21 bp, Artificial sequence
  SiRNA target sequence
taattacattataacacgata

SEQ ID NO: 52672 - DNA, 21 bp, Artificial sequence
  SiRNA target sequence
aattacattataacacgataa

SEQ ID NO: 52673 - DNA, 21 bp, Artificial sequence
  SiRNA target sequence
attacattataacacgataaa

SEQ ID NO: 52674 - DNA, 21 bp, Artificial sequence
  SiRNA target sequence
ttacattataacacgataaaa

SEQ ID NO: 52675 - DNA, 21 bp, Artificial sequence
  SiRNA target sequence
tacattataacacgataaaaa

SEQ ID NO: 52676 - DNA, 21 bp, Artificial sequence
  SiRNA target sequence
acattataacacgataaaaat

SEQ ID NO: 52677 - DNA, 21 bp, Artificial sequence
  SiRNA target sequence
cattataacacgataaaaata

SEQ ID NO: 52678 - DNA, 21 bp, Artificial sequence
  SiRNA target sequence
attataacacgataaaaataa

SEQ ID NO: 52679 - DNA, 21 bp, Artificial sequence
  SiRNA target sequence
ttataacacgataaaaataat

SEQ ID NO: 52680 - DNA, 21 bp, Artificial sequence
  SiRNA target sequence
tataacacgataaaaataata

SEQ ID NO: 52681 - DNA, 21 bp, Artificial sequence
  SiRNA target sequence
ataacacgataaaaataataa

SEQ ID NO: 52682 - DNA, 21 bp, Artificial sequence
  SiRNA target sequence
taacacgataaaaataataat

SEQ ID NO: 52683 - DNA, 21 bp, Artificial sequence
  SiRNA target sequence
aacacgataaaaataataata

SEQ ID NO: 52684 - DNA, 21 bp, Artificial sequence
  SiRNA target sequence
acacgataaaaataataatac

SEQ ID NO: 52685 - DNA, 21 bp, Artificial sequence
  SiRNA target sequence
cacgataaaaataataataca

SEQ ID NO: 52686 - DNA, 21 bp, Artificial sequence
  SiRNA target sequence
acgataaaaataataatacac

SEQ ID NO: 52687 - DNA, 21 bp, Artificial sequence
  SiRNA target sequence
cgataaaaataataatacact

SEQ ID NO: 52688 - DNA, 21 bp, Artificial sequence
  SiRNA target sequence
gataaaaataataatacactt

SEQ ID NO: 52689 - DNA, 21 bp, Artificial sequence
  SiRNA target sequence
ataaaaataataatacacttt

SEQ ID NO: 52690 - DNA, 21 bp, Artificial sequence
  SiRNA target sequence
taaaaataataatacactttt

SEQ ID NO: 52691 - DNA, 21 bp, Artificial sequence
  SiRNA target sequence
aaaaataataatacacttttg

SEQ ID NO: 52692 - DNA, 21 bp, Artificial sequence
  SiRNA target sequence
aaaataataatacacttttgt

SEQ ID NO: 52693 - DNA, 21 bp, Artificial sequence
  SiRNA target sequence
aaataataatacacttttgta

SEQ ID NO: 52694 - DNA, 21 bp, Artificial sequence
  SiRNA target sequence
aataataatacacttttgtat

SEQ ID NO: 52695 - DNA, 21 bp, Artificial sequence
  SiRNA target sequence
ataataatacacttttgtatt

SEQ ID NO: 52696 - DNA, 21 bp, Artificial sequence
  SiRNA target sequence
taataatacacttttgtattt

SEQ ID NO: 52697 - DNA, 21 bp, Artificial sequence
  SiRNA target sequence
aataatacacttttgtattta

SEQ ID NO: 52698 - DNA, 21 bp, Artificial sequence
  SiRNA target sequence
ataatacacttttgtatttat

SEQ ID NO: 52699 - DNA, 21 bp, Artificial sequence
  SiRNA target sequence
taatacacttttgtatttatc

SEQ ID NO: 52700 - DNA, 21 bp, Artificial sequence
  SiRNA target sequence
aatacacttttgtatttatct

SEQ ID NO: 52701 - DNA, 21 bp, Artificial sequence
  SiRNA target sequence
atacacttttgtatttatcta

SEQ ID NO: 52702 - DNA, 21 bp, Artificial sequence
  SiRNA target sequence
tacacttttgtatttatctaa

SEQ ID NO: 52703 - DNA, 21 bp, Artificial sequence
  SiRNA target sequence
acacttttgtatttatctaat

SEQ ID NO: 52704 - DNA, 21 bp, Artificial sequence
  SiRNA target sequence
cacttttgtatttatctaata

SEQ ID NO: 52705 - DNA, 21 bp, Artificial sequence
  SiRNA target sequence
acttttgtatttatctaatag

SEQ ID NO: 52706 - DNA, 21 bp, Artificial sequence
  SiRNA target sequence
cttttgtatttatctaataga

SEQ ID NO: 52707 - DNA, 21 bp, Artificial sequence
  SiRNA target sequence
ttttgtatttatctaatagat

SEQ ID NO: 52708 - DNA, 21 bp, Artificial sequence
  SiRNA target sequence
tttgtatttatctaatagatt

SEQ ID NO: 52709 - DNA, 21 bp, Artificial sequence
  SiRNA target sequence
ttgtatttatctaatagattt

SEQ ID NO: 52710 - DNA, 21 bp, Artificial sequence
  SiRNA target sequence
tgtatttatctaatagattta

SEQ ID NO: 52711 - DNA, 21 bp, Artificial sequence
  SiRNA target sequence
gtatttatctaatagatttat

SEQ ID NO: 52712 - DNA, 21 bp, Artificial sequence
  SiRNA target sequence
tatttatctaatagatttata

SEQ ID NO: 52713 - DNA, 21 bp, Artificial sequence
  SiRNA target sequence
atttatctaatagatttatat

SEQ ID NO: 52714 - DNA, 21 bp, Artificial sequence
  SiRNA target sequence
tttatctaatagatttatata

SEQ ID NO: 52715 - DNA, 21 bp, Artificial sequence
  SiRNA target sequence
ttatctaatagatttatataa

SEQ ID NO: 52716 - DNA, 21 bp, Artificial sequence
  SiRNA target sequence
tatctaatagatttatataat

SEQ ID NO: 52717 - DNA, 21 bp, Artificial sequence
  SiRNA target sequence
atctaatagatttatataata

SEQ ID NO: 52718 - DNA, 21 bp, Artificial sequence
  SiRNA target sequence
tctaatagatttatataataa

SEQ ID NO: 52719 - DNA, 21 bp, Artificial sequence
  SiRNA target sequence
ctaatagatttatataataaa

SEQ ID NO: 52720 - DNA, 21 bp, Artificial sequence
  SiRNA target sequence
taatagatttatataataaac

SEQ ID NO: 52721 - DNA, 21 bp, Artificial sequence
  SiRNA target sequence
aatagatttatataataaaca

SEQ ID NO: 52722 - DNA, 21 bp, Artificial sequence
  SiRNA target sequence
atagatttatataataaacat

SEQ ID NO: 52723 - DNA, 21 bp, Artificial sequence
  SiRNA target sequence
tagatttatataataaacata

SEQ ID NO: 52724 - DNA, 21 bp, Artificial sequence
  SiRNA target sequence
agatttatataataaacataa

SEQ ID NO: 52725 - DNA, 21 bp, Artificial sequence
  SiRNA target sequence
gatttatataataaacataaa

SEQ ID NO: 52726 - DNA, 21 bp, Artificial sequence
  SiRNA target sequence
atttatataataaacataaaa

SEQ ID NO: 52727 - DNA, 21 bp, Artificial sequence
  SiRNA target sequence
tttatataataaacataaaaa

SEQ ID NO: 52728 - DNA, 21 bp, Artificial sequence
  SiRNA target sequence
ttatataataaacataaaaat

SEQ ID NO: 52729 - DNA, 21 bp, Artificial sequence
  SiRNA target sequence
tatataataaacataaaaatg

SEQ ID NO: 52730 - DNA, 21 bp, Artificial sequence
  SiRNA target sequence
atataataaacataaaaatga

SEQ ID NO: 52731 - DNA, 21 bp, Artificial sequence
  SiRNA target sequence
tataataaacataaaaatgat

SEQ ID NO: 52732 - DNA, 21 bp, Artificial sequence
  SiRNA target sequence
ataataaacataaaaatgatt

SEQ ID NO: 52733 - DNA, 21 bp, Artificial sequence
  SiRNA target sequence
taataaacataaaaatgattt

SEQ ID NO: 52734 - DNA, 21 bp, Artificial sequence
  SiRNA target sequence
aataaacataaaaatgatttt

SEQ ID NO: 52735 - DNA, 21 bp, Artificial sequence
  SiRNA target sequence
ataaacataaaaatgattttt

SEQ ID NO: 52736 - DNA, 21 bp, Artificial sequence
  SiRNA target sequence
taaacataaaaatgatttttt

SEQ ID NO: 52737 - DNA, 21 bp, Artificial sequence
  SiRNA target sequence
aaacataaaaatgattttttt

SEQ ID NO: 52738 - DNA, 21 bp, Artificial sequence
  SiRNA target sequence
aacataaaaatgatttttttt

SEQ ID NO: 52739 - DNA, 21 bp, Artificial sequence
  SiRNA target sequence
acataaaaatgatttttttta

SEQ ID NO: 52740 - DNA, 21 bp, Artificial sequence
  SiRNA target sequence
cataaaaatgattttttttaa

SEQ ID NO: 52741 - DNA, 21 bp, Artificial sequence
  SiRNA target sequence
ataaaaatgattttttttaat

SEQ ID NO: 52742 - DNA, 21 bp, Artificial sequence
  SiRNA target sequence
taaaaatgattttttttaatt

SEQ ID NO: 52743 - DNA, 21 bp, Artificial sequence
  SiRNA target sequence
aaaaatgattttttttaattg

SEQ ID NO: 52744 - DNA, 21 bp, Artificial sequence
  SiRNA target sequence
aaaatgattttttttaattgt

SEQ ID NO: 52745 - DNA, 21 bp, Artificial sequence
  SiRNA target sequence
aaatgattttttttaattgtt

SEQ ID NO: 52746 - DNA, 21 bp, Artificial sequence
  SiRNA target sequence
aatgattttttttaattgtta

SEQ ID NO: 52747 - DNA, 21 bp, Artificial sequence
  SiRNA target sequence
atgattttttttaattgttac

SEQ ID NO: 52748 - DNA, 21 bp, Artificial sequence
  SiRNA target sequence
tgattttttttaattgttact

SEQ ID NO: 52749 - DNA, 21 bp, Artificial sequence
  SiRNA target sequence
gattttttttaattgttacta

SEQ ID NO: 52750 - DNA, 21 bp, Artificial sequence
  SiRNA target sequence
attttttttaattgttactaa

SEQ ID NO: 52751 - DNA, 21 bp, Artificial sequence
  SiRNA target sequence
ttttttttaattgttactaat

SEQ ID NO: 52752 - DNA, 21 bp, Artificial sequence
  SiRNA target sequence
tttttttaattgttactaatt

SEQ ID NO: 52753 - DNA, 21 bp, Artificial sequence
  SiRNA target sequence
ttttttaattgttactaattt

SEQ ID NO: 52754 - DNA, 21 bp, Artificial sequence
  SiRNA target sequence
tttttaattgttactaattta

SEQ ID NO: 52755 - DNA, 21 bp, Artificial sequence
  SiRNA target sequence
ttttaattgttactaatttat

SEQ ID NO: 52756 - DNA, 21 bp, Artificial sequence
  SiRNA target sequence
tttaattgttactaatttatg

SEQ ID NO: 52757 - DNA, 21 bp, Artificial sequence
  SiRNA target sequence
ttaattgttactaatttatgc

SEQ ID NO: 52758 - DNA, 21 bp, Artificial sequence
  SiRNA target sequence
taattgttactaatttatgcc

SEQ ID NO: 52759 - DNA, 21 bp, Artificial sequence
  SiRNA target sequence
aattgttactaatttatgcca

SEQ ID NO: 52760 - DNA, 21 bp, Artificial sequence
  SiRNA target sequence
attgttactaatttatgccat

SEQ ID NO: 52761 - DNA, 21 bp, Artificial sequence
  SiRNA target sequence
ttgttactaatttatgccata

SEQ ID NO: 52762 - DNA, 21 bp, Artificial sequence
  SiRNA target sequence
tgttactaatttatgccatat

SEQ ID NO: 52763 - DNA, 21 bp, Artificial sequence
  SiRNA target sequence
gttactaatttatgccatata

SEQ ID NO: 52764 - DNA, 21 bp, Artificial sequence
  SiRNA target sequence
ttactaatttatgccatatat

SEQ ID NO: 52765 - DNA, 21 bp, Artificial sequence
  SiRNA target sequence
tactaatttatgccatatatt

SEQ ID NO: 52766 - DNA, 21 bp, Artificial sequence
  SiRNA target sequence
actaatttatgccatatatta

SEQ ID NO: 52767 - DNA, 21 bp, Artificial sequence
  SiRNA target sequence
ctaatttatgccatatattat

SEQ ID NO: 52768 - DNA, 21 bp, Artificial sequence
  SiRNA target sequence
taatttatgccatatattata

SEQ ID NO: 52769 - DNA, 21 bp, Artificial sequence
  SiRNA target sequence
aatttatgccatatattatat

SEQ ID NO: 52770 - DNA, 21 bp, Artificial sequence
  SiRNA target sequence
atttatgccatatattatata

SEQ ID NO: 52771 - DNA, 21 bp, Artificial sequence
  SiRNA target sequence
tttatgccatatattatatac

SEQ ID NO: 52772 - DNA, 21 bp, Artificial sequence
  SiRNA target sequence
ttatgccatatattatataca

SEQ ID NO: 52773 - DNA, 21 bp, Artificial sequence
  SiRNA target sequence
tatgccatatattatatacat

SEQ ID NO: 52774 - DNA, 21 bp, Artificial sequence
  SiRNA target sequence
atgccatatattatatacatt

SEQ ID NO: 52775 - DNA, 21 bp, Artificial sequence
  SiRNA target sequence
tgccatatattatatacattt

SEQ ID NO: 52776 - DNA, 21 bp, Artificial sequence
  SiRNA target sequence
gccatatattatatacatttc

SEQ ID NO: 52777 - DNA, 21 bp, Artificial sequence
  SiRNA target sequence
ccatatattatatacatttct

SEQ ID NO: 52778 - DNA, 21 bp, Artificial sequence
  SiRNA target sequence
catatattatatacatttcta

SEQ ID NO: 52779 - DNA, 21 bp, Artificial sequence
  SiRNA target sequence
atatattatatacatttctaa

SEQ ID NO: 52780 - DNA, 21 bp, Artificial sequence
  SiRNA target sequence
tatattatatacatttctaaa

SEQ ID NO: 52781 - DNA, 21 bp, Artificial sequence
  SiRNA target sequence
atattatatacatttctaaaa

SEQ ID NO: 52782 - DNA, 21 bp, Artificial sequence
  SiRNA target sequence
tattatatacatttctaaaat

SEQ ID NO: 52783 - DNA, 21 bp, Artificial sequence
  SiRNA target sequence
attatatacatttctaaaatt

SEQ ID NO: 52784 - DNA, 21 bp, Artificial sequence
  SiRNA target sequence
ttatatacatttctaaaatta

SEQ ID NO: 52785 - DNA, 21 bp, Artificial sequence
  SiRNA target sequence
tatatacatttctaaaattaa

SEQ ID NO: 52786 - DNA, 21 bp, Artificial sequence
  SiRNA target sequence
atatacatttctaaaattaaa

SEQ ID NO: 52787 - DNA, 21 bp, Artificial sequence
  SiRNA target sequence
tatacatttctaaaattaaat

SEQ ID NO: 52788 - DNA, 21 bp, Artificial sequence
  SiRNA target sequence
atacatttctaaaattaaatc

SEQ ID NO: 52789 - DNA, 21 bp, Artificial sequence
  SiRNA target sequence
tacatttctaaaattaaatca

SEQ ID NO: 52790 - DNA, 21 bp, Artificial sequence
  SiRNA target sequence
acatttctaaaattaaatcaa

SEQ ID NO: 52791 - DNA, 21 bp, Artificial sequence
  SiRNA target sequence
catttctaaaattaaatcaaa

SEQ ID NO: 52792 - DNA, 21 bp, Artificial sequence
  SiRNA target sequence
atttctaaaattaaatcaaaa

SEQ ID NO: 52793 - DNA, 21 bp, Artificial sequence
  SiRNA target sequence
tttctaaaattaaatcaaaaa

SEQ ID NO: 52794 - DNA, 21 bp, Artificial sequence
  SiRNA target sequence
ttctaaaattaaatcaaaaaa

SEQ ID NO: 52795 - DNA, 21 bp, Artificial sequence
  SiRNA target sequence
tctaaaattaaatcaaaaaag

SEQ ID NO: 52796 - DNA, 21 bp, Artificial sequence
  SiRNA target sequence
ctaaaattaaatcaaaaaagt

SEQ ID NO: 52797 - DNA, 21 bp, Artificial sequence
  SiRNA target sequence
taaaattaaatcaaaaaagtt

SEQ ID NO: 52798 - DNA, 21 bp, Artificial sequence
  SiRNA target sequence
aaaattaaatcaaaaaagtta

SEQ ID NO: 52799 - DNA, 21 bp, Artificial sequence
  SiRNA target sequence
aaattaaatcaaaaaagttat

SEQ ID NO: 52800 - DNA, 21 bp, Artificial sequence
  SiRNA target sequence
aattaaatcaaaaaagttatt

SEQ ID NO: 52801 - DNA, 21 bp, Artificial sequence
  SiRNA target sequence
attaaatcaaaaaagttattt

SEQ ID NO: 52802 - DNA, 21 bp, Artificial sequence
  SiRNA target sequence
ttaaatcaaaaaagttattta

SEQ ID NO: 52803 - DNA, 21 bp, Artificial sequence
  SiRNA target sequence
taaatcaaaaaagttatttat

SEQ ID NO: 52804 - DNA, 21 bp, Artificial sequence
  SiRNA target sequence
aaatcaaaaaagttatttatt

SEQ ID NO: 52805 - DNA, 21 bp, Artificial sequence
  SiRNA target sequence
aatcaaaaaagttatttattc

SEQ ID NO: 52806 - DNA, 21 bp, Artificial sequence
  SiRNA target sequence
atcaaaaaagttatttattct

SEQ ID NO: 52807 - DNA, 21 bp, Artificial sequence
  SiRNA target sequence
tcaaaaaagttatttattctt

SEQ ID NO: 52808 - DNA, 21 bp, Artificial sequence
  SiRNA target sequence
caaaaaagttatttattcttg

SEQ ID NO: 52809 - DNA, 21 bp, Artificial sequence
  SiRNA target sequence
aaaaaagttatttattcttga

SEQ ID NO: 52810 - DNA, 21 bp, Artificial sequence
  SiRNA target sequence
aaaaagttatttattcttgag

SEQ ID NO: 52811 - DNA, 21 bp, Artificial sequence
  SiRNA target sequence
aaaagttatttattcttgagg

SEQ ID NO: 52812 - DNA, 21 bp, Artificial sequence
  SiRNA target sequence
aaagttatttattcttgagga

SEQ ID NO: 52813 - DNA, 21 bp, Artificial sequence
  SiRNA target sequence
aagttatttattcttgaggag

SEQ ID NO: 52814 - DNA, 21 bp, Artificial sequence
  SiRNA target sequence
agttatttattcttgaggagc

SEQ ID NO: 52815 - DNA, 21 bp, Artificial sequence
  SiRNA target sequence
gttatttattcttgaggagca

SEQ ID NO: 52816 - DNA, 21 bp, Artificial sequence
  SiRNA target sequence
ttatttattcttgaggagcaa

SEQ ID NO: 52817 - DNA, 21 bp, Artificial sequence
  SiRNA target sequence
tatttattcttgaggagcaaa

SEQ ID NO: 52818 - DNA, 21 bp, Artificial sequence
  SiRNA target sequence
atttattcttgaggagcaaat

SEQ ID NO: 52819 - DNA, 21 bp, Artificial sequence
  SiRNA target sequence
tttattcttgaggagcaaatt

SEQ ID NO: 52820 - DNA, 21 bp, Artificial sequence
  SiRNA target sequence
ttattcttgaggagcaaattt

SEQ ID NO: 52821 - DNA, 21 bp, Artificial sequence
  SiRNA target sequence
tattcttgaggagcaaatttt

SEQ ID NO: 52822 - DNA, 21 bp, Artificial sequence
  SiRNA target sequence
attcttgaggagcaaattttt

SEQ ID NO: 52823 - DNA, 21 bp, Artificial sequence
  SiRNA target sequence
ttcttgaggagcaaatttttc

SEQ ID NO: 52824 - DNA, 21 bp, Artificial sequence
  SiRNA target sequence
tcttgaggagcaaatttttct

SEQ ID NO: 52825 - DNA, 21 bp, Artificial sequence
  SiRNA target sequence
cttgaggagcaaatttttctt

SEQ ID NO: 52826 - DNA, 21 bp, Artificial sequence
  SiRNA target sequence
ttgaggagcaaatttttctta

SEQ ID NO: 52827 - DNA, 21 bp, Artificial sequence
  SiRNA target sequence
tgaggagcaaatttttcttat

SEQ ID NO: 52828 - DNA, 21 bp, Artificial sequence
  SiRNA target sequence
gaggagcaaatttttcttatt

SEQ ID NO: 52829 - DNA, 21 bp, Artificial sequence
  SiRNA target sequence
aggagcaaatttttcttattt

SEQ ID NO: 52830 - DNA, 21 bp, Artificial sequence
  SiRNA target sequence
ggagcaaatttttcttattta

SEQ ID NO: 52831 - DNA, 21 bp, Artificial sequence
  SiRNA target sequence
gagcaaatttttcttatttaa

SEQ ID NO: 52832 - DNA, 21 bp, Artificial sequence
  SiRNA target sequence
agcaaatttttcttatttaaa

SEQ ID NO: 52833 - DNA, 21 bp, Artificial sequence
  SiRNA target sequence
gcaaatttttcttatttaaaa

SEQ ID NO: 52834 - DNA, 21 bp, Artificial sequence
  SiRNA target sequence
caaatttttcttatttaaaat

SEQ ID NO: 52835 - DNA, 21 bp, Artificial sequence
  SiRNA target sequence
aaatttttcttatttaaaatt

SEQ ID NO: 52836 - DNA, 21 bp, Artificial sequence
  SiRNA target sequence
aatttttcttatttaaaattt

SEQ ID NO: 52837 - DNA, 21 bp, Artificial sequence
  SiRNA target sequence
atttttcttatttaaaatttt

SEQ ID NO: 52838 - DNA, 21 bp, Artificial sequence
  SiRNA target sequence
tttttcttatttaaaattttc

SEQ ID NO: 52839 - DNA, 21 bp, Artificial sequence
  SiRNA target sequence
ttttcttatttaaaattttct

SEQ ID NO: 52840 - DNA, 21 bp, Artificial sequence
  SiRNA target sequence
tttcttatttaaaattttcta

SEQ ID NO: 52841 - DNA, 21 bp, Artificial sequence
  SiRNA target sequence
ttcttatttaaaattttctaa

SEQ ID NO: 52842 - DNA, 21 bp, Artificial sequence
  SiRNA target sequence
tcttatttaaaattttctaat

SEQ ID NO: 52843 - DNA, 21 bp, Artificial sequence
  SiRNA target sequence
cttatttaaaattttctaatc

SEQ ID NO: 52844 - DNA, 21 bp, Artificial sequence
  SiRNA target sequence
ttatttaaaattttctaatct

SEQ ID NO: 52845 - DNA, 21 bp, Artificial sequence
  SiRNA target sequence
tatttaaaattttctaatctg

SEQ ID NO: 52846 - DNA, 21 bp, Artificial sequence
  SiRNA target sequence
atttaaaattttctaatctgt

SEQ ID NO: 52847 - DNA, 21 bp, Artificial sequence
  SiRNA target sequence
tttaaaattttctaatctgta

SEQ ID NO: 52848 - DNA, 21 bp, Artificial sequence
  SiRNA target sequence
ttaaaattttctaatctgtaa

SEQ ID NO: 52849 - DNA, 21 bp, Artificial sequence
  SiRNA target sequence
taaaattttctaatctgtaaa

SEQ ID NO: 52850 - DNA, 21 bp, Artificial sequence
  SiRNA target sequence
aaaattttctaatctgtaaat

SEQ ID NO: 52851 - DNA, 21 bp, Artificial sequence
  SiRNA target sequence
aaattttctaatctgtaaatt

SEQ ID NO: 52852 - DNA, 21 bp, Artificial sequence
  SiRNA target sequence
aattttctaatctgtaaatta

SEQ ID NO: 52853 - DNA, 21 bp, Artificial sequence
  SiRNA target sequence
attttctaatctgtaaattag

SEQ ID NO: 52854 - DNA, 21 bp, Artificial sequence
  SiRNA target sequence
ttttctaatctgtaaattagt

SEQ ID NO: 52855 - DNA, 21 bp, Artificial sequence
  SiRNA target sequence
tttctaatctgtaaattagtg

SEQ ID NO: 52856 - DNA, 21 bp, Artificial sequence
  SiRNA target sequence
ttctaatctgtaaattagtga

SEQ ID NO: 52857 - DNA, 21 bp, Artificial sequence
  SiRNA target sequence
tctaatctgtaaattagtgat

SEQ ID NO: 52858 - DNA, 21 bp, Artificial sequence
  SiRNA target sequence
ctaatctgtaaattagtgatt

SEQ ID NO: 52859 - DNA, 21 bp, Artificial sequence
  SiRNA target sequence
taatctgtaaattagtgattg

SEQ ID NO: 52860 - DNA, 21 bp, Artificial sequence
  SiRNA target sequence
aatctgtaaattagtgattga

SEQ ID NO: 52861 - DNA, 21 bp, Artificial sequence
  SiRNA target sequence
atctgtaaattagtgattgat

SEQ ID NO: 52862 - DNA, 21 bp, Artificial sequence
  SiRNA target sequence
tctgtaaattagtgattgatc

SEQ ID NO: 52863 - DNA, 21 bp, Artificial sequence
  SiRNA target sequence
ctgtaaattagtgattgatca

SEQ ID NO: 52864 - DNA, 21 bp, Artificial sequence
  SiRNA target sequence
tgtaaattagtgattgatcaa

SEQ ID NO: 52865 - DNA, 21 bp, Artificial sequence
  SiRNA target sequence
gtaaattagtgattgatcaat

SEQ ID NO: 52866 - DNA, 21 bp, Artificial sequence
  SiRNA target sequence
taaattagtgattgatcaata

SEQ ID NO: 52867 - DNA, 21 bp, Artificial sequence
  SiRNA target sequence
aaattagtgattgatcaataa

SEQ ID NO: 52868 - DNA, 21 bp, Artificial sequence
  SiRNA target sequence
aattagtgattgatcaataaa

SEQ ID NO: 52869 - DNA, 21 bp, Artificial sequence
  SiRNA target sequence
attagtgattgatcaataaat

SEQ ID NO: 52870 - DNA, 21 bp, Artificial sequence
  SiRNA target sequence
ttagtgattgatcaataaatt

SEQ ID NO: 52871 - DNA, 21 bp, Artificial sequence
  SiRNA target sequence
tagtgattgatcaataaatta

SEQ ID NO: 52872 - DNA, 21 bp, Artificial sequence
  SiRNA target sequence
agtgattgatcaataaattac

SEQ ID NO: 52873 - DNA, 21 bp, Artificial sequence
  SiRNA target sequence
gtgattgatcaataaattact

SEQ ID NO: 52874 - DNA, 21 bp, Artificial sequence
  SiRNA target sequence
tgattgatcaataaattactg

SEQ ID NO: 52875 - DNA, 21 bp, Artificial sequence
  SiRNA target sequence
gattgatcaataaattactga

SEQ ID NO: 52876 - DNA, 21 bp, Artificial sequence
  SiRNA target sequence
attgatcaataaattactgat

SEQ ID NO: 52877 - DNA, 21 bp, Artificial sequence
  SiRNA target sequence
ttgatcaataaattactgatt

SEQ ID NO: 52878 - DNA, 21 bp, Artificial sequence
  SiRNA target sequence
tgatcaataaattactgattt

SEQ ID NO: 52879 - DNA, 21 bp, Artificial sequence
  SiRNA target sequence
gatcaataaattactgattta

SEQ ID NO: 52880 - DNA, 21 bp, Artificial sequence
  SiRNA target sequence
atcaataaattactgatttat

SEQ ID NO: 52881 - DNA, 21 bp, Artificial sequence
  SiRNA target sequence
tcaataaattactgatttatt

SEQ ID NO: 52882 - DNA, 21 bp, Artificial sequence
  SiRNA target sequence
caataaattactgatttatta

SEQ ID NO: 52883 - DNA, 21 bp, Artificial sequence
  SiRNA target sequence
aataaattactgatttattaa

SEQ ID NO: 52884 - DNA, 21 bp, Artificial sequence
  SiRNA target sequence
ataaattactgatttattaaa

SEQ ID NO: 52885 - DNA, 21 bp, Artificial sequence
  SiRNA target sequence
taaattactgatttattaaat

SEQ ID NO: 52886 - DNA, 21 bp, Artificial sequence
  SiRNA target sequence
aaattactgatttattaaatg

SEQ ID NO: 52887 - DNA, 21 bp, Artificial sequence
  SiRNA target sequence
aattactgatttattaaatga

SEQ ID NO: 52888 - DNA, 21 bp, Artificial sequence
  SiRNA target sequence
attactgatttattaaatgat

SEQ ID NO: 52889 - DNA, 21 bp, Artificial sequence
  SiRNA target sequence
ttactgatttattaaatgatt

SEQ ID NO: 52890 - DNA, 21 bp, Artificial sequence
  SiRNA target sequence
tactgatttattaaatgattt

SEQ ID NO: 52891 - DNA, 21 bp, Artificial sequence
  SiRNA target sequence
actgatttattaaatgatttt

SEQ ID NO: 52892 - DNA, 21 bp, Artificial sequence
  SiRNA target sequence
ctgatttattaaatgattttt

SEQ ID NO: 52893 - DNA, 21 bp, Artificial sequence
  SiRNA target sequence
tgatttattaaatgatttttt

SEQ ID NO: 52894 - DNA, 21 bp, Artificial sequence
  SiRNA target sequence
gatttattaaatgattttttt

SEQ ID NO: 52895 - DNA, 21 bp, Artificial sequence
  SiRNA target sequence
atttattaaatgatttttttg

SEQ ID NO: 52896 - DNA, 21 bp, Artificial sequence
  SiRNA target sequence
tttattaaatgatttttttga

SEQ ID NO: 52897 - DNA, 21 bp, Artificial sequence
  SiRNA target sequence
ttattaaatgatttttttgaa

SEQ ID NO: 52898 - DNA, 21 bp, Artificial sequence
  SiRNA target sequence
tattaaatgatttttttgaac

SEQ ID NO: 52899 - DNA, 21 bp, Artificial sequence
  SiRNA target sequence
attaaatgatttttttgaacc

SEQ ID NO: 52900 - DNA, 21 bp, Artificial sequence
  SiRNA target sequence
ttaaatgatttttttgaaccc

SEQ ID NO: 52901 - DNA, 21 bp, Artificial sequence
  SiRNA target sequence
taaatgatttttttgaaccct

SEQ ID NO: 52902 - DNA, 21 bp, Artificial sequence
  SiRNA target sequence
aaatgatttttttgaaccctt

SEQ ID NO: 52903 - DNA, 21 bp, Artificial sequence
  SiRNA target sequence
aatgatttttttgaacccttg

SEQ ID NO: 52904 - DNA, 21 bp, Artificial sequence
  SiRNA target sequence
atgatttttttgaacccttgt

SEQ ID NO: 52905 - DNA, 21 bp, Artificial sequence
  SiRNA target sequence
tgatttttttgaacccttgtt

SEQ ID NO: 52906 - DNA, 21 bp, Artificial sequence
  SiRNA target sequence
gatttttttgaacccttgtta

SEQ ID NO: 52907 - DNA, 21 bp, Artificial sequence
  SiRNA target sequence
atttttttgaacccttgttaa

SEQ ID NO: 52908 - DNA, 21 bp, Artificial sequence
  SiRNA target sequence
tttttttgaacccttgttaaa

SEQ ID NO: 52909 - DNA, 21 bp, Artificial sequence
  SiRNA target sequence
ttttttgaacccttgttaaaa

SEQ ID NO: 52910 - DNA, 21 bp, Artificial sequence
  SiRNA target sequence
tttttgaacccttgttaaaaa

SEQ ID NO: 52911 - DNA, 21 bp, Artificial sequence
  SiRNA target sequence
ttttgaacccttgttaaaaaa

SEQ ID NO: 52912 - DNA, 21 bp, Artificial sequence
  SiRNA target sequence
tttgaacccttgttaaaaaaa

SEQ ID NO: 52913 - DNA, 21 bp, Artificial sequence
  SiRNA target sequence
ttgaacccttgttaaaaaaat

SEQ ID NO: 52914 - DNA, 21 bp, Artificial sequence
  SiRNA target sequence
tgaacccttgttaaaaaaatt

SEQ ID NO: 52915 - DNA, 21 bp, Artificial sequence
  SiRNA target sequence
gaacccttgttaaaaaaatta

SEQ ID NO: 52916 - DNA, 21 bp, Artificial sequence
  SiRNA target sequence
aacccttgttaaaaaaattat

SEQ ID NO: 52917 - DNA, 21 bp, Artificial sequence
  SiRNA target sequence
acccttgttaaaaaaattatt

SEQ ID NO: 52918 - DNA, 21 bp, Artificial sequence
  SiRNA target sequence
cccttgttaaaaaaattattt

SEQ ID NO: 52919 - DNA, 21 bp, Artificial sequence
  SiRNA target sequence
ccttgttaaaaaaattattta

SEQ ID NO: 52920 - DNA, 21 bp, Artificial sequence
  SiRNA target sequence
cttgttaaaaaaattatttat

SEQ ID NO: 52921 - DNA, 21 bp, Artificial sequence
  SiRNA target sequence
ttgttaaaaaaattatttatt

SEQ ID NO: 52922 - DNA, 21 bp, Artificial sequence
  SiRNA target sequence
tgttaaaaaaattatttattt

SEQ ID NO: 52923 - DNA, 21 bp, Artificial sequence
  SiRNA target sequence
gttaaaaaaattatttatttc

SEQ ID NO: 52924 - DNA, 21 bp, Artificial sequence
  SiRNA target sequence
ttaaaaaaattatttatttca

SEQ ID NO: 52925 - DNA, 21 bp, Artificial sequence
  SiRNA target sequence
taaaaaaattatttatttcaa

SEQ ID NO: 52926 - DNA, 21 bp, Artificial sequence
  SiRNA target sequence
aaaaaaattatttatttcaat

SEQ ID NO: 52927 - DNA, 21 bp, Artificial sequence
  SiRNA target sequence
aaaaaattatttatttcaatt

SEQ ID NO: 52928 - DNA, 21 bp, Artificial sequence
  SiRNA target sequence
aaaaattatttatttcaattt

SEQ ID NO: 52929 - DNA, 21 bp, Artificial sequence
  SiRNA target sequence
aaaattatttatttcaatttg

SEQ ID NO: 52930 - DNA, 21 bp, Artificial sequence
  SiRNA target sequence
aaattatttatttcaatttga

SEQ ID NO: 52931 - DNA, 21 bp, Artificial sequence
  SiRNA target sequence
aattatttatttcaatttgat

SEQ ID NO: 52932 - DNA, 21 bp, Artificial sequence
  SiRNA target sequence
attatttatttcaatttgatg

SEQ ID NO: 52933 - DNA, 21 bp, Artificial sequence
  SiRNA target sequence
ttatttatttcaatttgatga

SEQ ID NO: 52934 - DNA, 21 bp, Artificial sequence
  SiRNA target sequence
tatttatttcaatttgatgat

SEQ ID NO: 52935 - DNA, 21 bp, Artificial sequence
  SiRNA target sequence
atttatttcaatttgatgata

SEQ ID NO: 52936 - DNA, 21 bp, Artificial sequence
  SiRNA target sequence
tttatttcaatttgatgatat

SEQ ID NO: 52937 - DNA, 21 bp, Artificial sequence
  SiRNA target sequence
ttatttcaatttgatgatata

SEQ ID NO: 52938 - DNA, 21 bp, Artificial sequence
  SiRNA target sequence
tatttcaatttgatgatatat

SEQ ID NO: 52939 - DNA, 21 bp, Artificial sequence
  SiRNA target sequence
atttcaatttgatgatatatc

SEQ ID NO: 52940 - DNA, 21 bp, Artificial sequence
  SiRNA target sequence
tttcaatttgatgatatatca

SEQ ID NO: 52941 - DNA, 21 bp, Artificial sequence
  SiRNA target sequence
ttcaatttgatgatatatcaa

SEQ ID NO: 52942 - DNA, 21 bp, Artificial sequence
  SiRNA target sequence
tcaatttgatgatatatcaat

SEQ ID NO: 52943 - DNA, 21 bp, Artificial sequence
  SiRNA target sequence
caatttgatgatatatcaata

SEQ ID NO: 52944 - DNA, 21 bp, Artificial sequence
  SiRNA target sequence
aatttgatgatatatcaatat

SEQ ID NO: 52945 - DNA, 21 bp, Artificial sequence
  SiRNA target sequence
atttgatgatatatcaatatg

SEQ ID NO: 52946 - DNA, 21 bp, Artificial sequence
  SiRNA target sequence
tttgatgatatatcaatatgt

SEQ ID NO: 52947 - DNA, 21 bp, Artificial sequence
  SiRNA target sequence
ttgatgatatatcaatatgtt

SEQ ID NO: 52948 - DNA, 21 bp, Artificial sequence
  SiRNA target sequence
tgatgatatatcaatatgttt

SEQ ID NO: 52949 - DNA, 21 bp, Artificial sequence
  SiRNA target sequence
gatgatatatcaatatgtttt

SEQ ID NO: 52950 - DNA, 21 bp, Artificial sequence
  SiRNA target sequence
atgatatatcaatatgttttg

SEQ ID NO: 52951 - DNA, 21 bp, Artificial sequence
  SiRNA target sequence
tgatatatcaatatgttttgt

SEQ ID NO: 52952 - DNA, 21 bp, Artificial sequence
  SiRNA target sequence
gatatatcaatatgttttgta

SEQ ID NO: 52953 - DNA, 21 bp, Artificial sequence
  SiRNA target sequence
atatatcaatatgttttgtac

SEQ ID NO: 52954 - DNA, 21 bp, Artificial sequence
  SiRNA target sequence
tatatcaatatgttttgtact

SEQ ID NO: 52955 - DNA, 21 bp, Artificial sequence
  SiRNA target sequence
atatcaatatgttttgtactt

SEQ ID NO: 52956 - DNA, 21 bp, Artificial sequence
  SiRNA target sequence
tatcaatatgttttgtacttt

SEQ ID NO: 52957 - DNA, 21 bp, Artificial sequence
  SiRNA target sequence
atcaatatgttttgtacttta

SEQ ID NO: 52958 - DNA, 21 bp, Artificial sequence
  SiRNA target sequence
tcaatatgttttgtactttat

SEQ ID NO: 52959 - DNA, 21 bp, Artificial sequence
  SiRNA target sequence
caatatgttttgtactttatt

SEQ ID NO: 52960 - DNA, 21 bp, Artificial sequence
  SiRNA target sequence
aatatgttttgtactttattt

SEQ ID NO: 52961 - DNA, 21 bp, Artificial sequence
  SiRNA target sequence
atatgttttgtactttatttt

SEQ ID NO: 52962 - DNA, 21 bp, Artificial sequence
  SiRNA target sequence
tatgttttgtactttattttt

SEQ ID NO: 52963 - DNA, 21 bp, Artificial sequence
  SiRNA target sequence
atgttttgtactttattttta

SEQ ID NO: 52964 - DNA, 21 bp, Artificial sequence
  SiRNA target sequence
tgttttgtactttatttttat

SEQ ID NO: 52965 - DNA, 21 bp, Artificial sequence
  SiRNA target sequence
gttttgtactttatttttatt

SEQ ID NO: 52966 - DNA, 21 bp, Artificial sequence
  SiRNA target sequence
ttttgtactttatttttattt

SEQ ID NO: 52967 - DNA, 21 bp, Artificial sequence
  SiRNA target sequence
tttgtactttatttttattta

SEQ ID NO: 52968 - DNA, 21 bp, Artificial sequence
  SiRNA target sequence
ttgtactttatttttatttat

SEQ ID NO: 52969 - DNA, 21 bp, Artificial sequence
  SiRNA target sequence
tgtactttatttttatttata

SEQ ID NO: 52970 - DNA, 21 bp, Artificial sequence
  SiRNA target sequence
gtactttatttttatttatag

SEQ ID NO: 52971 - DNA, 21 bp, Artificial sequence
  SiRNA target sequence
tactttatttttatttatagt

SEQ ID NO: 52972 - DNA, 21 bp, Artificial sequence
  SiRNA target sequence
actttatttttatttatagtt

SEQ ID NO: 52973 - DNA, 21 bp, Artificial sequence
  SiRNA target sequence
ctttatttttatttatagttt

SEQ ID NO: 52974 - DNA, 21 bp, Artificial sequence
  SiRNA target sequence
tttatttttatttatagtttt

SEQ ID NO: 52975 - DNA, 21 bp, Artificial sequence
  SiRNA target sequence
ttatttttatttatagttttc

SEQ ID NO: 52976 - DNA, 21 bp, Artificial sequence
  SiRNA target sequence
tatttttatttatagttttca

SEQ ID NO: 52977 - DNA, 21 bp, Artificial sequence
  SiRNA target sequence
atttttatttatagttttcat

SEQ ID NO: 52978 - DNA, 21 bp, Artificial sequence
  SiRNA target sequence
tttttatttatagttttcata

SEQ ID NO: 52979 - DNA, 21 bp, Artificial sequence
  SiRNA target sequence
ttttatttatagttttcatat

SEQ ID NO: 52980 - DNA, 21 bp, Artificial sequence
  SiRNA target sequence
tttatttatagttttcatata

SEQ ID NO: 52981 - DNA, 21 bp, Artificial sequence
  SiRNA target sequence
ttatttatagttttcatatat

SEQ ID NO: 52982 - DNA, 21 bp, Artificial sequence
  SiRNA target sequence
tatttatagttttcatatatt

SEQ ID NO: 52983 - DNA, 21 bp, Artificial sequence
  SiRNA target sequence
atttatagttttcatatatta

SEQ ID NO: 52984 - DNA, 21 bp, Artificial sequence
  SiRNA target sequence
tttatagttttcatatattat

SEQ ID NO: 52985 - DNA, 21 bp, Artificial sequence
  SiRNA target sequence
ttatagttttcatatattata

SEQ ID NO: 52986 - DNA, 21 bp, Artificial sequence
  SiRNA target sequence
tatagttttcatatattatat

SEQ ID NO: 52987 - DNA, 21 bp, Artificial sequence
  SiRNA target sequence
atagttttcatatattatatc

SEQ ID NO: 52988 - DNA, 21 bp, Artificial sequence
  SiRNA target sequence
tagttttcatatattatatct

SEQ ID NO: 52989 - DNA, 21 bp, Artificial sequence
  SiRNA target sequence
agttttcatatattatatctg

SEQ ID NO: 52990 - DNA, 21 bp, Artificial sequence
  SiRNA target sequence
gttttcatatattatatctgt

SEQ ID NO: 52991 - DNA, 21 bp, Artificial sequence
  SiRNA target sequence
ttttcatatattatatctgtg

SEQ ID NO: 52992 - DNA, 21 bp, Artificial sequence
  SiRNA target sequence
tttcatatattatatctgtga

SEQ ID NO: 52993 - DNA, 21 bp, Artificial sequence
  SiRNA target sequence
ttcatatattatatctgtgaa

SEQ ID NO: 52994 - DNA, 21 bp, Artificial sequence
  SiRNA target sequence
tcatatattatatctgtgaaa

SEQ ID NO: 52995 - DNA, 21 bp, Artificial sequence
  SiRNA target sequence
catatattatatctgtgaaat

SEQ ID NO: 52996 - DNA, 21 bp, Artificial sequence
  SiRNA target sequence
atatattatatctgtgaaata

SEQ ID NO: 52997 - DNA, 21 bp, Artificial sequence
  SiRNA target sequence
tatattatatctgtgaaatat

SEQ ID NO: 52998 - DNA, 21 bp, Artificial sequence
  SiRNA target sequence
atattatatctgtgaaatatg

SEQ ID NO: 52999 - DNA, 21 bp, Artificial sequence
  SiRNA target sequence
tattatatctgtgaaatatgt

SEQ ID NO: 53000 - DNA, 21 bp, Artificial sequence
  SiRNA target sequence
attatatctgtgaaatatgta

SEQ ID NO: 53001 - DNA, 21 bp, Artificial sequence
  SiRNA target sequence
ttatatctgtgaaatatgtat

SEQ ID NO: 53002 - DNA, 21 bp, Artificial sequence
  SiRNA target sequence
tatatctgtgaaatatgtata

SEQ ID NO: 53003 - DNA, 21 bp, Artificial sequence
  SiRNA target sequence
atatctgtgaaatatgtatat

SEQ ID NO: 53004 - DNA, 21 bp, Artificial sequence
  SiRNA target sequence
tatctgtgaaatatgtatatg

SEQ ID NO: 53005 - DNA, 21 bp, Artificial sequence
  SiRNA target sequence
atctgtgaaatatgtatatgt

SEQ ID NO: 53006 - DNA, 21 bp, Artificial sequence
  SiRNA target sequence
tctgtgaaatatgtatatgta

SEQ ID NO: 53007 - DNA, 21 bp, Artificial sequence
  SiRNA target sequence
ctgtgaaatatgtatatgtat

SEQ ID NO: 53008 - DNA, 21 bp, Artificial sequence
  SiRNA target sequence
tgtgaaatatgtatatgtatc

SEQ ID NO: 53009 - DNA, 21 bp, Artificial sequence
  SiRNA target sequence
gtgaaatatgtatatgtatct

SEQ ID NO: 53010 - DNA, 21 bp, Artificial sequence
  SiRNA target sequence
tgaaatatgtatatgtatctt

SEQ ID NO: 53011 - DNA, 21 bp, Artificial sequence
  SiRNA target sequence
gaaatatgtatatgtatcttt

SEQ ID NO: 53012 - DNA, 21 bp, Artificial sequence
  SiRNA target sequence
aaatatgtatatgtatcttta

SEQ ID NO: 53013 - DNA, 21 bp, Artificial sequence
  SiRNA target sequence
aatatgtatatgtatctttag

SEQ ID NO: 53014 - DNA, 21 bp, Artificial sequence
  SiRNA target sequence
atatgtatatgtatctttaga

SEQ ID NO: 53015 - DNA, 21 bp, Artificial sequence
  SiRNA target sequence
tatgtatatgtatctttagaa

SEQ ID NO: 53016 - DNA, 21 bp, Artificial sequence
  SiRNA target sequence
atgtatatgtatctttagaaa

SEQ ID NO: 53017 - DNA, 21 bp, Artificial sequence
  SiRNA target sequence
tgtatatgtatctttagaaat

SEQ ID NO: 53018 - DNA, 21 bp, Artificial sequence
  SiRNA target sequence
gtatatgtatctttagaaatt

SEQ ID NO: 53019 - DNA, 21 bp, Artificial sequence
  SiRNA target sequence
tatatgtatctttagaaattt

SEQ ID NO: 53020 - DNA, 21 bp, Artificial sequence
  SiRNA target sequence
atatgtatctttagaaattta

SEQ ID NO: 53021 - DNA, 21 bp, Artificial sequence
  SiRNA target sequence
tatgtatctttagaaatttac

SEQ ID NO: 53022 - DNA, 21 bp, Artificial sequence
  SiRNA target sequence
atgtatctttagaaatttact

SEQ ID NO: 53023 - DNA, 21 bp, Artificial sequence
  SiRNA target sequence
tgtatctttagaaatttactg

SEQ ID NO: 53024 - DNA, 21 bp, Artificial sequence
  SiRNA target sequence
gtatctttagaaatttactgt

SEQ ID NO: 53025 - DNA, 21 bp, Artificial sequence
  SiRNA target sequence
tatctttagaaatttactgtt

SEQ ID NO: 53026 - DNA, 21 bp, Artificial sequence
  SiRNA target sequence
atctttagaaatttactgttt

SEQ ID NO: 53027 - DNA, 21 bp, Artificial sequence
  SiRNA target sequence
tctttagaaatttactgtttc

SEQ ID NO: 53028 - DNA, 21 bp, Artificial sequence
  SiRNA target sequence
ctttagaaatttactgtttct

SEQ ID NO: 53029 - DNA, 21 bp, Artificial sequence
  SiRNA target sequence
tttagaaatttactgtttcta

SEQ ID NO: 53030 - DNA, 21 bp, Artificial sequence
  SiRNA target sequence
ttagaaatttactgtttctaa

SEQ ID NO: 53031 - DNA, 21 bp, Artificial sequence
  SiRNA target sequence
tagaaatttactgtttctaat

SEQ ID NO: 53032 - DNA, 21 bp, Artificial sequence
  SiRNA target sequence
agaaatttactgtttctaatt

SEQ ID NO: 53033 - DNA, 21 bp, Artificial sequence
  SiRNA target sequence
gaaatttactgtttctaatta

SEQ ID NO: 53034 - DNA, 21 bp, Artificial sequence
  SiRNA target sequence
aaatttactgtttctaattat

SEQ ID NO: 53035 - DNA, 21 bp, Artificial sequence
  SiRNA target sequence
aatttactgtttctaattatt

SEQ ID NO: 53036 - DNA, 21 bp, Artificial sequence
  SiRNA target sequence
atttactgtttctaattattt

SEQ ID NO: 53037 - DNA, 21 bp, Artificial sequence
  SiRNA target sequence
tttactgtttctaattatttt

SEQ ID NO: 53038 - DNA, 21 bp, Artificial sequence
  SiRNA target sequence
ttactgtttctaattattttc

SEQ ID NO: 53039 - DNA, 21 bp, Artificial sequence
  SiRNA target sequence
tactgtttctaattattttct

SEQ ID NO: 53040 - DNA, 21 bp, Artificial sequence
  SiRNA target sequence
actgtttctaattattttctt

SEQ ID NO: 53041 - DNA, 21 bp, Artificial sequence
  SiRNA target sequence
ctgtttctaattattttcttt

SEQ ID NO: 53042 - DNA, 21 bp, Artificial sequence
  SiRNA target sequence
tgtttctaattattttctttt

SEQ ID NO: 53043 - DNA, 21 bp, Artificial sequence
  SiRNA target sequence
gtttctaattattttctttta

SEQ ID NO: 53044 - DNA, 21 bp, Artificial sequence
  SiRNA target sequence
tttctaattattttcttttat

SEQ ID NO: 53045 - DNA, 21 bp, Artificial sequence
  SiRNA target sequence
ttctaattattttcttttata

SEQ ID NO: 53046 - DNA, 21 bp, Artificial sequence
  SiRNA target sequence
tctaattattttcttttatat

SEQ ID NO: 53047 - DNA, 21 bp, Artificial sequence
  SiRNA target sequence
ctaattattttcttttatata

SEQ ID NO: 53048 - DNA, 21 bp, Artificial sequence
  SiRNA target sequence
taattattttcttttatatac

SEQ ID NO: 53049 - DNA, 21 bp, Artificial sequence
  SiRNA target sequence
aattattttcttttatatact

SEQ ID NO: 53050 - DNA, 21 bp, Artificial sequence
  SiRNA target sequence
attattttcttttatatactg

SEQ ID NO: 53051 - DNA, 21 bp, Artificial sequence
  SiRNA target sequence
ttattttcttttatatactga

SEQ ID NO: 53052 - DNA, 21 bp, Artificial sequence
  SiRNA target sequence
tattttcttttatatactgac

SEQ ID NO: 53053 - DNA, 21 bp, Artificial sequence
  SiRNA target sequence
attttcttttatatactgact

SEQ ID NO: 53054 - DNA, 21 bp, Artificial sequence
  SiRNA target sequence
ttttcttttatatactgactt

SEQ ID NO: 53055 - DNA, 21 bp, Artificial sequence
  SiRNA target sequence
tttcttttatatactgacttt

SEQ ID NO: 53056 - DNA, 21 bp, Artificial sequence
  SiRNA target sequence
ttcttttatatactgactttt

SEQ ID NO: 53057 - DNA, 21 bp, Artificial sequence
  SiRNA target sequence
tcttttatatactgactttta

SEQ ID NO: 53058 - DNA, 21 bp, Artificial sequence
  SiRNA target sequence
cttttatatactgacttttat

SEQ ID NO: 53059 - DNA, 21 bp, Artificial sequence
  SiRNA target sequence
ttttatatactgacttttatg

SEQ ID NO: 53060 - DNA, 21 bp, Artificial sequence
  SiRNA target sequence
tttatatactgacttttatgg

SEQ ID NO: 53061 - DNA, 21 bp, Artificial sequence
  SiRNA target sequence
ttatatactgacttttatggt

SEQ ID NO: 53062 - DNA, 21 bp, Artificial sequence
  SiRNA target sequence
tatatactgacttttatggtt

SEQ ID NO: 53063 - DNA, 21 bp, Artificial sequence
  SiRNA target sequence
atatactgacttttatggtta

SEQ ID NO: 53064 - DNA, 21 bp, Artificial sequence
  SiRNA target sequence
tatactgacttttatggttat

SEQ ID NO: 53065 - DNA, 21 bp, Artificial sequence
  SiRNA target sequence
atactgacttttatggttata

SEQ ID NO: 53066 - DNA, 21 bp, Artificial sequence
  SiRNA target sequence
tactgacttttatggttatat

SEQ ID NO: 53067 - DNA, 21 bp, Artificial sequence
  SiRNA target sequence
actgacttttatggttatata

SEQ ID NO: 53068 - DNA, 21 bp, Artificial sequence
  SiRNA target sequence
ctgacttttatggttatatat

SEQ ID NO: 53069 - DNA, 21 bp, Artificial sequence
  SiRNA target sequence
tgacttttatggttatatata

SEQ ID NO: 53070 - DNA, 21 bp, Artificial sequence
  SiRNA target sequence
gacttttatggttatatataa

SEQ ID NO: 53071 - DNA, 21 bp, Artificial sequence
  SiRNA target sequence
acttttatggttatatataat

SEQ ID NO: 53072 - DNA, 21 bp, Artificial sequence
  SiRNA target sequence
cttttatggttatatataatg

SEQ ID NO: 53073 - DNA, 21 bp, Artificial sequence
  SiRNA target sequence
ttttatggttatatataatgt

SEQ ID NO: 53074 - DNA, 21 bp, Artificial sequence
  SiRNA target sequence
tttatggttatatataatgtt

SEQ ID NO: 53075 - DNA, 21 bp, Artificial sequence
  SiRNA target sequence
ttatggttatatataatgttg

SEQ ID NO: 53076 - DNA, 21 bp, Artificial sequence
  SiRNA target sequence
tatggttatatataatgttgt

SEQ ID NO: 53077 - DNA, 21 bp, Artificial sequence
  SiRNA target sequence
atggttatatataatgttgta

SEQ ID NO: 53078 - DNA, 21 bp, Artificial sequence
  SiRNA target sequence
tggttatatataatgttgtat

SEQ ID NO: 53079 - DNA, 21 bp, Artificial sequence
  SiRNA target sequence
ggttatatataatgttgtata

SEQ ID NO: 53080 - DNA, 21 bp, Artificial sequence
  SiRNA target sequence
gttatatataatgttgtatac

SEQ ID NO: 53081 - DNA, 21 bp, Artificial sequence
  SiRNA target sequence
ttatatataatgttgtataca

SEQ ID NO: 53082 - DNA, 21 bp, Artificial sequence
  SiRNA target sequence
tatatataatgttgtatacac

SEQ ID NO: 53083 - DNA, 21 bp, Artificial sequence
  SiRNA target sequence
atatataatgttgtatacaca

SEQ ID NO: 53084 - DNA, 21 bp, Artificial sequence
  SiRNA target sequence
tatataatgttgtatacacac

SEQ ID NO: 53085 - DNA, 21 bp, Artificial sequence
  SiRNA target sequence
atataatgttgtatacacaca

SEQ ID NO: 53086 - DNA, 21 bp, Artificial sequence
  SiRNA target sequence
tataatgttgtatacacacac

SEQ ID NO: 53087 - DNA, 21 bp, Artificial sequence
  SiRNA target sequence
ataatgttgtatacacacacc

SEQ ID NO: 53088 - DNA, 21 bp, Artificial sequence
  SiRNA target sequence
taatgttgtatacacacacca

SEQ ID NO: 53089 - DNA, 21 bp, Artificial sequence
  SiRNA target sequence
aatgttgtatacacacaccag

SEQ ID NO: 53090 - DNA, 21 bp, Artificial sequence
  SiRNA target sequence
atgttgtatacacacaccagg

SEQ ID NO: 53091 - DNA, 21 bp, Artificial sequence
  SiRNA target sequence
tgttgtatacacacaccaggt

SEQ ID NO: 53092 - DNA, 21 bp, Artificial sequence
  SiRNA target sequence
gttgtatacacacaccaggtt

SEQ ID NO: 53093 - DNA, 21 bp, Artificial sequence
  SiRNA target sequence
ttgtatacacacaccaggttg

SEQ ID NO: 53094 - DNA, 21 bp, Artificial sequence
  SiRNA target sequence
tgtatacacacaccaggttga

SEQ ID NO: 53095 - DNA, 21 bp, Artificial sequence
  SiRNA target sequence
gtatacacacaccaggttgat

SEQ ID NO: 53096 - DNA, 21 bp, Artificial sequence
  SiRNA target sequence
tatacacacaccaggttgatt

SEQ ID NO: 53097 - DNA, 21 bp, Artificial sequence
  SiRNA target sequence
atacacacaccaggttgattc

SEQ ID NO: 53098 - DNA, 21 bp, Artificial sequence
  SiRNA target sequence
tacacacaccaggttgattct

SEQ ID NO: 53099 - DNA, 21 bp, Artificial sequence
  SiRNA target sequence
acacacaccaggttgattctg

SEQ ID NO: 53100 - DNA, 21 bp, Artificial sequence
  SiRNA target sequence
cacacaccaggttgattctgc

SEQ ID NO: 53101 - DNA, 21 bp, Artificial sequence
  SiRNA target sequence
acacaccaggttgattctgcc

SEQ ID NO: 53102 - DNA, 21 bp, Artificial sequence
  SiRNA target sequence
cacaccaggttgattctgcct

SEQ ID NO: 53103 - DNA, 21 bp, Artificial sequence
  SiRNA target sequence
acaccaggttgattctgcctg

SEQ ID NO: 53104 - DNA, 21 bp, Artificial sequence
  SiRNA target sequence
caccaggttgattctgcctga

SEQ ID NO: 53105 - DNA, 21 bp, Artificial sequence
  SiRNA target sequence
accaggttgattctgcctgac

SEQ ID NO: 53106 - DNA, 21 bp, Artificial sequence
  SiRNA target sequence
ccaggttgattctgcctgacg

SEQ ID NO: 53107 - DNA, 21 bp, Artificial sequence
  SiRNA target sequence
caggttgattctgcctgacgt

SEQ ID NO: 53108 - DNA, 21 bp, Artificial sequence
  SiRNA target sequence
gcttaacttcggagagctgat

SEQ ID NO: 53109 - DNA, 21 bp, Artificial sequence
  SiRNA target sequence
cttaacttcggagagctgatg

SEQ ID NO: 53110 - DNA, 21 bp, Artificial sequence
  SiRNA target sequence
ttaacttcggagagctgatga

SEQ ID NO: 53111 - DNA, 21 bp, Artificial sequence
  SiRNA target sequence
taacttcggagagctgatgag

SEQ ID NO: 53112 - DNA, 21 bp, Artificial sequence
  SiRNA target sequence
aacttcggagagctgatgagt

SEQ ID NO: 53113 - DNA, 21 bp, Artificial sequence
  SiRNA target sequence
acttcggagagctgatgagtt

SEQ ID NO: 53114 - DNA, 21 bp, Artificial sequence
  SiRNA target sequence
cttcggagagctgatgagttc

SEQ ID NO: 53115 - DNA, 21 bp, Artificial sequence
  SiRNA target sequence
ttcggagagctgatgagttcc

SEQ ID NO: 53116 - DNA, 21 bp, Artificial sequence
  SiRNA target sequence
tcggagagctgatgagttccg

SEQ ID NO: 53117 - DNA, 21 bp, Artificial sequence
  SiRNA target sequence
cggagagctgatgagttccgg

SEQ ID NO: 53118 - DNA, 21 bp, Artificial sequence
  SiRNA target sequence
ggagagctgatgagttccggt

SEQ ID NO: 53119 - DNA, 21 bp, Artificial sequence
  SiRNA target sequence
gagagctgatgagttccggtg

SEQ ID NO: 53120 - DNA, 21 bp, Artificial sequence
  SiRNA target sequence
agagctgatgagttccggtgt

SEQ ID NO: 53121 - DNA, 21 bp, Artificial sequence
  SiRNA target sequence
gagctgatgagttccggtgtt

SEQ ID NO: 53122 - DNA, 21 bp, Artificial sequence
  SiRNA target sequence
agctgatgagttccggtgttt

SEQ ID NO: 53123 - DNA, 21 bp, Artificial sequence
  SiRNA target sequence
gctgatgagttccggtgtttt

SEQ ID NO: 53124 - DNA, 21 bp, Artificial sequence
  SiRNA target sequence
ctgatgagttccggtgtttta

SEQ ID NO: 53125 - DNA, 21 bp, Artificial sequence
  SiRNA target sequence
tgatgagttccggtgttttac

SEQ ID NO: 53126 - DNA, 21 bp, Artificial sequence
  SiRNA target sequence
gatgagttccggtgttttaca

SEQ ID NO: 53127 - DNA, 21 bp, Artificial sequence
  SiRNA target sequence
atgagttccggtgttttacag

SEQ ID NO: 53128 - DNA, 21 bp, Artificial sequence
  SiRNA target sequence
tgagttccggtgttttacagt

SEQ ID NO: 53129 - DNA, 21 bp, Artificial sequence
  SiRNA target sequence
gagttccggtgttttacagta

SEQ ID NO: 53130 - DNA, 21 bp, Artificial sequence
  SiRNA target sequence
agttccggtgttttacagtag

SEQ ID NO: 53131 - DNA, 21 bp, Artificial sequence
  SiRNA target sequence
gttccggtgttttacagtaga

SEQ ID NO: 53132 - DNA, 21 bp, Artificial sequence
  SiRNA target sequence
ttccggtgttttacagtagat

SEQ ID NO: 53133 - DNA, 21 bp, Artificial sequence
  SiRNA target sequence
tccggtgttttacagtagata

SEQ ID NO: 53134 - DNA, 21 bp, Artificial sequence
  SiRNA target sequence
ccggtgttttacagtagatat

SEQ ID NO: 53135 - DNA, 21 bp, Artificial sequence
  SiRNA target sequence
cggtgttttacagtagatatg

SEQ ID NO: 53136 - DNA, 21 bp, Artificial sequence
  SiRNA target sequence
ggtgttttacagtagatatgg

SEQ ID NO: 53137 - DNA, 21 bp, Artificial sequence
  SiRNA target sequence
gtgttttacagtagatatggc

SEQ ID NO: 53138 - DNA, 21 bp, Artificial sequence
  SiRNA target sequence
tgttttacagtagatatggcc

SEQ ID NO: 53139 - DNA, 21 bp, Artificial sequence
  SiRNA target sequence
gttttacagtagatatggccg

SEQ ID NO: 53140 - DNA, 21 bp, Artificial sequence
  SiRNA target sequence
ttttacagtagatatggccgt

SEQ ID NO: 53141 - DNA, 21 bp, Artificial sequence
  SiRNA target sequence
tttacagtagatatggccgta

SEQ ID NO: 53142 - DNA, 21 bp, Artificial sequence
  SiRNA target sequence
ttacagtagatatggccgtag

SEQ ID NO: 53143 - DNA, 21 bp, Artificial sequence
  SiRNA target sequence
tacagtagatatggccgtagc

SEQ ID NO: 53144 - DNA, 21 bp, Artificial sequence
  SiRNA target sequence
acagtagatatggccgtagct

SEQ ID NO: 53145 - DNA, 21 bp, Artificial sequence
  SiRNA target sequence
cagtagatatggccgtagcta

SEQ ID NO: 53146 - DNA, 21 bp, Artificial sequence
  SiRNA target sequence
agtagatatggccgtagctaa

SEQ ID NO: 53147 - DNA, 21 bp, Artificial sequence
  SiRNA target sequence
gtagatatggccgtagctaag

SEQ ID NO: 53148 - DNA, 21 bp, Artificial sequence
  SiRNA target sequence
tagatatggccgtagctaagc

SEQ ID NO: 53149 - DNA, 21 bp, Artificial sequence
  SiRNA target sequence
agatatggccgtagctaagcg

SEQ ID NO: 53150 - DNA, 21 bp, Artificial sequence
  SiRNA target sequence
gatatggccgtagctaagcgc

SEQ ID NO: 53151 - DNA, 21 bp, Artificial sequence
  SiRNA target sequence
atatggccgtagctaagcgct

SEQ ID NO: 53152 - DNA, 21 bp, Artificial sequence
  SiRNA target sequence
tatggccgtagctaagcgctg

SEQ ID NO: 53153 - DNA, 21 bp, Artificial sequence
  SiRNA target sequence
atggccgtagctaagcgctgg

SEQ ID NO: 53154 - DNA, 21 bp, Artificial sequence
  SiRNA target sequence
tggccgtagctaagcgctgga

SEQ ID NO: 53155 - DNA, 21 bp, Artificial sequence
  SiRNA target sequence
ggccgtagctaagcgctggat

SEQ ID NO: 53156 - DNA, 21 bp, Artificial sequence
  SiRNA target sequence
gccgtagctaagcgctggata

SEQ ID NO: 53157 - DNA, 21 bp, Artificial sequence
  SiRNA target sequence
ccgtagctaagcgctggatag

SEQ ID NO: 53158 - DNA, 21 bp, Artificial sequence
  SiRNA target sequence
cgtagctaagcgctggataga

SEQ ID NO: 53159 - DNA, 21 bp, Artificial sequence
  SiRNA target sequence
gtagctaagcgctggatagat

SEQ ID NO: 53160 - DNA, 21 bp, Artificial sequence
  SiRNA target sequence
tagctaagcgctggatagatt

SEQ ID NO: 53161 - DNA, 21 bp, Artificial sequence
  SiRNA target sequence
agctaagcgctggatagatta

SEQ ID NO: 53162 - DNA, 21 bp, Artificial sequence
  SiRNA target sequence
gctaagcgctggatagattaa

SEQ ID NO: 53163 - DNA, 21 bp, Artificial sequence
  SiRNA target sequence
ctaagcgctggatagattaaa

SEQ ID NO: 53164 - DNA, 21 bp, Artificial sequence
  SiRNA target sequence
taagcgctggatagattaaat

SEQ ID NO: 53165 - DNA, 21 bp, Artificial sequence
  SiRNA target sequence
aagcgctggatagattaaatt

SEQ ID NO: 53166 - DNA, 21 bp, Artificial sequence
  SiRNA target sequence
agcgctggatagattaaattt

SEQ ID NO: 53167 - DNA, 21 bp, Artificial sequence
  SiRNA target sequence
gcgctggatagattaaatttt

SEQ ID NO: 53168 - DNA, 21 bp, Artificial sequence
  SiRNA target sequence
cgctggatagattaaatttta

SEQ ID NO: 53169 - DNA, 21 bp, Artificial sequence
  SiRNA target sequence
gctggatagattaaattttat

SEQ ID NO: 53170 - DNA, 21 bp, Artificial sequence
  SiRNA target sequence
ctggatagattaaattttatt

SEQ ID NO: 53171 - DNA, 21 bp, Artificial sequence
  SiRNA target sequence
tggatagattaaattttatta

SEQ ID NO: 53172 - DNA, 21 bp, Artificial sequence
  SiRNA target sequence
ggatagattaaattttattaa

SEQ ID NO: 53173 - DNA, 21 bp, Artificial sequence
  SiRNA target sequence
gatagattaaattttattaaa

SEQ ID NO: 53174 - DNA, 21 bp, Artificial sequence
  SiRNA target sequence
atagattaaattttattaaac

SEQ ID NO: 53175 - DNA, 21 bp, Artificial sequence
  SiRNA target sequence
tagattaaattttattaaact

SEQ ID NO: 53176 - DNA, 21 bp, Artificial sequence
  SiRNA target sequence
agattaaattttattaaacta

SEQ ID NO: 53177 - DNA, 21 bp, Artificial sequence
  SiRNA target sequence
gattaaattttattaaactaa

SEQ ID NO: 53178 - DNA, 21 bp, Artificial sequence
  SiRNA target sequence
attaaattttattaaactaat

SEQ ID NO: 53179 - DNA, 21 bp, Artificial sequence
  SiRNA target sequence
ttaaattttattaaactaatt

SEQ ID NO: 53180 - DNA, 21 bp, Artificial sequence
  SiRNA target sequence
taaattttattaaactaattt

SEQ ID NO: 53181 - DNA, 21 bp, Artificial sequence
  SiRNA target sequence
aaattttattaaactaattta

SEQ ID NO: 53182 - DNA, 21 bp, Artificial sequence
  SiRNA target sequence
aattttattaaactaatttat

SEQ ID NO: 53183 - DNA, 21 bp, Artificial sequence
  SiRNA target sequence
attttattaaactaatttatt

SEQ ID NO: 53184 - DNA, 21 bp, Artificial sequence
  SiRNA target sequence
ttttattaaactaatttattg

SEQ ID NO: 53185 - DNA, 21 bp, Artificial sequence
  SiRNA target sequence
tttattaaactaatttattga

SEQ ID NO: 53186 - DNA, 21 bp, Artificial sequence
  SiRNA target sequence
ttattaaactaatttattgaa

SEQ ID NO: 53187 - DNA, 21 bp, Artificial sequence
  SiRNA target sequence
tattaaactaatttattgaaa

SEQ ID NO: 53188 - DNA, 21 bp, Artificial sequence
  SiRNA target sequence
attaaactaatttattgaaaa

SEQ ID NO: 53189 - DNA, 21 bp, Artificial sequence
  SiRNA target sequence
ttaaactaatttattgaaaaa

SEQ ID NO: 53190 - DNA, 21 bp, Artificial sequence
  SiRNA target sequence
taaactaatttattgaaaaag

SEQ ID NO: 53191 - DNA, 21 bp, Artificial sequence
  SiRNA target sequence
aaactaatttattgaaaaagt

SEQ ID NO: 53192 - DNA, 21 bp, Artificial sequence
  SiRNA target sequence
aactaatttattgaaaaagta

SEQ ID NO: 53193 - DNA, 21 bp, Artificial sequence
  SiRNA target sequence
actaatttattgaaaaagtag

SEQ ID NO: 53194 - DNA, 21 bp, Artificial sequence
  SiRNA target sequence
ctaatttattgaaaaagtagt

SEQ ID NO: 53195 - DNA, 21 bp, Artificial sequence
  SiRNA target sequence
taatttattgaaaaagtagtt

SEQ ID NO: 53196 - DNA, 21 bp, Artificial sequence
  SiRNA target sequence
aatttattgaaaaagtagttt

SEQ ID NO: 53197 - DNA, 21 bp, Artificial sequence
  SiRNA target sequence
atttattgaaaaagtagtttt

SEQ ID NO: 53198 - DNA, 21 bp, Artificial sequence
  SiRNA target sequence
tttattgaaaaagtagttttc

SEQ ID NO: 53199 - DNA, 21 bp, Artificial sequence
  SiRNA target sequence
ttattgaaaaagtagttttca

SEQ ID NO: 53200 - DNA, 21 bp, Artificial sequence
  SiRNA target sequence
tattgaaaaagtagttttcac

SEQ ID NO: 53201 - DNA, 21 bp, Artificial sequence
  SiRNA target sequence
attgaaaaagtagttttcaca

SEQ ID NO: 53202 - DNA, 21 bp, Artificial sequence
  SiRNA target sequence
ttgaaaaagtagttttcacat

SEQ ID NO: 53203 - DNA, 21 bp, Artificial sequence
  SiRNA target sequence
tgaaaaagtagttttcacatt

SEQ ID NO: 53204 - DNA, 21 bp, Artificial sequence
  SiRNA target sequence
gaaaaagtagttttcacatta

SEQ ID NO: 53205 - DNA, 21 bp, Artificial sequence
  SiRNA target sequence
aaaaagtagttttcacattat

SEQ ID NO: 53206 - DNA, 21 bp, Artificial sequence
  SiRNA target sequence
aaaagtagttttcacattatt

SEQ ID NO: 53207 - DNA, 21 bp, Artificial sequence
  SiRNA target sequence
aaagtagttttcacattattt

SEQ ID NO: 53208 - DNA, 21 bp, Artificial sequence
  SiRNA target sequence
aagtagttttcacattatttt

SEQ ID NO: 53209 - DNA, 21 bp, Artificial sequence
  SiRNA target sequence
agtagttttcacattattttc

SEQ ID NO: 53210 - DNA, 21 bp, Artificial sequence
  SiRNA target sequence
gtagttttcacattattttct

SEQ ID NO: 53211 - DNA, 21 bp, Artificial sequence
  SiRNA target sequence
tagttttcacattattttcta

SEQ ID NO: 53212 - DNA, 21 bp, Artificial sequence
  SiRNA target sequence
agttttcacattattttctaa

SEQ ID NO: 53213 - DNA, 21 bp, Artificial sequence
  SiRNA target sequence
gttttcacattattttctaaa

SEQ ID NO: 53214 - DNA, 21 bp, Artificial sequence
  SiRNA target sequence
ttttcacattattttctaaat

SEQ ID NO: 53215 - DNA, 21 bp, Artificial sequence
  SiRNA target sequence
tttcacattattttctaaatt

SEQ ID NO: 53216 - DNA, 21 bp, Artificial sequence
  SiRNA target sequence
ttcacattattttctaaattt

SEQ ID NO: 53217 - DNA, 21 bp, Artificial sequence
  SiRNA target sequence
tcacattattttctaaatttt

SEQ ID NO: 53218 - DNA, 21 bp, Artificial sequence
  SiRNA target sequence
cacattattttctaaattttc

SEQ ID NO: 53219 - DNA, 21 bp, Artificial sequence
  SiRNA target sequence
acattattttctaaattttca

SEQ ID NO: 53220 - DNA, 21 bp, Artificial sequence
  SiRNA target sequence
cattattttctaaattttcaa

SEQ ID NO: 53221 - DNA, 21 bp, Artificial sequence
  SiRNA target sequence
attattttctaaattttcaaa

SEQ ID NO: 53222 - DNA, 21 bp, Artificial sequence
  SiRNA target sequence
ttattttctaaattttcaaac

SEQ ID NO: 53223 - DNA, 21 bp, Artificial sequence
  SiRNA target sequence
tattttctaaattttcaaact

SEQ ID NO: 53224 - DNA, 21 bp, Artificial sequence
  SiRNA target sequence
attttctaaattttcaaactt

SEQ ID NO: 53225 - DNA, 21 bp, Artificial sequence
  SiRNA target sequence
ttttctaaattttcaaacttt

SEQ ID NO: 53226 - DNA, 21 bp, Artificial sequence
  SiRNA target sequence
tttctaaattttcaaactttt

SEQ ID NO: 53227 - DNA, 21 bp, Artificial sequence
  SiRNA target sequence
ttctaaattttcaaactttta

SEQ ID NO: 53228 - DNA, 21 bp, Artificial sequence
  SiRNA target sequence
tctaaattttcaaacttttaa

SEQ ID NO: 53229 - DNA, 21 bp, Artificial sequence
  SiRNA target sequence
ctaaattttcaaacttttaaa

SEQ ID NO: 53230 - DNA, 21 bp, Artificial sequence
  SiRNA target sequence
taaattttcaaacttttaaat

SEQ ID NO: 53231 - DNA, 21 bp, Artificial sequence
  SiRNA target sequence
aaattttcaaacttttaaatt

SEQ ID NO: 53232 - DNA, 21 bp, Artificial sequence
  SiRNA target sequence
aattttcaaacttttaaatta

SEQ ID NO: 53233 - DNA, 21 bp, Artificial sequence
  SiRNA target sequence
attttcaaacttttaaattat

SEQ ID NO: 53234 - DNA, 21 bp, Artificial sequence
  SiRNA target sequence
ttttcaaacttttaaattata

SEQ ID NO: 53235 - DNA, 21 bp, Artificial sequence
  SiRNA target sequence
tttcaaacttttaaattatag

SEQ ID NO: 53236 - DNA, 21 bp, Artificial sequence
  SiRNA target sequence
ttcaaacttttaaattatagt

SEQ ID NO: 53237 - DNA, 21 bp, Artificial sequence
  SiRNA target sequence
tcaaacttttaaattatagta

SEQ ID NO: 53238 - DNA, 21 bp, Artificial sequence
  SiRNA target sequence
caaacttttaaattatagtac

SEQ ID NO: 53239 - DNA, 21 bp, Artificial sequence
  SiRNA target sequence
aaacttttaaattatagtaca

SEQ ID NO: 53240 - DNA, 21 bp, Artificial sequence
  SiRNA target sequence
aacttttaaattatagtacaa

SEQ ID NO: 53241 - DNA, 21 bp, Artificial sequence
  SiRNA target sequence
acttttaaattatagtacaat

SEQ ID NO: 53242 - DNA, 21 bp, Artificial sequence
  SiRNA target sequence
cttttaaattatagtacaatt

SEQ ID NO: 53243 - DNA, 21 bp, Artificial sequence
  SiRNA target sequence
ttttaaattatagtacaatta

SEQ ID NO: 53244 - DNA, 21 bp, Artificial sequence
  SiRNA target sequence
tttaaattatagtacaattat

SEQ ID NO: 53245 - DNA, 21 bp, Artificial sequence
  SiRNA target sequence
ttaaattatagtacaattatt

SEQ ID NO: 53246 - DNA, 21 bp, Artificial sequence
  SiRNA target sequence
taaattatagtacaattattt

SEQ ID NO: 53247 - DNA, 21 bp, Artificial sequence
  SiRNA target sequence
aaattatagtacaattatttt

SEQ ID NO: 53248 - DNA, 21 bp, Artificial sequence
  SiRNA target sequence
aattatagtacaattattttg

SEQ ID NO: 53249 - DNA, 21 bp, Artificial sequence
  SiRNA target sequence
attatagtacaattattttgc

SEQ ID NO: 53250 - DNA, 21 bp, Artificial sequence
  SiRNA target sequence
ttatagtacaattattttgcg

SEQ ID NO: 53251 - DNA, 21 bp, Artificial sequence
  SiRNA target sequence
tatagtacaattattttgcga

SEQ ID NO: 53252 - DNA, 21 bp, Artificial sequence
  SiRNA target sequence
atagtacaattattttgcgaa

SEQ ID NO: 53253 - DNA, 21 bp, Artificial sequence
  SiRNA target sequence
tagtacaattattttgcgaaa

SEQ ID NO: 53254 - DNA, 21 bp, Artificial sequence
  SiRNA target sequence
agtacaattattttgcgaaat

SEQ ID NO: 53255 - DNA, 21 bp, Artificial sequence
  SiRNA target sequence
gtacaattattttgcgaaatt

SEQ ID NO: 53256 - DNA, 21 bp, Artificial sequence
  SiRNA target sequence
tacaattattttgcgaaattt

SEQ ID NO: 53257 - DNA, 21 bp, Artificial sequence
  SiRNA target sequence
acaattattttgcgaaattta

SEQ ID NO: 53258 - DNA, 21 bp, Artificial sequence
  SiRNA target sequence
caattattttgcgaaatttat

SEQ ID NO: 53259 - DNA, 21 bp, Artificial sequence
  SiRNA target sequence
aattattttgcgaaatttata

SEQ ID NO: 53260 - DNA, 21 bp, Artificial sequence
  SiRNA target sequence
attattttgcgaaatttataa

SEQ ID NO: 53261 - DNA, 21 bp, Artificial sequence
  SiRNA target sequence
ttattttgcgaaatttataat

SEQ ID NO: 53262 - DNA, 21 bp, Artificial sequence
  SiRNA target sequence
tattttgcgaaatttataatt

SEQ ID NO: 53263 - DNA, 21 bp, Artificial sequence
  SiRNA target sequence
attttgcgaaatttataattc

SEQ ID NO: 53264 - DNA, 21 bp, Artificial sequence
  SiRNA target sequence
ttttgcgaaatttataattca

SEQ ID NO: 53265 - DNA, 21 bp, Artificial sequence
  SiRNA target sequence
tttgcgaaatttataattcat

SEQ ID NO: 53266 - DNA, 21 bp, Artificial sequence
  SiRNA target sequence
ttgcgaaatttataattcatt

SEQ ID NO: 53267 - DNA, 21 bp, Artificial sequence
  SiRNA target sequence
tgcgaaatttataattcattg

SEQ ID NO: 53268 - DNA, 21 bp, Artificial sequence
  SiRNA target sequence
gcgaaatttataattcattga

SEQ ID NO: 53269 - DNA, 21 bp, Artificial sequence
  SiRNA target sequence
cgaaatttataattcattgat

SEQ ID NO: 53270 - DNA, 21 bp, Artificial sequence
  SiRNA target sequence
gaaatttataattcattgata

SEQ ID NO: 53271 - DNA, 21 bp, Artificial sequence
  SiRNA target sequence
aaatttataattcattgatat

SEQ ID NO: 53272 - DNA, 21 bp, Artificial sequence
  SiRNA target sequence
aatttataattcattgatata

SEQ ID NO: 53273 - DNA, 21 bp, Artificial sequence
  SiRNA target sequence
atttataattcattgatatat

SEQ ID NO: 53274 - DNA, 21 bp, Artificial sequence
  SiRNA target sequence
tttataattcattgatatatt

SEQ ID NO: 53275 - DNA, 21 bp, Artificial sequence
  SiRNA target sequence
ttataattcattgatatattc

SEQ ID NO: 53276 - DNA, 21 bp, Artificial sequence
  SiRNA target sequence
tataattcattgatatattct

SEQ ID NO: 53277 - DNA, 21 bp, Artificial sequence
  SiRNA target sequence
ataattcattgatatattctt

SEQ ID NO: 53278 - DNA, 21 bp, Artificial sequence
  SiRNA target sequence
taattcattgatatattctta

SEQ ID NO: 53279 - DNA, 21 bp, Artificial sequence
  SiRNA target sequence
aattcattgatatattcttaa

SEQ ID NO: 53280 - DNA, 21 bp, Artificial sequence
  SiRNA target sequence
attcattgatatattcttaaa

SEQ ID NO: 53281 - DNA, 21 bp, Artificial sequence
  SiRNA target sequence
ttcattgatatattcttaaaa

SEQ ID NO: 53282 - DNA, 21 bp, Artificial sequence
  SiRNA target sequence
tcattgatatattcttaaaag

SEQ ID NO: 53283 - DNA, 21 bp, Artificial sequence
  SiRNA target sequence
cattgatatattcttaaaagt

SEQ ID NO: 53284 - DNA, 21 bp, Artificial sequence
  SiRNA target sequence
attgatatattcttaaaagta

SEQ ID NO: 53285 - DNA, 21 bp, Artificial sequence
  SiRNA target sequence
ttgatatattcttaaaagtaa

SEQ ID NO: 53286 - DNA, 21 bp, Artificial sequence
  SiRNA target sequence
tgatatattcttaaaagtaat

SEQ ID NO: 53287 - DNA, 21 bp, Artificial sequence
  SiRNA target sequence
gatatattcttaaaagtaatc

SEQ ID NO: 53288 - DNA, 21 bp, Artificial sequence
  SiRNA target sequence
atatattcttaaaagtaatct

SEQ ID NO: 53289 - DNA, 21 bp, Artificial sequence
  SiRNA target sequence
tatattcttaaaagtaatcta

SEQ ID NO: 53290 - DNA, 21 bp, Artificial sequence
  SiRNA target sequence
atattcttaaaagtaatctat

SEQ ID NO: 53291 - DNA, 21 bp, Artificial sequence
  SiRNA target sequence
tattcttaaaagtaatctatt

SEQ ID NO: 53292 - DNA, 21 bp, Artificial sequence
  SiRNA target sequence
attcttaaaagtaatctatta

SEQ ID NO: 53293 - DNA, 21 bp, Artificial sequence
  SiRNA target sequence
ttcttaaaagtaatctattaa

SEQ ID NO: 53294 - DNA, 21 bp, Artificial sequence
  SiRNA target sequence
tcttaaaagtaatctattaac

SEQ ID NO: 53295 - DNA, 21 bp, Artificial sequence
  SiRNA target sequence
cttaaaagtaatctattaaca

SEQ ID NO: 53296 - DNA, 21 bp, Artificial sequence
  SiRNA target sequence
ttaaaagtaatctattaacat

SEQ ID NO: 53297 - DNA, 21 bp, Artificial sequence
  SiRNA target sequence
taaaagtaatctattaacatt

SEQ ID NO: 53298 - DNA, 21 bp, Artificial sequence
  SiRNA target sequence
aaaagtaatctattaacatta

SEQ ID NO: 53299 - DNA, 21 bp, Artificial sequence
  SiRNA target sequence
aaagtaatctattaacattaa

SEQ ID NO: 53300 - DNA, 21 bp, Artificial sequence
  SiRNA target sequence
aagtaatctattaacattaaa

SEQ ID NO: 53301 - DNA, 21 bp, Artificial sequence
  SiRNA target sequence
agtaatctattaacattaaat

SEQ ID NO: 53302 - DNA, 21 bp, Artificial sequence
  SiRNA target sequence
gtaatctattaacattaaatt

SEQ ID NO: 53303 - DNA, 21 bp, Artificial sequence
  SiRNA target sequence
taatctattaacattaaatta

SEQ ID NO: 53304 - DNA, 21 bp, Artificial sequence
  SiRNA target sequence
aatctattaacattaaattat

SEQ ID NO: 53305 - DNA, 21 bp, Artificial sequence
  SiRNA target sequence
atctattaacattaaattata

SEQ ID NO: 53306 - DNA, 21 bp, Artificial sequence
  SiRNA target sequence
tctattaacattaaattataa

SEQ ID NO: 53307 - DNA, 21 bp, Artificial sequence
  SiRNA target sequence
ctattaacattaaattataaa

SEQ ID NO: 53308 - DNA, 21 bp, Artificial sequence
  SiRNA target sequence
tattaacattaaattataaaa

SEQ ID NO: 53309 - DNA, 21 bp, Artificial sequence
  SiRNA target sequence
attaacattaaattataaaaa

SEQ ID NO: 53310 - DNA, 21 bp, Artificial sequence
  SiRNA target sequence
ttaacattaaattataaaaat

SEQ ID NO: 53311 - DNA, 21 bp, Artificial sequence
  SiRNA target sequence
taacattaaattataaaaatt

SEQ ID NO: 53312 - DNA, 21 bp, Artificial sequence
  SiRNA target sequence
aacattaaattataaaaattt

SEQ ID NO: 53313 - DNA, 21 bp, Artificial sequence
  SiRNA target sequence
acattaaattataaaaatttt

SEQ ID NO: 53314 - DNA, 21 bp, Artificial sequence
  SiRNA target sequence
cattaaattataaaaattttt

SEQ ID NO: 53315 - DNA, 21 bp, Artificial sequence
  SiRNA target sequence
attaaattataaaaattttta

SEQ ID NO: 53316 - DNA, 21 bp, Artificial sequence
  SiRNA target sequence
ttaaattataaaaatttttat

SEQ ID NO: 53317 - DNA, 21 bp, Artificial sequence
  SiRNA target sequence
taaattataaaaatttttatg

SEQ ID NO: 53318 - DNA, 21 bp, Artificial sequence
  SiRNA target sequence
aaattataaaaatttttatgt

SEQ ID NO: 53319 - DNA, 21 bp, Artificial sequence
  SiRNA target sequence
aattataaaaatttttatgta

SEQ ID NO: 53320 - DNA, 21 bp, Artificial sequence
  SiRNA target sequence
attataaaaatttttatgtac

SEQ ID NO: 53321 - DNA, 21 bp, Artificial sequence
  SiRNA target sequence
ttataaaaatttttatgtact

SEQ ID NO: 53322 - DNA, 21 bp, Artificial sequence
  SiRNA target sequence
tataaaaatttttatgtactt

SEQ ID NO: 53323 - DNA, 21 bp, Artificial sequence
  SiRNA target sequence
ataaaaatttttatgtacttt

SEQ ID NO: 53324 - DNA, 21 bp, Artificial sequence
  SiRNA target sequence
taaaaatttttatgtactttg

SEQ ID NO: 53325 - DNA, 21 bp, Artificial sequence
  SiRNA target sequence
aaaaatttttatgtactttgt

SEQ ID NO: 53326 - DNA, 21 bp, Artificial sequence
  SiRNA target sequence
aaaatttttatgtactttgta

SEQ ID NO: 53327 - DNA, 21 bp, Artificial sequence
  SiRNA target sequence
aaatttttatgtactttgtaa

SEQ ID NO: 53328 - DNA, 21 bp, Artificial sequence
  SiRNA target sequence
aatttttatgtactttgtaat

SEQ ID NO: 53329 - DNA, 21 bp, Artificial sequence
  SiRNA target sequence
atttttatgtactttgtaatt

SEQ ID NO: 53330 - DNA, 21 bp, Artificial sequence
  SiRNA target sequence
tttttatgtactttgtaatta

SEQ ID NO: 53331 - DNA, 21 bp, Artificial sequence
  SiRNA target sequence
ttttatgtactttgtaattac

SEQ ID NO: 53332 - DNA, 21 bp, Artificial sequence
  SiRNA target sequence
tttatgtactttgtaattaca

SEQ ID NO: 53333 - DNA, 21 bp, Artificial sequence
  SiRNA target sequence
ttatgtactttgtaattacat

SEQ ID NO: 53334 - DNA, 21 bp, Artificial sequence
  SiRNA target sequence
tatgtactttgtaattacatt

SEQ ID NO: 53335 - DNA, 21 bp, Artificial sequence
  SiRNA target sequence
atgtactttgtaattacatta

SEQ ID NO: 53336 - DNA, 21 bp, Artificial sequence
  SiRNA target sequence
tgtactttgtaattacattat

SEQ ID NO: 53337 - DNA, 21 bp, Artificial sequence
  SiRNA target sequence
gtactttgtaattacattata

SEQ ID NO: 53338 - DNA, 21 bp, Artificial sequence
  SiRNA target sequence
tactttgtaattacattataa

SEQ ID NO: 53339 - DNA, 21 bp, Artificial sequence
  SiRNA target sequence
actttgtaattacattataac

SEQ ID NO: 53340 - DNA, 21 bp, Artificial sequence
  SiRNA target sequence
ctttgtaattacattataaca

SEQ ID NO: 53341 - DNA, 21 bp, Artificial sequence
  SiRNA target sequence
tttgtaattacattataacac

SEQ ID NO: 53342 - DNA, 21 bp, Artificial sequence
  SiRNA target sequence
ttgtaattacattataacacg

SEQ ID NO: 53343 - DNA, 21 bp, Artificial sequence
  SiRNA target sequence
tgtaattacattataacacga

SEQ ID NO: 53344 - DNA, 21 bp, Artificial sequence
  SiRNA target sequence
gtaattacattataacacgat

SEQ ID NO: 53345 - DNA, 21 bp, Artificial sequence
  SiRNA target sequence
taattacattataacacgata

SEQ ID NO: 53346 - DNA, 21 bp, Artificial sequence
  SiRNA target sequence
aattacattataacacgataa

SEQ ID NO: 53347 - DNA, 21 bp, Artificial sequence
  SiRNA target sequence
attacattataacacgataaa

SEQ ID NO: 53348 - DNA, 21 bp, Artificial sequence
  SiRNA target sequence
ttacattataacacgataaaa

SEQ ID NO: 53349 - DNA, 21 bp, Artificial sequence
  SiRNA target sequence
tacattataacacgataaaaa

SEQ ID NO: 53350 - DNA, 21 bp, Artificial sequence
  SiRNA target sequence
acattataacacgataaaaat

SEQ ID NO: 53351 - DNA, 21 bp, Artificial sequence
  SiRNA target sequence
cattataacacgataaaaata

SEQ ID NO: 53352 - DNA, 21 bp, Artificial sequence
  SiRNA target sequence
attataacacgataaaaataa

SEQ ID NO: 53353 - DNA, 21 bp, Artificial sequence
  SiRNA target sequence
ttataacacgataaaaataat

SEQ ID NO: 53354 - DNA, 21 bp, Artificial sequence
  SiRNA target sequence
tataacacgataaaaataata

SEQ ID NO: 53355 - DNA, 21 bp, Artificial sequence
  SiRNA target sequence
ataacacgataaaaataataa

SEQ ID NO: 53356 - DNA, 21 bp, Artificial sequence
  SiRNA target sequence
taacacgataaaaataataat

SEQ ID NO: 53357 - DNA, 21 bp, Artificial sequence
  SiRNA target sequence
aacacgataaaaataataata

SEQ ID NO: 53358 - DNA, 21 bp, Artificial sequence
  SiRNA target sequence
acacgataaaaataataatac

SEQ ID NO: 53359 - DNA, 21 bp, Artificial sequence
  SiRNA target sequence
cacgataaaaataataataca

SEQ ID NO: 53360 - DNA, 21 bp, Artificial sequence
  SiRNA target sequence
acgataaaaataataatacac

SEQ ID NO: 53361 - DNA, 21 bp, Artificial sequence
  SiRNA target sequence
cgataaaaataataatacact

SEQ ID NO: 53362 - DNA, 21 bp, Artificial sequence
  SiRNA target sequence
gataaaaataataatacactt

SEQ ID NO: 53363 - DNA, 21 bp, Artificial sequence
  SiRNA target sequence
ataaaaataataatacacttt

SEQ ID NO: 53364 - DNA, 21 bp, Artificial sequence
  SiRNA target sequence
taaaaataataatacactttt

SEQ ID NO: 53365 - DNA, 21 bp, Artificial sequence
  SiRNA target sequence
aaaaataataatacacttttg

SEQ ID NO: 53366 - DNA, 21 bp, Artificial sequence
  SiRNA target sequence
aaaataataatacacttttgt

SEQ ID NO: 53367 - DNA, 21 bp, Artificial sequence
  SiRNA target sequence
aaataataatacacttttgta

SEQ ID NO: 53368 - DNA, 21 bp, Artificial sequence
  SiRNA target sequence
aataataatacacttttgtat

SEQ ID NO: 53369 - DNA, 21 bp, Artificial sequence
  SiRNA target sequence
ataataatacacttttgtatt

SEQ ID NO: 53370 - DNA, 21 bp, Artificial sequence
  SiRNA target sequence
taataatacacttttgtattt

SEQ ID NO: 53371 - DNA, 21 bp, Artificial sequence
  SiRNA target sequence
aataatacacttttgtattta

SEQ ID NO: 53372 - DNA, 21 bp, Artificial sequence
  SiRNA target sequence
ataatacacttttgtatttat

SEQ ID NO: 53373 - DNA, 21 bp, Artificial sequence
  SiRNA target sequence
taatacacttttgtatttatc

SEQ ID NO: 53374 - DNA, 21 bp, Artificial sequence
  SiRNA target sequence
aatacacttttgtatttatct

SEQ ID NO: 53375 - DNA, 21 bp, Artificial sequence
  SiRNA target sequence
atacacttttgtatttatcta

SEQ ID NO: 53376 - DNA, 21 bp, Artificial sequence
  SiRNA target sequence
tacacttttgtatttatctaa

SEQ ID NO: 53377 - DNA, 21 bp, Artificial sequence
  SiRNA target sequence
acacttttgtatttatctaat

SEQ ID NO: 53378 - DNA, 21 bp, Artificial sequence
  SiRNA target sequence
cacttttgtatttatctaata

SEQ ID NO: 53379 - DNA, 21 bp, Artificial sequence
  SiRNA target sequence
acttttgtatttatctaatag

SEQ ID NO: 53380 - DNA, 21 bp, Artificial sequence
  SiRNA target sequence
cttttgtatttatctaataga

SEQ ID NO: 53381 - DNA, 21 bp, Artificial sequence
  SiRNA target sequence
ttttgtatttatctaatagat

SEQ ID NO: 53382 - DNA, 21 bp, Artificial sequence
  SiRNA target sequence
tttgtatttatctaatagatt

SEQ ID NO: 53383 - DNA, 21 bp, Artificial sequence
  SiRNA target sequence
ttgtatttatctaatagattt

SEQ ID NO: 53384 - DNA, 21 bp, Artificial sequence
  SiRNA target sequence
tgtatttatctaatagattta

SEQ ID NO: 53385 - DNA, 21 bp, Artificial sequence
  SiRNA target sequence
gtatttatctaatagatttat

SEQ ID NO: 53386 - DNA, 21 bp, Artificial sequence
  SiRNA target sequence
tatttatctaatagatttata

SEQ ID NO: 53387 - DNA, 21 bp, Artificial sequence
  SiRNA target sequence
atttatctaatagatttatat

SEQ ID NO: 53388 - DNA, 21 bp, Artificial sequence
  SiRNA target sequence
tttatctaatagatttatata

SEQ ID NO: 53389 - DNA, 21 bp, Artificial sequence
  SiRNA target sequence
ttatctaatagatttatataa

SEQ ID NO: 53390 - DNA, 21 bp, Artificial sequence
  SiRNA target sequence
tatctaatagatttatataat

SEQ ID NO: 53391 - DNA, 21 bp, Artificial sequence
  SiRNA target sequence
atctaatagatttatataata

SEQ ID NO: 53392 - DNA, 21 bp, Artificial sequence
  SiRNA target sequence
tctaatagatttatataataa

SEQ ID NO: 53393 - DNA, 21 bp, Artificial sequence
  SiRNA target sequence
ctaatagatttatataataaa

SEQ ID NO: 53394 - DNA, 21 bp, Artificial sequence
  SiRNA target sequence
taatagatttatataataaac

SEQ ID NO: 53395 - DNA, 21 bp, Artificial sequence
  SiRNA target sequence
aatagatttatataataaaca

SEQ ID NO: 53396 - DNA, 21 bp, Artificial sequence
  SiRNA target sequence
atagatttatataataaacat

SEQ ID NO: 53397 - DNA, 21 bp, Artificial sequence
  SiRNA target sequence
tagatttatataataaacatt

SEQ ID NO: 53398 - DNA, 21 bp, Artificial sequence
  SiRNA target sequence
agatttatataataaacatta

SEQ ID NO: 53399 - DNA, 21 bp, Artificial sequence
  SiRNA target sequence
gatttatataataaacattaa

SEQ ID NO: 53400 - DNA, 21 bp, Artificial sequence
  SiRNA target sequence
atttatataataaacattaat

SEQ ID NO: 53401 - DNA, 21 bp, Artificial sequence
  SiRNA target sequence
tttatataataaacattaatg

SEQ ID NO: 53402 - DNA, 21 bp, Artificial sequence
  SiRNA target sequence
ttatataataaacattaatga

SEQ ID NO: 53403 - DNA, 21 bp, Artificial sequence
  SiRNA target sequence
tatataataaacattaatgat

SEQ ID NO: 53404 - DNA, 21 bp, Artificial sequence
  SiRNA target sequence
atataataaacattaatgatt

SEQ ID NO: 53405 - DNA, 21 bp, Artificial sequence
  SiRNA target sequence
tataataaacattaatgattc

SEQ ID NO: 53406 - DNA, 21 bp, Artificial sequence
  SiRNA target sequence
ataataaacattaatgattct

SEQ ID NO: 53407 - DNA, 21 bp, Artificial sequence
  SiRNA target sequence
taataaacattaatgattctt

SEQ ID NO: 53408 - DNA, 21 bp, Artificial sequence
  SiRNA target sequence
aataaacattaatgattcttt

SEQ ID NO: 53409 - DNA, 21 bp, Artificial sequence
  SiRNA target sequence
ataaacattaatgattctttt

SEQ ID NO: 53410 - DNA, 21 bp, Artificial sequence
  SiRNA target sequence
taaacattaatgattcttttt

SEQ ID NO: 53411 - DNA, 21 bp, Artificial sequence
  SiRNA target sequence
aaacattaatgattcttttta

SEQ ID NO: 53412 - DNA, 21 bp, Artificial sequence
  SiRNA target sequence
aacattaatgattctttttag

SEQ ID NO: 53413 - DNA, 21 bp, Artificial sequence
  SiRNA target sequence
acattaatgattctttttagt

SEQ ID NO: 53414 - DNA, 21 bp, Artificial sequence
  SiRNA target sequence
cattaatgattctttttagtt

SEQ ID NO: 53415 - DNA, 21 bp, Artificial sequence
  SiRNA target sequence
attaatgattctttttagttg

SEQ ID NO: 53416 - DNA, 21 bp, Artificial sequence
  SiRNA target sequence
ttaatgattctttttagttgt

SEQ ID NO: 53417 - DNA, 21 bp, Artificial sequence
  SiRNA target sequence
taatgattctttttagttgtt

SEQ ID NO: 53418 - DNA, 21 bp, Artificial sequence
  SiRNA target sequence
aatgattctttttagttgtta

SEQ ID NO: 53419 - DNA, 21 bp, Artificial sequence
  SiRNA target sequence
atgattctttttagttgttac

SEQ ID NO: 53420 - DNA, 21 bp, Artificial sequence
  SiRNA target sequence
tgattctttttagttgttact

SEQ ID NO: 53421 - DNA, 21 bp, Artificial sequence
  SiRNA target sequence
gattctttttagttgttacta

SEQ ID NO: 53422 - DNA, 21 bp, Artificial sequence
  SiRNA target sequence
attctttttagttgttactaa

SEQ ID NO: 53423 - DNA, 21 bp, Artificial sequence
  SiRNA target sequence
ttctttttagttgttactaat

SEQ ID NO: 53424 - DNA, 21 bp, Artificial sequence
  SiRNA target sequence
tctttttagttgttactaatt

SEQ ID NO: 53425 - DNA, 21 bp, Artificial sequence
  SiRNA target sequence
ctttttagttgttactaattt

SEQ ID NO: 53426 - DNA, 21 bp, Artificial sequence
  SiRNA target sequence
tttttagttgttactaattta

SEQ ID NO: 53427 - DNA, 21 bp, Artificial sequence
  SiRNA target sequence
ttttagttgttactaatttat

SEQ ID NO: 53428 - DNA, 21 bp, Artificial sequence
  SiRNA target sequence
tttagttgttactaatttatg

SEQ ID NO: 53429 - DNA, 21 bp, Artificial sequence
  SiRNA target sequence
ttagttgttactaatttatgc

SEQ ID NO: 53430 - DNA, 21 bp, Artificial sequence
  SiRNA target sequence
tagttgttactaatttatgcc

SEQ ID NO: 53431 - DNA, 21 bp, Artificial sequence
  SiRNA target sequence
agttgttactaatttatgcca

SEQ ID NO: 53432 - DNA, 21 bp, Artificial sequence
  SiRNA target sequence
gttgttactaatttatgccat

SEQ ID NO: 53433 - DNA, 21 bp, Artificial sequence
  SiRNA target sequence
ttgttactaatttatgccata

SEQ ID NO: 53434 - DNA, 21 bp, Artificial sequence
  SiRNA target sequence
tgttactaatttatgccatat

SEQ ID NO: 53435 - DNA, 21 bp, Artificial sequence
  SiRNA target sequence
gttactaatttatgccatata

SEQ ID NO: 53436 - DNA, 21 bp, Artificial sequence
  SiRNA target sequence
ttactaatttatgccatatat

SEQ ID NO: 53437 - DNA, 21 bp, Artificial sequence
  SiRNA target sequence
tactaatttatgccatatatt

SEQ ID NO: 53438 - DNA, 21 bp, Artificial sequence
  SiRNA target sequence
actaatttatgccatatatta

SEQ ID NO: 53439 - DNA, 21 bp, Artificial sequence
  SiRNA target sequence
ctaatttatgccatatattat

SEQ ID NO: 53440 - DNA, 21 bp, Artificial sequence
  SiRNA target sequence
taatttatgccatatattata

SEQ ID NO: 53441 - DNA, 21 bp, Artificial sequence
  SiRNA target sequence
aatttatgccatatattatat

SEQ ID NO: 53442 - DNA, 21 bp, Artificial sequence
  SiRNA target sequence
atttatgccatatattatata

SEQ ID NO: 53443 - DNA, 21 bp, Artificial sequence
  SiRNA target sequence
tttatgccatatattatatac

SEQ ID NO: 53444 - DNA, 21 bp, Artificial sequence
  SiRNA target sequence
ttatgccatatattatataca

SEQ ID NO: 53445 - DNA, 21 bp, Artificial sequence
  SiRNA target sequence
tatgccatatattatatacat

SEQ ID NO: 53446 - DNA, 21 bp, Artificial sequence
  SiRNA target sequence
atgccatatattatatacatt

SEQ ID NO: 53447 - DNA, 21 bp, Artificial sequence
  SiRNA target sequence
tgccatatattatatacattt

SEQ ID NO: 53448 - DNA, 21 bp, Artificial sequence
  SiRNA target sequence
gccatatattatatacatttc

SEQ ID NO: 53449 - DNA, 21 bp, Artificial sequence
  SiRNA target sequence
ccatatattatatacatttct

SEQ ID NO: 53450 - DNA, 21 bp, Artificial sequence
  SiRNA target sequence
catatattatatacatttcta

SEQ ID NO: 53451 - DNA, 21 bp, Artificial sequence
  SiRNA target sequence
atatattatatacatttctat

SEQ ID NO: 53452 - DNA, 21 bp, Artificial sequence
  SiRNA target sequence
tatattatatacatttctata

SEQ ID NO: 53453 - DNA, 21 bp, Artificial sequence
  SiRNA target sequence
atattatatacatttctataa

SEQ ID NO: 53454 - DNA, 21 bp, Artificial sequence
  SiRNA target sequence
tattatatacatttctataat

SEQ ID NO: 53455 - DNA, 21 bp, Artificial sequence
  SiRNA target sequence
attatatacatttctataatt

SEQ ID NO: 53456 - DNA, 21 bp, Artificial sequence
  SiRNA target sequence
ttatatacatttctataatta

SEQ ID NO: 53457 - DNA, 21 bp, Artificial sequence
  SiRNA target sequence
tatatacatttctataattaa

SEQ ID NO: 53458 - DNA, 21 bp, Artificial sequence
  SiRNA target sequence
atatacatttctataattaaa

SEQ ID NO: 53459 - DNA, 21 bp, Artificial sequence
  SiRNA target sequence
tatacatttctataattaaat

SEQ ID NO: 53460 - DNA, 21 bp, Artificial sequence
  SiRNA target sequence
atacatttctataattaaatc

SEQ ID NO: 53461 - DNA, 21 bp, Artificial sequence
  SiRNA target sequence
tacatttctataattaaatca

SEQ ID NO: 53462 - DNA, 21 bp, Artificial sequence
  SiRNA target sequence
acatttctataattaaatcaa

SEQ ID NO: 53463 - DNA, 21 bp, Artificial sequence
  SiRNA target sequence
catttctataattaaatcaaa

SEQ ID NO: 53464 - DNA, 21 bp, Artificial sequence
  SiRNA target sequence
atttctataattaaatcaaaa

SEQ ID NO: 53465 - DNA, 21 bp, Artificial sequence
  SiRNA target sequence
tttctataattaaatcaaaaa

SEQ ID NO: 53466 - DNA, 21 bp, Artificial sequence
  SiRNA target sequence
ttctataattaaatcaaaaaa

SEQ ID NO: 53467 - DNA, 21 bp, Artificial sequence
  SiRNA target sequence
tctataattaaatcaaaaaag

SEQ ID NO: 53468 - DNA, 21 bp, Artificial sequence
  SiRNA target sequence
ctataattaaatcaaaaaagt

SEQ ID NO: 53469 - DNA, 21 bp, Artificial sequence
  SiRNA target sequence
tataattaaatcaaaaaagtt

SEQ ID NO: 53470 - DNA, 21 bp, Artificial sequence
  SiRNA target sequence
ataattaaatcaaaaaagtta

SEQ ID NO: 53471 - DNA, 21 bp, Artificial sequence
  SiRNA target sequence
taattaaatcaaaaaagttat

SEQ ID NO: 53472 - DNA, 21 bp, Artificial sequence
  SiRNA target sequence
aattaaatcaaaaaagttatt

SEQ ID NO: 53473 - DNA, 21 bp, Artificial sequence
  SiRNA target sequence
attaaatcaaaaaagttattt

SEQ ID NO: 53474 - DNA, 21 bp, Artificial sequence
  SiRNA target sequence
ttaaatcaaaaaagttattta

SEQ ID NO: 53475 - DNA, 21 bp, Artificial sequence
  SiRNA target sequence
taaatcaaaaaagttatttat

SEQ ID NO: 53476 - DNA, 21 bp, Artificial sequence
  SiRNA target sequence
aaatcaaaaaagttatttatt

SEQ ID NO: 53477 - DNA, 21 bp, Artificial sequence
  SiRNA target sequence
aatcaaaaaagttatttattc

SEQ ID NO: 53478 - DNA, 21 bp, Artificial sequence
  SiRNA target sequence
atcaaaaaagttatttattct

SEQ ID NO: 53479 - DNA, 21 bp, Artificial sequence
  SiRNA target sequence
tcaaaaaagttatttattctt

SEQ ID NO: 53480 - DNA, 21 bp, Artificial sequence
  SiRNA target sequence
caaaaaagttatttattcttg

SEQ ID NO: 53481 - DNA, 21 bp, Artificial sequence
  SiRNA target sequence
aaaaaagttatttattcttga

SEQ ID NO: 53482 - DNA, 21 bp, Artificial sequence
  SiRNA target sequence
aaaaagttatttattcttgag

SEQ ID NO: 53483 - DNA, 21 bp, Artificial sequence
  SiRNA target sequence
aaaagttatttattcttgagg

SEQ ID NO: 53484 - DNA, 21 bp, Artificial sequence
  SiRNA target sequence
aaagttatttattcttgagga

SEQ ID NO: 53485 - DNA, 21 bp, Artificial sequence
  SiRNA target sequence
aagttatttattcttgaggag

SEQ ID NO: 53486 - DNA, 21 bp, Artificial sequence
  SiRNA target sequence
agttatttattcttgaggagc

SEQ ID NO: 53487 - DNA, 21 bp, Artificial sequence
  SiRNA target sequence
gttatttattcttgaggagca

SEQ ID NO: 53488 - DNA, 21 bp, Artificial sequence
  SiRNA target sequence
ttatttattcttgaggagcaa

SEQ ID NO: 53489 - DNA, 21 bp, Artificial sequence
  SiRNA target sequence
tatttattcttgaggagcaat

SEQ ID NO: 53490 - DNA, 21 bp, Artificial sequence
  SiRNA target sequence
atttattcttgaggagcaatt

SEQ ID NO: 53491 - DNA, 21 bp, Artificial sequence
  SiRNA target sequence
tttattcttgaggagcaattt

SEQ ID NO: 53492 - DNA, 21 bp, Artificial sequence
  SiRNA target sequence
ttattcttgaggagcaatttt

SEQ ID NO: 53493 - DNA, 21 bp, Artificial sequence
  SiRNA target sequence
tattcttgaggagcaattttt

SEQ ID NO: 53494 - DNA, 21 bp, Artificial sequence
  SiRNA target sequence
attcttgaggagcaatttttt

SEQ ID NO: 53495 - DNA, 21 bp, Artificial sequence
  SiRNA target sequence
ttcttgaggagcaattttttc

SEQ ID NO: 53496 - DNA, 21 bp, Artificial sequence
  SiRNA target sequence
tcttgaggagcaattttttct

SEQ ID NO: 53497 - DNA, 21 bp, Artificial sequence
  SiRNA target sequence
cttgaggagcaattttttctt

SEQ ID NO: 53498 - DNA, 21 bp, Artificial sequence
  SiRNA target sequence
ttgaggagcaattttttctta

SEQ ID NO: 53499 - DNA, 21 bp, Artificial sequence
  SiRNA target sequence
tgaggagcaattttttcttat

SEQ ID NO: 53500 - DNA, 21 bp, Artificial sequence
  SiRNA target sequence
gaggagcaattttttcttatt

SEQ ID NO: 53501 - DNA, 21 bp, Artificial sequence
  SiRNA target sequence
aggagcaattttttcttattt

SEQ ID NO: 53502 - DNA, 21 bp, Artificial sequence
  SiRNA target sequence
ggagcaattttttcttattta

SEQ ID NO: 53503 - DNA, 21 bp, Artificial sequence
  SiRNA target sequence
gagcaattttttcttatttaa

SEQ ID NO: 53504 - DNA, 21 bp, Artificial sequence
  SiRNA target sequence
agcaattttttcttatttaaa

SEQ ID NO: 53505 - DNA, 21 bp, Artificial sequence
  SiRNA target sequence
gcaattttttcttatttaaaa

SEQ ID NO: 53506 - DNA, 21 bp, Artificial sequence
  SiRNA target sequence
caattttttcttatttaaaaa

SEQ ID NO: 53507 - DNA, 21 bp, Artificial sequence
  SiRNA target sequence
aattttttcttatttaaaaat

SEQ ID NO: 53508 - DNA, 21 bp, Artificial sequence
  SiRNA target sequence
attttttcttatttaaaaatt

SEQ ID NO: 53509 - DNA, 21 bp, Artificial sequence
  SiRNA target sequence
ttttttcttatttaaaaattt

SEQ ID NO: 53510 - DNA, 21 bp, Artificial sequence
  SiRNA target sequence
tttttcttatttaaaaatttt

SEQ ID NO: 53511 - DNA, 21 bp, Artificial sequence
  SiRNA target sequence
ttttcttatttaaaaattttc

SEQ ID NO: 53512 - DNA, 21 bp, Artificial sequence
  SiRNA target sequence
tttcttatttaaaaattttct

SEQ ID NO: 53513 - DNA, 21 bp, Artificial sequence
  SiRNA target sequence
ttcttatttaaaaattttcta

SEQ ID NO: 53514 - DNA, 21 bp, Artificial sequence
  SiRNA target sequence
tcttatttaaaaattttctaa

SEQ ID NO: 53515 - DNA, 21 bp, Artificial sequence
  SiRNA target sequence
cttatttaaaaattttctaat

SEQ ID NO: 53516 - DNA, 21 bp, Artificial sequence
  SiRNA target sequence
ttatttaaaaattttctaatc

SEQ ID NO: 53517 - DNA, 21 bp, Artificial sequence
  SiRNA target sequence
tatttaaaaattttctaatct

SEQ ID NO: 53518 - DNA, 21 bp, Artificial sequence
  SiRNA target sequence
atttaaaaattttctaatctg

SEQ ID NO: 53519 - DNA, 21 bp, Artificial sequence
  SiRNA target sequence
tttaaaaattttctaatctgt

SEQ ID NO: 53520 - DNA, 21 bp, Artificial sequence
  SiRNA target sequence
ttaaaaattttctaatctgta

SEQ ID NO: 53521 - DNA, 21 bp, Artificial sequence
  SiRNA target sequence
taaaaattttctaatctgtaa

SEQ ID NO: 53522 - DNA, 21 bp, Artificial sequence
  SiRNA target sequence
aaaaattttctaatctgtaaa

SEQ ID NO: 53523 - DNA, 21 bp, Artificial sequence
  SiRNA target sequence
aaaattttctaatctgtaaat

SEQ ID NO: 53524 - DNA, 21 bp, Artificial sequence
  SiRNA target sequence
aaattttctaatctgtaaatt

SEQ ID NO: 53525 - DNA, 21 bp, Artificial sequence
  SiRNA target sequence
aattttctaatctgtaaatta

SEQ ID NO: 53526 - DNA, 21 bp, Artificial sequence
  SiRNA target sequence
attttctaatctgtaaattag

SEQ ID NO: 53527 - DNA, 21 bp, Artificial sequence
  SiRNA target sequence
ttttctaatctgtaaattagt

SEQ ID NO: 53528 - DNA, 21 bp, Artificial sequence
  SiRNA target sequence
tttctaatctgtaaattagtg

SEQ ID NO: 53529 - DNA, 21 bp, Artificial sequence
  SiRNA target sequence
ttctaatctgtaaattagtga

SEQ ID NO: 53530 - DNA, 21 bp, Artificial sequence
  SiRNA target sequence
tctaatctgtaaattagtgat

SEQ ID NO: 53531 - DNA, 21 bp, Artificial sequence
  SiRNA target sequence
ctaatctgtaaattagtgatt

SEQ ID NO: 53532 - DNA, 21 bp, Artificial sequence
  SiRNA target sequence
taatctgtaaattagtgattg

SEQ ID NO: 53533 - DNA, 21 bp, Artificial sequence
  SiRNA target sequence
aatctgtaaattagtgattga

SEQ ID NO: 53534 - DNA, 21 bp, Artificial sequence
  SiRNA target sequence
atctgtaaattagtgattgat

SEQ ID NO: 53535 - DNA, 21 bp, Artificial sequence
  SiRNA target sequence
tctgtaaattagtgattgatc

SEQ ID NO: 53536 - DNA, 21 bp, Artificial sequence
  SiRNA target sequence
ctgtaaattagtgattgatca

SEQ ID NO: 53537 - DNA, 21 bp, Artificial sequence
  SiRNA target sequence
tgtaaattagtgattgatcaa

SEQ ID NO: 53538 - DNA, 21 bp, Artificial sequence
  SiRNA target sequence
gtaaattagtgattgatcaat

SEQ ID NO: 53539 - DNA, 21 bp, Artificial sequence
  SiRNA target sequence
taaattagtgattgatcaata

SEQ ID NO: 53540 - DNA, 21 bp, Artificial sequence
  SiRNA target sequence
aaattagtgattgatcaataa

SEQ ID NO: 53541 - DNA, 21 bp, Artificial sequence
  SiRNA target sequence
aattagtgattgatcaataaa

SEQ ID NO: 53542 - DNA, 21 bp, Artificial sequence
  SiRNA target sequence
attagtgattgatcaataaat

SEQ ID NO: 53543 - DNA, 21 bp, Artificial sequence
  SiRNA target sequence
ttagtgattgatcaataaatt

SEQ ID NO: 53544 - DNA, 21 bp, Artificial sequence
  SiRNA target sequence
tagtgattgatcaataaatta

SEQ ID NO: 53545 - DNA, 21 bp, Artificial sequence
  SiRNA target sequence
agtgattgatcaataaattac

SEQ ID NO: 53546 - DNA, 21 bp, Artificial sequence
  SiRNA target sequence
gtgattgatcaataaattact

SEQ ID NO: 53547 - DNA, 21 bp, Artificial sequence
  SiRNA target sequence
tgattgatcaataaattactg

SEQ ID NO: 53548 - DNA, 21 bp, Artificial sequence
  SiRNA target sequence
gattgatcaataaattactga

SEQ ID NO: 53549 - DNA, 21 bp, Artificial sequence
  SiRNA target sequence
attgatcaataaattactgat

SEQ ID NO: 53550 - DNA, 21 bp, Artificial sequence
  SiRNA target sequence
ttgatcaataaattactgatt

SEQ ID NO: 53551 - DNA, 21 bp, Artificial sequence
  SiRNA target sequence
tgatcaataaattactgattt

SEQ ID NO: 53552 - DNA, 21 bp, Artificial sequence
  SiRNA target sequence
gatcaataaattactgattta

SEQ ID NO: 53553 - DNA, 21 bp, Artificial sequence
  SiRNA target sequence
atcaataaattactgatttat

SEQ ID NO: 53554 - DNA, 21 bp, Artificial sequence
  SiRNA target sequence
tcaataaattactgatttatt

SEQ ID NO: 53555 - DNA, 21 bp, Artificial sequence
  SiRNA target sequence
caataaattactgatttatta

SEQ ID NO: 53556 - DNA, 21 bp, Artificial sequence
  SiRNA target sequence
aataaattactgatttattaa

SEQ ID NO: 53557 - DNA, 21 bp, Artificial sequence
  SiRNA target sequence
ataaattactgatttattaaa

SEQ ID NO: 53558 - DNA, 21 bp, Artificial sequence
  SiRNA target sequence
taaattactgatttattaaat

SEQ ID NO: 53559 - DNA, 21 bp, Artificial sequence
  SiRNA target sequence
aaattactgatttattaaatg

SEQ ID NO: 53560 - DNA, 21 bp, Artificial sequence
  SiRNA target sequence
aattactgatttattaaatga

SEQ ID NO: 53561 - DNA, 21 bp, Artificial sequence
  SiRNA target sequence
attactgatttattaaatgat

SEQ ID NO: 53562 - DNA, 21 bp, Artificial sequence
  SiRNA target sequence
ttactgatttattaaatgatt

SEQ ID NO: 53563 - DNA, 21 bp, Artificial sequence
  SiRNA target sequence
tactgatttattaaatgattt

SEQ ID NO: 53564 - DNA, 21 bp, Artificial sequence
  SiRNA target sequence
actgatttattaaatgatttt

SEQ ID NO: 53565 - DNA, 21 bp, Artificial sequence
  SiRNA target sequence
ctgatttattaaatgattttt

SEQ ID NO: 53566 - DNA, 21 bp, Artificial sequence
  SiRNA target sequence
tgatttattaaatgattttta

SEQ ID NO: 53567 - DNA, 21 bp, Artificial sequence
  SiRNA target sequence
gatttattaaatgatttttaa

SEQ ID NO: 53568 - DNA, 21 bp, Artificial sequence
  SiRNA target sequence
atttattaaatgatttttaaa

SEQ ID NO: 53569 - DNA, 21 bp, Artificial sequence
  SiRNA target sequence
tttattaaatgatttttaaac

SEQ ID NO: 53570 - DNA, 21 bp, Artificial sequence
  SiRNA target sequence
ttattaaatgatttttaaacc

SEQ ID NO: 53571 - DNA, 21 bp, Artificial sequence
  SiRNA target sequence
tattaaatgatttttaaaccc

SEQ ID NO: 53572 - DNA, 21 bp, Artificial sequence
  SiRNA target sequence
attaaatgatttttaaaccct

SEQ ID NO: 53573 - DNA, 21 bp, Artificial sequence
  SiRNA target sequence
ttaaatgatttttaaaccctt

SEQ ID NO: 53574 - DNA, 21 bp, Artificial sequence
  SiRNA target sequence
taaatgatttttaaacccttg

SEQ ID NO: 53575 - DNA, 21 bp, Artificial sequence
  SiRNA target sequence
aaatgatttttaaacccttgt

SEQ ID NO: 53576 - DNA, 21 bp, Artificial sequence
  SiRNA target sequence
aatgatttttaaacccttgtt

SEQ ID NO: 53577 - DNA, 21 bp, Artificial sequence
  SiRNA target sequence
atgatttttaaacccttgtta

SEQ ID NO: 53578 - DNA, 21 bp, Artificial sequence
  SiRNA target sequence
tgatttttaaacccttgttaa

SEQ ID NO: 53579 - DNA, 21 bp, Artificial sequence
  SiRNA target sequence
gatttttaaacccttgttaaa

SEQ ID NO: 53580 - DNA, 21 bp, Artificial sequence
  SiRNA target sequence
atttttaaacccttgttaaaa

SEQ ID NO: 53581 - DNA, 21 bp, Artificial sequence
  SiRNA target sequence
tttttaaacccttgttaaaaa

SEQ ID NO: 53582 - DNA, 21 bp, Artificial sequence
  SiRNA target sequence
ttttaaacccttgttaaaaaa

SEQ ID NO: 53583 - DNA, 21 bp, Artificial sequence
  SiRNA target sequence
tttaaacccttgttaaaaaaa

SEQ ID NO: 53584 - DNA, 21 bp, Artificial sequence
  SiRNA target sequence
ttaaacccttgttaaaaaaat

SEQ ID NO: 53585 - DNA, 21 bp, Artificial sequence
  SiRNA target sequence
taaacccttgttaaaaaaatt

SEQ ID NO: 53586 - DNA, 21 bp, Artificial sequence
  SiRNA target sequence
aaacccttgttaaaaaaatta

SEQ ID NO: 53587 - DNA, 21 bp, Artificial sequence
  SiRNA target sequence
aacccttgttaaaaaaattat

SEQ ID NO: 53588 - DNA, 21 bp, Artificial sequence
  SiRNA target sequence
acccttgttaaaaaaattatt

SEQ ID NO: 53589 - DNA, 21 bp, Artificial sequence
  SiRNA target sequence
cccttgttaaaaaaattattt

SEQ ID NO: 53590 - DNA, 21 bp, Artificial sequence
  SiRNA target sequence
ccttgttaaaaaaattattta

SEQ ID NO: 53591 - DNA, 21 bp, Artificial sequence
  SiRNA target sequence
cttgttaaaaaaattatttat

SEQ ID NO: 53592 - DNA, 21 bp, Artificial sequence
  SiRNA target sequence
ttgttaaaaaaattatttatt

SEQ ID NO: 53593 - DNA, 21 bp, Artificial sequence
  SiRNA target sequence
tgttaaaaaaattatttattt

SEQ ID NO: 53594 - DNA, 21 bp, Artificial sequence
  SiRNA target sequence
gttaaaaaaattatttatttt

SEQ ID NO: 53595 - DNA, 21 bp, Artificial sequence
  SiRNA target sequence
ttaaaaaaattatttatttta

SEQ ID NO: 53596 - DNA, 21 bp, Artificial sequence
  SiRNA target sequence
taaaaaaattatttattttaa

SEQ ID NO: 53597 - DNA, 21 bp, Artificial sequence
  SiRNA target sequence
aaaaaaattatttattttaat

SEQ ID NO: 53598 - DNA, 21 bp, Artificial sequence
  SiRNA target sequence
aaaaaattatttattttaatt

SEQ ID NO: 53599 - DNA, 21 bp, Artificial sequence
  SiRNA target sequence
aaaaattatttattttaattt

SEQ ID NO: 53600 - DNA, 21 bp, Artificial sequence
  SiRNA target sequence
aaaattatttattttaatttg

SEQ ID NO: 53601 - DNA, 21 bp, Artificial sequence
  SiRNA target sequence
aaattatttattttaatttga

SEQ ID NO: 53602 - DNA, 21 bp, Artificial sequence
  SiRNA target sequence
aattatttattttaatttgat

SEQ ID NO: 53603 - DNA, 21 bp, Artificial sequence
  SiRNA target sequence
attatttattttaatttgata

SEQ ID NO: 53604 - DNA, 21 bp, Artificial sequence
  SiRNA target sequence
ttatttattttaatttgataa

SEQ ID NO: 53605 - DNA, 21 bp, Artificial sequence
  SiRNA target sequence
tatttattttaatttgataat

SEQ ID NO: 53606 - DNA, 21 bp, Artificial sequence
  SiRNA target sequence
atttattttaatttgataata

SEQ ID NO: 53607 - DNA, 21 bp, Artificial sequence
  SiRNA target sequence
tttattttaatttgataatat

SEQ ID NO: 53608 - DNA, 21 bp, Artificial sequence
  SiRNA target sequence
ttattttaatttgataatata

SEQ ID NO: 53609 - DNA, 21 bp, Artificial sequence
  SiRNA target sequence
tattttaatttgataatatat

SEQ ID NO: 53610 - DNA, 21 bp, Artificial sequence
  SiRNA target sequence
attttaatttgataatatatc

SEQ ID NO: 53611 - DNA, 21 bp, Artificial sequence
  SiRNA target sequence
ttttaatttgataatatatca

SEQ ID NO: 53612 - DNA, 21 bp, Artificial sequence
  SiRNA target sequence
tttaatttgataatatatcaa

SEQ ID NO: 53613 - DNA, 21 bp, Artificial sequence
  SiRNA target sequence
ttaatttgataatatatcaat

SEQ ID NO: 53614 - DNA, 21 bp, Artificial sequence
  SiRNA target sequence
taatttgataatatatcaata

SEQ ID NO: 53615 - DNA, 21 bp, Artificial sequence
  SiRNA target sequence
aatttgataatatatcaatat

SEQ ID NO: 53616 - DNA, 21 bp, Artificial sequence
  SiRNA target sequence
atttgataatatatcaatatg

SEQ ID NO: 53617 - DNA, 21 bp, Artificial sequence
  SiRNA target sequence
tttgataatatatcaatatgt

SEQ ID NO: 53618 - DNA, 21 bp, Artificial sequence
  SiRNA target sequence
ttgataatatatcaatatgtc

SEQ ID NO: 53619 - DNA, 21 bp, Artificial sequence
  SiRNA target sequence
tgataatatatcaatatgtct

SEQ ID NO: 53620 - DNA, 21 bp, Artificial sequence
  SiRNA target sequence
gataatatatcaatatgtctt

SEQ ID NO: 53621 - DNA, 21 bp, Artificial sequence
  SiRNA target sequence
ataatatatcaatatgtcttg

SEQ ID NO: 53622 - DNA, 21 bp, Artificial sequence
  SiRNA target sequence
taatatatcaatatgtcttgt

SEQ ID NO: 53623 - DNA, 21 bp, Artificial sequence
  SiRNA target sequence
aatatatcaatatgtcttgta

SEQ ID NO: 53624 - DNA, 21 bp, Artificial sequence
  SiRNA target sequence
atatatcaatatgtcttgtac

SEQ ID NO: 53625 - DNA, 21 bp, Artificial sequence
  SiRNA target sequence
tatatcaatatgtcttgtact

SEQ ID NO: 53626 - DNA, 21 bp, Artificial sequence
  SiRNA target sequence
atatcaatatgtcttgtactt

SEQ ID NO: 53627 - DNA, 21 bp, Artificial sequence
  SiRNA target sequence
tatcaatatgtcttgtacttt

SEQ ID NO: 53628 - DNA, 21 bp, Artificial sequence
  SiRNA target sequence
atcaatatgtcttgtacttta

SEQ ID NO: 53629 - DNA, 21 bp, Artificial sequence
  SiRNA target sequence
tcaatatgtcttgtactttat

SEQ ID NO: 53630 - DNA, 21 bp, Artificial sequence
  SiRNA target sequence
caatatgtcttgtactttatt

SEQ ID NO: 53631 - DNA, 21 bp, Artificial sequence
  SiRNA target sequence
aatatgtcttgtactttattt

SEQ ID NO: 53632 - DNA, 21 bp, Artificial sequence
  SiRNA target sequence
atatgtcttgtactttatttt

SEQ ID NO: 53633 - DNA, 21 bp, Artificial sequence
  SiRNA target sequence
tatgtcttgtactttattttt

SEQ ID NO: 53634 - DNA, 21 bp, Artificial sequence
  SiRNA target sequence
atgtcttgtactttattttta

SEQ ID NO: 53635 - DNA, 21 bp, Artificial sequence
  SiRNA target sequence
tgtcttgtactttatttttat

SEQ ID NO: 53636 - DNA, 21 bp, Artificial sequence
  SiRNA target sequence
gtcttgtactttatttttatt

SEQ ID NO: 53637 - DNA, 21 bp, Artificial sequence
  SiRNA target sequence
tcttgtactttatttttattt

SEQ ID NO: 53638 - DNA, 21 bp, Artificial sequence
  SiRNA target sequence
cttgtactttatttttattta

SEQ ID NO: 53639 - DNA, 21 bp, Artificial sequence
  SiRNA target sequence
ttgtactttatttttatttat

SEQ ID NO: 53640 - DNA, 21 bp, Artificial sequence
  SiRNA target sequence
tgtactttatttttatttata

SEQ ID NO: 53641 - DNA, 21 bp, Artificial sequence
  SiRNA target sequence
gtactttatttttatttatat

SEQ ID NO: 53642 - DNA, 21 bp, Artificial sequence
  SiRNA target sequence
tactttatttttatttatata

SEQ ID NO: 53643 - DNA, 21 bp, Artificial sequence
  SiRNA target sequence
actttatttttatttatatag

SEQ ID NO: 53644 - DNA, 21 bp, Artificial sequence
  SiRNA target sequence
ctttatttttatttatatagt

SEQ ID NO: 53645 - DNA, 21 bp, Artificial sequence
  SiRNA target sequence
tttatttttatttatatagtt

SEQ ID NO: 53646 - DNA, 21 bp, Artificial sequence
  SiRNA target sequence
ttatttttatttatatagttt

SEQ ID NO: 53647 - DNA, 21 bp, Artificial sequence
  SiRNA target sequence
tatttttatttatatagtttt

SEQ ID NO: 53648 - DNA, 21 bp, Artificial sequence
  SiRNA target sequence
atttttatttatatagttttc

SEQ ID NO: 53649 - DNA, 21 bp, Artificial sequence
  SiRNA target sequence
tttttatttatatagttttca

SEQ ID NO: 53650 - DNA, 21 bp, Artificial sequence
  SiRNA target sequence
ttttatttatatagttttcat

SEQ ID NO: 53651 - DNA, 21 bp, Artificial sequence
  SiRNA target sequence
tttatttatatagttttcata

SEQ ID NO: 53652 - DNA, 21 bp, Artificial sequence
  SiRNA target sequence
ttatttatatagttttcatat

SEQ ID NO: 53653 - DNA, 21 bp, Artificial sequence
  SiRNA target sequence
tatttatatagttttcatata

SEQ ID NO: 53654 - DNA, 21 bp, Artificial sequence
  SiRNA target sequence
atttatatagttttcatatat

SEQ ID NO: 53655 - DNA, 21 bp, Artificial sequence
  SiRNA target sequence
tttatatagttttcatatatt

SEQ ID NO: 53656 - DNA, 21 bp, Artificial sequence
  SiRNA target sequence
ttatatagttttcatatatta

SEQ ID NO: 53657 - DNA, 21 bp, Artificial sequence
  SiRNA target sequence
tatatagttttcatatattat

SEQ ID NO: 53658 - DNA, 21 bp, Artificial sequence
  SiRNA target sequence
atatagttttcatatattata

SEQ ID NO: 53659 - DNA, 21 bp, Artificial sequence
  SiRNA target sequence
tatagttttcatatattatat

SEQ ID NO: 53660 - DNA, 21 bp, Artificial sequence
  SiRNA target sequence
atagttttcatatattatatc

SEQ ID NO: 53661 - DNA, 21 bp, Artificial sequence
  SiRNA target sequence
tagttttcatatattatatct

SEQ ID NO: 53662 - DNA, 21 bp, Artificial sequence
  SiRNA target sequence
agttttcatatattatatctg

SEQ ID NO: 53663 - DNA, 21 bp, Artificial sequence
  SiRNA target sequence
gttttcatatattatatctgt

SEQ ID NO: 53664 - DNA, 21 bp, Artificial sequence
  SiRNA target sequence
ttttcatatattatatctgtg

SEQ ID NO: 53665 - DNA, 21 bp, Artificial sequence
  SiRNA target sequence
tttcatatattatatctgtgg

SEQ ID NO: 53666 - DNA, 21 bp, Artificial sequence
  SiRNA target sequence
ttcatatattatatctgtgga

SEQ ID NO: 53667 - DNA, 21 bp, Artificial sequence
  SiRNA target sequence
tcatatattatatctgtggaa

SEQ ID NO: 53668 - DNA, 21 bp, Artificial sequence
  SiRNA target sequence
catatattatatctgtggaat

SEQ ID NO: 53669 - DNA, 21 bp, Artificial sequence
  SiRNA target sequence
atatattatatctgtggaatg

SEQ ID NO: 53670 - DNA, 21 bp, Artificial sequence
  SiRNA target sequence
tatattatatctgtggaatgt

SEQ ID NO: 53671 - DNA, 21 bp, Artificial sequence
  SiRNA target sequence
atattatatctgtggaatgtg

SEQ ID NO: 53672 - DNA, 21 bp, Artificial sequence
  SiRNA target sequence
tattatatctgtggaatgtgt

SEQ ID NO: 53673 - DNA, 21 bp, Artificial sequence
  SiRNA target sequence
attatatctgtggaatgtgtt

SEQ ID NO: 53674 - DNA, 21 bp, Artificial sequence
  SiRNA target sequence
ttatatctgtggaatgtgttc

SEQ ID NO: 53675 - DNA, 21 bp, Artificial sequence
  SiRNA target sequence
tatatctgtggaatgtgttct

SEQ ID NO: 53676 - DNA, 21 bp, Artificial sequence
  SiRNA target sequence
atatctgtggaatgtgttctt

SEQ ID NO: 53677 - DNA, 21 bp, Artificial sequence
  SiRNA target sequence
tatctgtggaatgtgttcttt

SEQ ID NO: 53678 - DNA, 21 bp, Artificial sequence
  SiRNA target sequence
atctgtggaatgtgttcttta

SEQ ID NO: 53679 - DNA, 21 bp, Artificial sequence
  SiRNA target sequence
tctgtggaatgtgttctttag

SEQ ID NO: 53680 - DNA, 21 bp, Artificial sequence
  SiRNA target sequence
ctgtggaatgtgttctttaga

SEQ ID NO: 53681 - DNA, 21 bp, Artificial sequence
  SiRNA target sequence
tgtggaatgtgttctttagaa

SEQ ID NO: 53682 - DNA, 21 bp, Artificial sequence
  SiRNA target sequence
gtggaatgtgttctttagaaa

SEQ ID NO: 53683 - DNA, 21 bp, Artificial sequence
  SiRNA target sequence
tggaatgtgttctttagaaat

SEQ ID NO: 53684 - DNA, 21 bp, Artificial sequence
  SiRNA target sequence
ggaatgtgttctttagaaatt

SEQ ID NO: 53685 - DNA, 21 bp, Artificial sequence
  SiRNA target sequence
gaatgtgttctttagaaattt

SEQ ID NO: 53686 - DNA, 21 bp, Artificial sequence
  SiRNA target sequence
aatgtgttctttagaaattta

SEQ ID NO: 53687 - DNA, 21 bp, Artificial sequence
  SiRNA target sequence
atgtgttctttagaaatttat

SEQ ID NO: 53688 - DNA, 21 bp, Artificial sequence
  SiRNA target sequence
tgtgttctttagaaatttatt

SEQ ID NO: 53689 - DNA, 21 bp, Artificial sequence
  SiRNA target sequence
gtgttctttagaaatttatta

SEQ ID NO: 53690 - DNA, 21 bp, Artificial sequence
  SiRNA target sequence
tgttctttagaaatttattat

SEQ ID NO: 53691 - DNA, 21 bp, Artificial sequence
  SiRNA target sequence
gttctttagaaatttattatt

SEQ ID NO: 53692 - DNA, 21 bp, Artificial sequence
  SiRNA target sequence
ttctttagaaatttattattt

SEQ ID NO: 53693 - DNA, 21 bp, Artificial sequence
  SiRNA target sequence
tctttagaaatttattatttc

SEQ ID NO: 53694 - DNA, 21 bp, Artificial sequence
  SiRNA target sequence
ctttagaaatttattatttct

SEQ ID NO: 53695 - DNA, 21 bp, Artificial sequence
  SiRNA target sequence
tttagaaatttattatttcta

SEQ ID NO: 53696 - DNA, 21 bp, Artificial sequence
  SiRNA target sequence
ttagaaatttattatttctaa

SEQ ID NO: 53697 - DNA, 21 bp, Artificial sequence
  SiRNA target sequence
tagaaatttattatttctaat

SEQ ID NO: 53698 - DNA, 21 bp, Artificial sequence
  SiRNA target sequence
agaaatttattatttctaatt

SEQ ID NO: 53699 - DNA, 21 bp, Artificial sequence
  SiRNA target sequence
gaaatttattatttctaatta

SEQ ID NO: 53700 - DNA, 21 bp, Artificial sequence
  SiRNA target sequence
aaatttattatttctaattat

SEQ ID NO: 53701 - DNA, 21 bp, Artificial sequence
  SiRNA target sequence
aatttattatttctaattatt

SEQ ID NO: 53702 - DNA, 21 bp, Artificial sequence
  SiRNA target sequence
atttattatttctaattattt

SEQ ID NO: 53703 - DNA, 21 bp, Artificial sequence
  SiRNA target sequence
tttattatttctaattatttt

SEQ ID NO: 53704 - DNA, 21 bp, Artificial sequence
  SiRNA target sequence
ttattatttctaattattttc

SEQ ID NO: 53705 - DNA, 21 bp, Artificial sequence
  SiRNA target sequence
tattatttctaattattttct

SEQ ID NO: 53706 - DNA, 21 bp, Artificial sequence
  SiRNA target sequence
attatttctaattattttctt

SEQ ID NO: 53707 - DNA, 21 bp, Artificial sequence
  SiRNA target sequence
ttatttctaattattttcttt

SEQ ID NO: 53708 - DNA, 21 bp, Artificial sequence
  SiRNA target sequence
tatttctaattattttctttt

SEQ ID NO: 53709 - DNA, 21 bp, Artificial sequence
  SiRNA target sequence
atttctaattattttctttta

SEQ ID NO: 53710 - DNA, 21 bp, Artificial sequence
  SiRNA target sequence
tttctaattattttcttttat

SEQ ID NO: 53711 - DNA, 21 bp, Artificial sequence
  SiRNA target sequence
ttctaattattttcttttata

SEQ ID NO: 53712 - DNA, 21 bp, Artificial sequence
  SiRNA target sequence
tctaattattttcttttatat

SEQ ID NO: 53713 - DNA, 21 bp, Artificial sequence
  SiRNA target sequence
ctaattattttcttttatata

SEQ ID NO: 53714 - DNA, 21 bp, Artificial sequence
  SiRNA target sequence
taattattttcttttatatac

SEQ ID NO: 53715 - DNA, 21 bp, Artificial sequence
  SiRNA target sequence
aattattttcttttatatact

SEQ ID NO: 53716 - DNA, 21 bp, Artificial sequence
  SiRNA target sequence
attattttcttttatatactg

SEQ ID NO: 53717 - DNA, 21 bp, Artificial sequence
  SiRNA target sequence
ttattttcttttatatactgg

SEQ ID NO: 53718 - DNA, 21 bp, Artificial sequence
  SiRNA target sequence
tattttcttttatatactggc

SEQ ID NO: 53719 - DNA, 21 bp, Artificial sequence
  SiRNA target sequence
attttcttttatatactggct

SEQ ID NO: 53720 - DNA, 21 bp, Artificial sequence
  SiRNA target sequence
ttttcttttatatactggctt

SEQ ID NO: 53721 - DNA, 21 bp, Artificial sequence
  SiRNA target sequence
tttcttttatatactggcttt

SEQ ID NO: 53722 - DNA, 21 bp, Artificial sequence
  SiRNA target sequence
ttcttttatatactggctttt

SEQ ID NO: 53723 - DNA, 21 bp, Artificial sequence
  SiRNA target sequence
tcttttatatactggctttta

SEQ ID NO: 53724 - DNA, 21 bp, Artificial sequence
  SiRNA target sequence
cttttatatactggcttttat

SEQ ID NO: 53725 - DNA, 21 bp, Artificial sequence
  SiRNA target sequence
ttttatatactggcttttatg

SEQ ID NO: 53726 - DNA, 21 bp, Artificial sequence
  SiRNA target sequence
tttatatactggcttttatgg

SEQ ID NO: 53727 - DNA, 21 bp, Artificial sequence
  SiRNA target sequence
ttatatactggcttttatggt

SEQ ID NO: 53728 - DNA, 21 bp, Artificial sequence
  SiRNA target sequence
tatatactggcttttatggtt

SEQ ID NO: 53729 - DNA, 21 bp, Artificial sequence
  SiRNA target sequence
atatactggcttttatggtta

SEQ ID NO: 53730 - DNA, 21 bp, Artificial sequence
  SiRNA target sequence
tatactggcttttatggttat

SEQ ID NO: 53731 - DNA, 21 bp, Artificial sequence
  SiRNA target sequence
atactggcttttatggttata

SEQ ID NO: 53732 - DNA, 21 bp, Artificial sequence
  SiRNA target sequence
tactggcttttatggttatat

SEQ ID NO: 53733 - DNA, 21 bp, Artificial sequence
  SiRNA target sequence
actggcttttatggttatata

SEQ ID NO: 53734 - DNA, 21 bp, Artificial sequence
  SiRNA target sequence
ctggcttttatggttatatat

SEQ ID NO: 53735 - DNA, 21 bp, Artificial sequence
  SiRNA target sequence
tggcttttatggttatatata

SEQ ID NO: 53736 - DNA, 21 bp, Artificial sequence
  SiRNA target sequence
ggcttttatggttatatataa

SEQ ID NO: 53737 - DNA, 21 bp, Artificial sequence
  SiRNA target sequence
gcttttatggttatatataat

SEQ ID NO: 53738 - DNA, 21 bp, Artificial sequence
  SiRNA target sequence
cttttatggttatatataatg

SEQ ID NO: 53739 - DNA, 21 bp, Artificial sequence
  SiRNA target sequence
ttttatggttatatataatgt

SEQ ID NO: 53740 - DNA, 21 bp, Artificial sequence
  SiRNA target sequence
tttatggttatatataatgtt

SEQ ID NO: 53741 - DNA, 21 bp, Artificial sequence
  SiRNA target sequence
ttatggttatatataatgttg

SEQ ID NO: 53742 - DNA, 21 bp, Artificial sequence
  SiRNA target sequence
tatggttatatataatgttgt

SEQ ID NO: 53743 - DNA, 21 bp, Artificial sequence
  SiRNA target sequence
atggttatatataatgttgta

SEQ ID NO: 53744 - DNA, 21 bp, Artificial sequence
  SiRNA target sequence
tggttatatataatgttgtat

SEQ ID NO: 53745 - DNA, 21 bp, Artificial sequence
  SiRNA target sequence
ggttatatataatgttgtata

SEQ ID NO: 53746 - DNA, 21 bp, Artificial sequence
  SiRNA target sequence
gttatatataatgttgtatac

SEQ ID NO: 53747 - DNA, 21 bp, Artificial sequence
  SiRNA target sequence
ttatatataatgttgtataca

SEQ ID NO: 53748 - DNA, 21 bp, Artificial sequence
  SiRNA target sequence
tatatataatgttgtatacac

SEQ ID NO: 53749 - DNA, 21 bp, Artificial sequence
  SiRNA target sequence
atatataatgttgtatacaca

SEQ ID NO: 53750 - DNA, 21 bp, Artificial sequence
  SiRNA target sequence
tatataatgttgtatacacac

SEQ ID NO: 53751 - DNA, 21 bp, Artificial sequence
  SiRNA target sequence
atataatgttgtatacacaca

SEQ ID NO: 53752 - DNA, 21 bp, Artificial sequence
  SiRNA target sequence
tataatgttgtatacacacac

SEQ ID NO: 53753 - DNA, 21 bp, Artificial sequence
  SiRNA target sequence
ataatgttgtatacacacacc

SEQ ID NO: 53754 - DNA, 21 bp, Artificial sequence
  SiRNA target sequence
taatgttgtatacacacacca

SEQ ID NO: 53755 - DNA, 21 bp, Artificial sequence
  SiRNA target sequence
aatgttgtatacacacaccag

SEQ ID NO: 53756 - DNA, 21 bp, Artificial sequence
  SiRNA target sequence
atgttgtatacacacaccagg

SEQ ID NO: 53757 - DNA, 21 bp, Artificial sequence
  SiRNA target sequence
tgttgtatacacacaccaggt

SEQ ID NO: 53758 - DNA, 21 bp, Artificial sequence
  SiRNA target sequence
gttgtatacacacaccaggtt

SEQ ID NO: 53759 - DNA, 21 bp, Artificial sequence
  SiRNA target sequence
ttgtatacacacaccaggttg

SEQ ID NO: 53760 - DNA, 21 bp, Artificial sequence
  SiRNA target sequence
tgtatacacacaccaggttga

SEQ ID NO: 53761 - DNA, 21 bp, Artificial sequence
  SiRNA target sequence
gtatacacacaccaggttgat

SEQ ID NO: 53762 - DNA, 21 bp, Artificial sequence
  SiRNA target sequence
tatacacacaccaggttgatt

SEQ ID NO: 53763 - DNA, 21 bp, Artificial sequence
  SiRNA target sequence
atacacacaccaggttgattc

SEQ ID NO: 53764 - DNA, 21 bp, Artificial sequence
  SiRNA target sequence
tacacacaccaggttgattct

SEQ ID NO: 53765 - DNA, 21 bp, Artificial sequence
  SiRNA target sequence
acacacaccaggttgattctg

SEQ ID NO: 53766 - DNA, 21 bp, Artificial sequence
  SiRNA target sequence
cacacaccaggttgattctgc

SEQ ID NO: 53767 - DNA, 21 bp, Artificial sequence
  SiRNA target sequence
acacaccaggttgattctgcc

SEQ ID NO: 53768 - DNA, 21 bp, Artificial sequence
  SiRNA target sequence
cacaccaggttgattctgcct

SEQ ID NO: 53769 - DNA, 21 bp, Artificial sequence
  SiRNA target sequence
acaccaggttgattctgcctg

SEQ ID NO: 53770 - DNA, 21 bp, Artificial sequence
  SiRNA target sequence
caccaggttgattctgcctga

SEQ ID NO: 53771 - DNA, 21 bp, Artificial sequence
  SiRNA target sequence
accaggttgattctgcctgac

SEQ ID NO: 53772 - DNA, 21 bp, Artificial sequence
  SiRNA target sequence
ccaggttgattctgcctgacg

SEQ ID NO: 53773 - DNA, 21 bp, Artificial sequence
  SiRNA target sequence
caggttgattctgcctgacgt

SEQ ID NO: 53774 - DNA, 21 bp, Artificial sequence
  SiRNA target sequence
tacttgaacaaagttaaaaaa

SEQ ID NO: 53775 - DNA, 21 bp, Artificial sequence
  SiRNA target sequence
acttgaacaaagttaaaaaaa

SEQ ID NO: 53776 - DNA, 21 bp, Artificial sequence
  SiRNA target sequence
cttgaacaaagttaaaaaaat

SEQ ID NO: 53777 - DNA, 21 bp, Artificial sequence
  SiRNA target sequence
ttgaacaaagttaaaaaaata

SEQ ID NO: 53778 - DNA, 21 bp, Artificial sequence
  SiRNA target sequence
tgaacaaagttaaaaaaatac

SEQ ID NO: 53779 - DNA, 21 bp, Artificial sequence
  SiRNA target sequence
gaacaaagttaaaaaaatact

SEQ ID NO: 53780 - DNA, 21 bp, Artificial sequence
  SiRNA target sequence
aacaaagttaaaaaaatactc

SEQ ID NO: 53781 - DNA, 21 bp, Artificial sequence
  SiRNA target sequence
acaaagttaaaaaaatactcg

SEQ ID NO: 53782 - DNA, 21 bp, Artificial sequence
  SiRNA target sequence
caaagttaaaaaaatactcga

SEQ ID NO: 53783 - DNA, 21 bp, Artificial sequence
  SiRNA target sequence
aaagttaaaaaaatactcgaa

SEQ ID NO: 53784 - DNA, 21 bp, Artificial sequence
  SiRNA target sequence
aagttaaaaaaatactcgaaa

SEQ ID NO: 53785 - DNA, 21 bp, Artificial sequence
  SiRNA target sequence
agttaaaaaaatactcgaaag

SEQ ID NO: 53786 - DNA, 21 bp, Artificial sequence
  SiRNA target sequence
gttaaaaaaatactcgaaagt

SEQ ID NO: 53787 - DNA, 21 bp, Artificial sequence
  SiRNA target sequence
ttaaaaaaatactcgaaagtg

SEQ ID NO: 53788 - DNA, 21 bp, Artificial sequence
  SiRNA target sequence
taaaaaaatactcgaaagtgt

SEQ ID NO: 53789 - DNA, 21 bp, Artificial sequence
  SiRNA target sequence
aaaaaaatactcgaaagtgtg

SEQ ID NO: 53790 - DNA, 21 bp, Artificial sequence
  SiRNA target sequence
aaaaaatactcgaaagtgtgt

SEQ ID NO: 53791 - DNA, 21 bp, Artificial sequence
  SiRNA target sequence
aaaaatactcgaaagtgtgtg

SEQ ID NO: 53792 - DNA, 21 bp, Artificial sequence
  SiRNA target sequence
aaaatactcgaaagtgtgtgt

SEQ ID NO: 53793 - DNA, 21 bp, Artificial sequence
  SiRNA target sequence
aaatactcgaaagtgtgtgtt

SEQ ID NO: 53794 - DNA, 21 bp, Artificial sequence
  SiRNA target sequence
aatactcgaaagtgtgtgttt

SEQ ID NO: 53795 - DNA, 21 bp, Artificial sequence
  SiRNA target sequence
atactcgaaagtgtgtgtttt

SEQ ID NO: 53796 - DNA, 21 bp, Artificial sequence
  SiRNA target sequence
tactcgaaagtgtgtgttttt

SEQ ID NO: 53797 - DNA, 21 bp, Artificial sequence
  SiRNA target sequence
actcgaaagtgtgtgttttta

SEQ ID NO: 53798 - DNA, 21 bp, Artificial sequence
  SiRNA target sequence
ctcgaaagtgtgtgtttttat

SEQ ID NO: 53799 - DNA, 21 bp, Artificial sequence
  SiRNA target sequence
tcgaaagtgtgtgtttttatt

SEQ ID NO: 53800 - DNA, 21 bp, Artificial sequence
  SiRNA target sequence
cgaaagtgtgtgtttttattg

SEQ ID NO: 53801 - DNA, 21 bp, Artificial sequence
  SiRNA target sequence
gaaagtgtgtgtttttattgt

SEQ ID NO: 53802 - DNA, 21 bp, Artificial sequence
  SiRNA target sequence
aaagtgtgtgtttttattgtt

SEQ ID NO: 53803 - DNA, 21 bp, Artificial sequence
  SiRNA target sequence
aagtgtgtgtttttattgttc

SEQ ID NO: 53804 - DNA, 21 bp, Artificial sequence
  SiRNA target sequence
agtgtgtgtttttattgttca

SEQ ID NO: 53805 - DNA, 21 bp, Artificial sequence
  SiRNA target sequence
gtgtgtgtttttattgttcaa

SEQ ID NO: 53806 - DNA, 21 bp, Artificial sequence
  SiRNA target sequence
tgtgtgtttttattgttcaaa

SEQ ID NO: 53807 - DNA, 21 bp, Artificial sequence
  SiRNA target sequence
gtgtgtttttattgttcaaaa

SEQ ID NO: 53808 - DNA, 21 bp, Artificial sequence
  SiRNA target sequence
tgtgtttttattgttcaaaaa

SEQ ID NO: 53809 - DNA, 21 bp, Artificial sequence
  SiRNA target sequence
gtgtttttattgttcaaaaat

SEQ ID NO: 53810 - DNA, 21 bp, Artificial sequence
  SiRNA target sequence
tgtttttattgttcaaaaata

SEQ ID NO: 53811 - DNA, 21 bp, Artificial sequence
  SiRNA target sequence
gtttttattgttcaaaaataa

SEQ ID NO: 53812 - DNA, 21 bp, Artificial sequence
  SiRNA target sequence
tttttattgttcaaaaataaa

SEQ ID NO: 53813 - DNA, 21 bp, Artificial sequence
  SiRNA target sequence
ttttattgttcaaaaataaaa

SEQ ID NO: 53814 - DNA, 21 bp, Artificial sequence
  SiRNA target sequence
tttattgttcaaaaataaaag

SEQ ID NO: 53815 - DNA, 21 bp, Artificial sequence
  SiRNA target sequence
ttattgttcaaaaataaaagt

SEQ ID NO: 53816 - DNA, 21 bp, Artificial sequence
  SiRNA target sequence
tattgttcaaaaataaaagtt

SEQ ID NO: 53817 - DNA, 21 bp, Artificial sequence
  SiRNA target sequence
attgttcaaaaataaaagttg

SEQ ID NO: 53818 - DNA, 21 bp, Artificial sequence
  SiRNA target sequence
ttgttcaaaaataaaagttga

SEQ ID NO: 53819 - DNA, 21 bp, Artificial sequence
  SiRNA target sequence
tgttcaaaaataaaagttgat

SEQ ID NO: 53820 - DNA, 21 bp, Artificial sequence
  SiRNA target sequence
gttcaaaaataaaagttgata

SEQ ID NO: 53821 - DNA, 21 bp, Artificial sequence
  SiRNA target sequence
ttcaaaaataaaagttgataa

SEQ ID NO: 53822 - DNA, 21 bp, Artificial sequence
  SiRNA target sequence
tcaaaaataaaagttgataaa

SEQ ID NO: 53823 - DNA, 21 bp, Artificial sequence
  SiRNA target sequence
caaaaataaaagttgataaaa

SEQ ID NO: 53824 - DNA, 21 bp, Artificial sequence
  SiRNA target sequence
aaaaataaaagttgataaaaa

SEQ ID NO: 53825 - DNA, 21 bp, Artificial sequence
  SiRNA target sequence
aaaataaaagttgataaaaaa

SEQ ID NO: 53826 - DNA, 21 bp, Artificial sequence
  SiRNA target sequence
aaataaaagttgataaaaaaa

SEQ ID NO: 53827 - DNA, 21 bp, Artificial sequence
  SiRNA target sequence
aataaaagttgataaaaaaat

SEQ ID NO: 53828 - DNA, 21 bp, Artificial sequence
  SiRNA target sequence
ataaaagttgataaaaaaatt

SEQ ID NO: 53829 - DNA, 21 bp, Artificial sequence
  SiRNA target sequence
taaaagttgataaaaaaattt

SEQ ID NO: 53830 - DNA, 21 bp, Artificial sequence
  SiRNA target sequence
aaaagttgataaaaaaatttt

SEQ ID NO: 53831 - DNA, 21 bp, Artificial sequence
  SiRNA target sequence
aaagttgataaaaaaatttta

SEQ ID NO: 53832 - DNA, 21 bp, Artificial sequence
  SiRNA target sequence
aagttgataaaaaaattttaa

SEQ ID NO: 53833 - DNA, 21 bp, Artificial sequence
  SiRNA target sequence
agttgataaaaaaattttaaa

SEQ ID NO: 53834 - DNA, 21 bp, Artificial sequence
  SiRNA target sequence
gttgataaaaaaattttaaaa

SEQ ID NO: 53835 - DNA, 21 bp, Artificial sequence
  SiRNA target sequence
ttgataaaaaaattttaaaac

SEQ ID NO: 53836 - DNA, 21 bp, Artificial sequence
  SiRNA target sequence
tgataaaaaaattttaaaacc

SEQ ID NO: 53837 - DNA, 21 bp, Artificial sequence
  SiRNA target sequence
gataaaaaaattttaaaacca

SEQ ID NO: 53838 - DNA, 21 bp, Artificial sequence
  SiRNA target sequence
ataaaaaaattttaaaaccag

SEQ ID NO: 53839 - DNA, 21 bp, Artificial sequence
  SiRNA target sequence
taaaaaaattttaaaaccaga

SEQ ID NO: 53840 - DNA, 21 bp, Artificial sequence
  SiRNA target sequence
aaaaaaattttaaaaccagat

SEQ ID NO: 53841 - DNA, 21 bp, Artificial sequence
  SiRNA target sequence
aaaaaattttaaaaccagatt

SEQ ID NO: 53842 - DNA, 21 bp, Artificial sequence
  SiRNA target sequence
aaaaattttaaaaccagattt

SEQ ID NO: 53843 - DNA, 21 bp, Artificial sequence
  SiRNA target sequence
aaaattttaaaaccagattta

SEQ ID NO: 53844 - DNA, 21 bp, Artificial sequence
  SiRNA target sequence
aaattttaaaaccagatttaa

SEQ ID NO: 53845 - DNA, 21 bp, Artificial sequence
  SiRNA target sequence
aattttaaaaccagatttaaa

SEQ ID NO: 53846 - DNA, 21 bp, Artificial sequence
  SiRNA target sequence
attttaaaaccagatttaaat

SEQ ID NO: 53847 - DNA, 21 bp, Artificial sequence
  SiRNA target sequence
ttttaaaaccagatttaaatt

SEQ ID NO: 53848 - DNA, 21 bp, Artificial sequence
  SiRNA target sequence
tttaaaaccagatttaaattc

SEQ ID NO: 53849 - DNA, 21 bp, Artificial sequence
  SiRNA target sequence
ttaaaaccagatttaaattct

SEQ ID NO: 53850 - DNA, 21 bp, Artificial sequence
  SiRNA target sequence
taaaaccagatttaaattctg

SEQ ID NO: 53851 - DNA, 21 bp, Artificial sequence
  SiRNA target sequence
aaaaccagatttaaattctgt

SEQ ID NO: 53852 - DNA, 21 bp, Artificial sequence
  SiRNA target sequence
aaaccagatttaaattctgtg

SEQ ID NO: 53853 - DNA, 21 bp, Artificial sequence
  SiRNA target sequence
aaccagatttaaattctgtgt

SEQ ID NO: 53854 - DNA, 21 bp, Artificial sequence
  SiRNA target sequence
accagatttaaattctgtgtg

SEQ ID NO: 53855 - DNA, 21 bp, Artificial sequence
  SiRNA target sequence
ccagatttaaattctgtgtgg

SEQ ID NO: 53856 - DNA, 21 bp, Artificial sequence
  SiRNA target sequence
cagatttaaattctgtgtgga

SEQ ID NO: 53857 - DNA, 21 bp, Artificial sequence
  SiRNA target sequence
agatttaaattctgtgtggaa

SEQ ID NO: 53858 - DNA, 21 bp, Artificial sequence
  SiRNA target sequence
gatttaaattctgtgtggaat

SEQ ID NO: 53859 - DNA, 21 bp, Artificial sequence
  SiRNA target sequence
atttaaattctgtgtggaatt

SEQ ID NO: 53860 - DNA, 21 bp, Artificial sequence
  SiRNA target sequence
tttaaattctgtgtggaatta

SEQ ID NO: 53861 - DNA, 21 bp, Artificial sequence
  SiRNA target sequence
ttaaattctgtgtggaattat

SEQ ID NO: 53862 - DNA, 21 bp, Artificial sequence
  SiRNA target sequence
taaattctgtgtggaattatt

SEQ ID NO: 53863 - DNA, 21 bp, Artificial sequence
  SiRNA target sequence
aaattctgtgtggaattattg

SEQ ID NO: 53864 - DNA, 21 bp, Artificial sequence
  SiRNA target sequence
aattctgtgtggaattattgt

SEQ ID NO: 53865 - DNA, 21 bp, Artificial sequence
  SiRNA target sequence
attctgtgtggaattattgta

SEQ ID NO: 53866 - DNA, 21 bp, Artificial sequence
  SiRNA target sequence
ttctgtgtggaattattgtaa

SEQ ID NO: 53867 - DNA, 21 bp, Artificial sequence
  SiRNA target sequence
tctgtgtggaattattgtaaa

SEQ ID NO: 53868 - DNA, 21 bp, Artificial sequence
  SiRNA target sequence
ctgtgtggaattattgtaaat

SEQ ID NO: 53869 - DNA, 21 bp, Artificial sequence
  SiRNA target sequence
tgtgtggaattattgtaaatc

SEQ ID NO: 53870 - DNA, 21 bp, Artificial sequence
  SiRNA target sequence
gtgtggaattattgtaaatct

SEQ ID NO: 53871 - DNA, 21 bp, Artificial sequence
  SiRNA target sequence
tgtggaattattgtaaatcta

SEQ ID NO: 53872 - DNA, 21 bp, Artificial sequence
  SiRNA target sequence
gtggaattattgtaaatctaa

SEQ ID NO: 53873 - DNA, 21 bp, Artificial sequence
  SiRNA target sequence
tggaattattgtaaatctaaa

SEQ ID NO: 53874 - DNA, 21 bp, Artificial sequence
  SiRNA target sequence
ggaattattgtaaatctaaaa

SEQ ID NO: 53875 - DNA, 21 bp, Artificial sequence
  SiRNA target sequence
gaattattgtaaatctaaaac

SEQ ID NO: 53876 - DNA, 21 bp, Artificial sequence
  SiRNA target sequence
aattattgtaaatctaaaact

SEQ ID NO: 53877 - DNA, 21 bp, Artificial sequence
  SiRNA target sequence
attattgtaaatctaaaacta

SEQ ID NO: 53878 - DNA, 21 bp, Artificial sequence
  SiRNA target sequence
ttattgtaaatctaaaactac

SEQ ID NO: 53879 - DNA, 21 bp, Artificial sequence
  SiRNA target sequence
tattgtaaatctaaaactact

SEQ ID NO: 53880 - DNA, 21 bp, Artificial sequence
  SiRNA target sequence
attgtaaatctaaaactactt

SEQ ID NO: 53881 - DNA, 21 bp, Artificial sequence
  SiRNA target sequence
ttgtaaatctaaaactacttg

SEQ ID NO: 53882 - DNA, 21 bp, Artificial sequence
  SiRNA target sequence
tgtaaatctaaaactacttgt

SEQ ID NO: 53883 - DNA, 21 bp, Artificial sequence
  SiRNA target sequence
gtaaatctaaaactacttgtg

SEQ ID NO: 53884 - DNA, 21 bp, Artificial sequence
  SiRNA target sequence
taaatctaaaactacttgtga

SEQ ID NO: 53885 - DNA, 21 bp, Artificial sequence
  SiRNA target sequence
aaatctaaaactacttgtgaa

SEQ ID NO: 53886 - DNA, 21 bp, Artificial sequence
  SiRNA target sequence
aatctaaaactacttgtgaag

SEQ ID NO: 53887 - DNA, 21 bp, Artificial sequence
  SiRNA target sequence
atctaaaactacttgtgaagg

SEQ ID NO: 53888 - DNA, 21 bp, Artificial sequence
  SiRNA target sequence
tctaaaactacttgtgaaggt

SEQ ID NO: 53889 - DNA, 21 bp, Artificial sequence
  SiRNA target sequence
ctaaaactacttgtgaaggtg

SEQ ID NO: 53890 - DNA, 21 bp, Artificial sequence
  SiRNA target sequence
taaaactacttgtgaaggtga

SEQ ID NO: 53891 - DNA, 21 bp, Artificial sequence
  SiRNA target sequence
aaaactacttgtgaaggtgaa

SEQ ID NO: 53892 - DNA, 21 bp, Artificial sequence
  SiRNA target sequence
aaactacttgtgaaggtgaaa

SEQ ID NO: 53893 - DNA, 21 bp, Artificial sequence
  SiRNA target sequence
aactacttgtgaaggtgaaaa

SEQ ID NO: 53894 - DNA, 21 bp, Artificial sequence
  SiRNA target sequence
actacttgtgaaggtgaaaat

SEQ ID NO: 53895 - DNA, 21 bp, Artificial sequence
  SiRNA target sequence
ctacttgtgaaggtgaaaata

SEQ ID NO: 53896 - DNA, 21 bp, Artificial sequence
  SiRNA target sequence
tacttgtgaaggtgaaaatac

SEQ ID NO: 53897 - DNA, 21 bp, Artificial sequence
  SiRNA target sequence
acttgtgaaggtgaaaataca

SEQ ID NO: 53898 - DNA, 21 bp, Artificial sequence
  SiRNA target sequence
cttgtgaaggtgaaaatacac

SEQ ID NO: 53899 - DNA, 21 bp, Artificial sequence
  SiRNA target sequence
ttgtgaaggtgaaaatacacc

SEQ ID NO: 53900 - DNA, 21 bp, Artificial sequence
  SiRNA target sequence
tgtgaaggtgaaaatacacca

SEQ ID NO: 53901 - DNA, 21 bp, Artificial sequence
  SiRNA target sequence
gtgaaggtgaaaatacaccag

SEQ ID NO: 53902 - DNA, 21 bp, Artificial sequence
  SiRNA target sequence
tgaaggtgaaaatacaccaga

SEQ ID NO: 53903 - DNA, 21 bp, Artificial sequence
  SiRNA target sequence
gaaggtgaaaatacaccagac

SEQ ID NO: 53904 - DNA, 21 bp, Artificial sequence
  SiRNA target sequence
aaggtgaaaatacaccagacg

SEQ ID NO: 53905 - DNA, 21 bp, Artificial sequence
  SiRNA target sequence
aggtgaaaatacaccagacgg

SEQ ID NO: 53906 - DNA, 21 bp, Artificial sequence
  SiRNA target sequence
ggtgaaaatacaccagacggt

SEQ ID NO: 53907 - DNA, 21 bp, Artificial sequence
  SiRNA target sequence
gtgaaaatacaccagacggtt

SEQ ID NO: 53908 - DNA, 21 bp, Artificial sequence
  SiRNA target sequence
tgaaaatacaccagacggtta

SEQ ID NO: 53909 - DNA, 21 bp, Artificial sequence
  SiRNA target sequence
gaaaatacaccagacggttat

SEQ ID NO: 53910 - DNA, 21 bp, Artificial sequence
  SiRNA target sequence
aaaatacaccagacggttata

SEQ ID NO: 53911 - DNA, 21 bp, Artificial sequence
  SiRNA target sequence
aaatacaccagacggttatac

SEQ ID NO: 53912 - DNA, 21 bp, Artificial sequence
  SiRNA target sequence
aatacaccagacggttatact

SEQ ID NO: 53913 - DNA, 21 bp, Artificial sequence
  SiRNA target sequence
atacaccagacggttatactg

SEQ ID NO: 53914 - DNA, 21 bp, Artificial sequence
  SiRNA target sequence
tacaccagacggttatactgg

SEQ ID NO: 53915 - DNA, 21 bp, Artificial sequence
  SiRNA target sequence
acaccagacggttatactggt

SEQ ID NO: 53916 - DNA, 21 bp, Artificial sequence
  SiRNA target sequence
caccagacggttatactggtt

SEQ ID NO: 53917 - DNA, 21 bp, Artificial sequence
  SiRNA target sequence
accagacggttatactggttg

SEQ ID NO: 53918 - DNA, 21 bp, Artificial sequence
  SiRNA target sequence
ccagacggttatactggttgt

SEQ ID NO: 53919 - DNA, 21 bp, Artificial sequence
  SiRNA target sequence
cagacggttatactggttgtg

SEQ ID NO: 53920 - DNA, 21 bp, Artificial sequence
  SiRNA target sequence
agacggttatactggttgtgg

SEQ ID NO: 53921 - DNA, 21 bp, Artificial sequence
  SiRNA target sequence
gacggttatactggttgtggt

SEQ ID NO: 53922 - DNA, 21 bp, Artificial sequence
  SiRNA target sequence
acggttatactggttgtggta

SEQ ID NO: 53923 - DNA, 21 bp, Artificial sequence
  SiRNA target sequence
cggttatactggttgtggtaa

SEQ ID NO: 53924 - DNA, 21 bp, Artificial sequence
  SiRNA target sequence
ggttatactggttgtggtaat

SEQ ID NO: 53925 - DNA, 21 bp, Artificial sequence
  SiRNA target sequence
gttatactggttgtggtaata

SEQ ID NO: 53926 - DNA, 21 bp, Artificial sequence
  SiRNA target sequence
ttatactggttgtggtaataa

SEQ ID NO: 53927 - DNA, 21 bp, Artificial sequence
  SiRNA target sequence
tatactggttgtggtaataaa

SEQ ID NO: 53928 - DNA, 21 bp, Artificial sequence
  SiRNA target sequence
atactggttgtggtaataaac

SEQ ID NO: 53929 - DNA, 21 bp, Artificial sequence
  SiRNA target sequence
tactggttgtggtaataaaca

SEQ ID NO: 53930 - DNA, 21 bp, Artificial sequence
  SiRNA target sequence
actggttgtggtaataaacaa

SEQ ID NO: 53931 - DNA, 21 bp, Artificial sequence
  SiRNA target sequence
ctggttgtggtaataaacaac

SEQ ID NO: 53932 - DNA, 21 bp, Artificial sequence
  SiRNA target sequence
tggttgtggtaataaacaacc

SEQ ID NO: 53933 - DNA, 21 bp, Artificial sequence
  SiRNA target sequence
ggttgtggtaataaacaacct

SEQ ID NO: 53934 - DNA, 21 bp, Artificial sequence
  SiRNA target sequence
gttgtggtaataaacaacctc

SEQ ID NO: 53935 - DNA, 21 bp, Artificial sequence
  SiRNA target sequence
ttgtggtaataaacaacctct

SEQ ID NO: 53936 - DNA, 21 bp, Artificial sequence
  SiRNA target sequence
tgtggtaataaacaacctctt

SEQ ID NO: 53937 - DNA, 21 bp, Artificial sequence
  SiRNA target sequence
gtggtaataaacaacctctta

SEQ ID NO: 53938 - DNA, 21 bp, Artificial sequence
  SiRNA target sequence
tggtaataaacaacctcttat

SEQ ID NO: 53939 - DNA, 21 bp, Artificial sequence
  SiRNA target sequence
ggtaataaacaacctcttatt

SEQ ID NO: 53940 - DNA, 21 bp, Artificial sequence
  SiRNA target sequence
gtaataaacaacctcttatta

SEQ ID NO: 53941 - DNA, 21 bp, Artificial sequence
  SiRNA target sequence
taataaacaacctcttattaa

SEQ ID NO: 53942 - DNA, 21 bp, Artificial sequence
  SiRNA target sequence
aataaacaacctcttattaaa

SEQ ID NO: 53943 - DNA, 21 bp, Artificial sequence
  SiRNA target sequence
ataaacaacctcttattaaaa

SEQ ID NO: 53944 - DNA, 21 bp, Artificial sequence
  SiRNA target sequence
taaacaacctcttattaaaaa

SEQ ID NO: 53945 - DNA, 21 bp, Artificial sequence
  SiRNA target sequence
aaacaacctcttattaaaaaa

SEQ ID NO: 53946 - DNA, 21 bp, Artificial sequence
  SiRNA target sequence
aacaacctcttattaaaaaag

SEQ ID NO: 53947 - DNA, 21 bp, Artificial sequence
  SiRNA target sequence
acaacctcttattaaaaaaga

SEQ ID NO: 53948 - DNA, 21 bp, Artificial sequence
  SiRNA target sequence
caacctcttattaaaaaagaa

SEQ ID NO: 53949 - DNA, 21 bp, Artificial sequence
  SiRNA target sequence
aacctcttattaaaaaagaag

SEQ ID NO: 53950 - DNA, 21 bp, Artificial sequence
  SiRNA target sequence
acctcttattaaaaaagaagg

SEQ ID NO: 53951 - DNA, 21 bp, Artificial sequence
  SiRNA target sequence
cctcttattaaaaaagaagga

SEQ ID NO: 53952 - DNA, 21 bp, Artificial sequence
  SiRNA target sequence
ctcttattaaaaaagaaggac

SEQ ID NO: 53953 - DNA, 21 bp, Artificial sequence
  SiRNA target sequence
tcttattaaaaaagaaggact

SEQ ID NO: 53954 - DNA, 21 bp, Artificial sequence
  SiRNA target sequence
cttattaaaaaagaaggactt

SEQ ID NO: 53955 - DNA, 21 bp, Artificial sequence
  SiRNA target sequence
ttattaaaaaagaaggacttg

SEQ ID NO: 53956 - DNA, 21 bp, Artificial sequence
  SiRNA target sequence
tattaaaaaagaaggacttgg

SEQ ID NO: 53957 - DNA, 21 bp, Artificial sequence
  SiRNA target sequence
attaaaaaagaaggacttgga

SEQ ID NO: 53958 - DNA, 21 bp, Artificial sequence
  SiRNA target sequence
ttaaaaaagaaggacttggac

SEQ ID NO: 53959 - DNA, 21 bp, Artificial sequence
  SiRNA target sequence
taaaaaagaaggacttggact

SEQ ID NO: 53960 - DNA, 21 bp, Artificial sequence
  SiRNA target sequence
aaaaaagaaggacttggactc

SEQ ID NO: 53961 - DNA, 21 bp, Artificial sequence
  SiRNA target sequence
aaaaagaaggacttggactcg

SEQ ID NO: 53962 - DNA, 21 bp, Artificial sequence
  SiRNA target sequence
aaaagaaggacttggactcgt

SEQ ID NO: 53963 - DNA, 21 bp, Artificial sequence
  SiRNA target sequence
aaagaaggacttggactcgtt

SEQ ID NO: 53964 - DNA, 21 bp, Artificial sequence
  SiRNA target sequence
aagaaggacttggactcgttg

SEQ ID NO: 53965 - DNA, 21 bp, Artificial sequence
  SiRNA target sequence
agaaggacttggactcgttgc

SEQ ID NO: 53966 - DNA, 21 bp, Artificial sequence
  SiRNA target sequence
gaaggacttggactcgttgct

SEQ ID NO: 53967 - DNA, 21 bp, Artificial sequence
  SiRNA target sequence
aaggacttggactcgttgctt

SEQ ID NO: 53968 - DNA, 21 bp, Artificial sequence
  SiRNA target sequence
aggacttggactcgttgcttt

SEQ ID NO: 53969 - DNA, 21 bp, Artificial sequence
  SiRNA target sequence
ggacttggactcgttgctttt

SEQ ID NO: 53970 - DNA, 21 bp, Artificial sequence
  SiRNA target sequence
gacttggactcgttgctttta

SEQ ID NO: 53971 - DNA, 21 bp, Artificial sequence
  SiRNA target sequence
acttggactcgttgcttttat

SEQ ID NO: 53972 - DNA, 21 bp, Artificial sequence
  SiRNA target sequence
cttggactcgttgcttttatg

SEQ ID NO: 53973 - DNA, 21 bp, Artificial sequence
  SiRNA target sequence
ttggactcgttgcttttatga

SEQ ID NO: 53974 - DNA, 21 bp, Artificial sequence
  SiRNA target sequence
tggactcgttgcttttatgaa

SEQ ID NO: 53975 - DNA, 21 bp, Artificial sequence
  SiRNA target sequence
ggactcgttgcttttatgaaa

SEQ ID NO: 53976 - DNA, 21 bp, Artificial sequence
  SiRNA target sequence
gactcgttgcttttatgaaag

SEQ ID NO: 53977 - DNA, 21 bp, Artificial sequence
  SiRNA target sequence
actcgttgcttttatgaaagg

SEQ ID NO: 53978 - DNA, 21 bp, Artificial sequence
  SiRNA target sequence
ctcgttgcttttatgaaaggg

SEQ ID NO: 53979 - DNA, 21 bp, Artificial sequence
  SiRNA target sequence
tcgttgcttttatgaaagggg

SEQ ID NO: 53980 - DNA, 21 bp, Artificial sequence
  SiRNA target sequence
cgttgcttttatgaaagggga

SEQ ID NO: 53981 - DNA, 21 bp, Artificial sequence
  SiRNA target sequence
gttgcttttatgaaaggggaa

SEQ ID NO: 53982 - DNA, 21 bp, Artificial sequence
  SiRNA target sequence
ttgcttttatgaaaggggaag

SEQ ID NO: 53983 - DNA, 21 bp, Artificial sequence
  SiRNA target sequence
tgcttttatgaaaggggaaga

SEQ ID NO: 53984 - DNA, 21 bp, Artificial sequence
  SiRNA target sequence
gcttttatgaaaggggaagaa

SEQ ID NO: 53985 - DNA, 21 bp, Artificial sequence
  SiRNA target sequence
cttttatgaaaggggaagaaa

SEQ ID NO: 53986 - DNA, 21 bp, Artificial sequence
  SiRNA target sequence
ttttatgaaaggggaagaaaa

SEQ ID NO: 53987 - DNA, 21 bp, Artificial sequence
  SiRNA target sequence
tttatgaaaggggaagaaaac

SEQ ID NO: 53988 - DNA, 21 bp, Artificial sequence
  SiRNA target sequence
ttatgaaaggggaagaaaact

SEQ ID NO: 53989 - DNA, 21 bp, Artificial sequence
  SiRNA target sequence
tatgaaaggggaagaaaactc

SEQ ID NO: 53990 - DNA, 21 bp, Artificial sequence
  SiRNA target sequence
atgaaaggggaagaaaactcc

SEQ ID NO: 53991 - DNA, 21 bp, Artificial sequence
  SiRNA target sequence
tgaaaggggaagaaaactccg

SEQ ID NO: 53992 - DNA, 21 bp, Artificial sequence
  SiRNA target sequence
gaaaggggaagaaaactccga

SEQ ID NO: 53993 - DNA, 21 bp, Artificial sequence
  SiRNA target sequence
aaaggggaagaaaactccgac

SEQ ID NO: 53994 - DNA, 21 bp, Artificial sequence
  SiRNA target sequence
aaggggaagaaaactccgacg

SEQ ID NO: 53995 - DNA, 21 bp, Artificial sequence
  SiRNA target sequence
aggggaagaaaactccgacgg

SEQ ID NO: 53996 - DNA, 21 bp, Artificial sequence
  SiRNA target sequence
ggggaagaaaactccgacggt

SEQ ID NO: 53997 - DNA, 21 bp, Artificial sequence
  SiRNA target sequence
gggaagaaaactccgacggta

SEQ ID NO: 53998 - DNA, 21 bp, Artificial sequence
  SiRNA target sequence
ggaagaaaactccgacggtaa

SEQ ID NO: 53999 - DNA, 21 bp, Artificial sequence
  SiRNA target sequence
gaagaaaactccgacggtaaa

SEQ ID NO: 54000 - DNA, 21 bp, Artificial sequence
  SiRNA target sequence
aagaaaactccgacggtaaag

SEQ ID NO: 54001 - DNA, 21 bp, Artificial sequence
  SiRNA target sequence
agaaaactccgacggtaaagt

SEQ ID NO: 54002 - DNA, 21 bp, Artificial sequence
  SiRNA target sequence
gaaaactccgacggtaaagtt

SEQ ID NO: 54003 - DNA, 21 bp, Artificial sequence
  SiRNA target sequence
aaaactccgacggtaaagtta

SEQ ID NO: 54004 - DNA, 21 bp, Artificial sequence
  SiRNA target sequence
aaactccgacggtaaagttat

SEQ ID NO: 54005 - DNA, 21 bp, Artificial sequence
  SiRNA target sequence
aactccgacggtaaagttatt

SEQ ID NO: 54006 - DNA, 21 bp, Artificial sequence
  SiRNA target sequence
actccgacggtaaagttattt

SEQ ID NO: 54007 - DNA, 21 bp, Artificial sequence
  SiRNA target sequence
ctccgacggtaaagttatttt

SEQ ID NO: 54008 - DNA, 21 bp, Artificial sequence
  SiRNA target sequence
tccgacggtaaagttatttta

SEQ ID NO: 54009 - DNA, 21 bp, Artificial sequence
  SiRNA target sequence
ccgacggtaaagttattttaa

SEQ ID NO: 54010 - DNA, 21 bp, Artificial sequence
  SiRNA target sequence
cgacggtaaagttattttaaa

SEQ ID NO: 54011 - DNA, 21 bp, Artificial sequence
  SiRNA target sequence
gacggtaaagttattttaaat

SEQ ID NO: 54012 - DNA, 21 bp, Artificial sequence
  SiRNA target sequence
acggtaaagttattttaaatg

SEQ ID NO: 54013 - DNA, 21 bp, Artificial sequence
  SiRNA target sequence
cggtaaagttattttaaatgg

SEQ ID NO: 54014 - DNA, 21 bp, Artificial sequence
  SiRNA target sequence
ggtaaagttattttaaatgga

SEQ ID NO: 54015 - DNA, 21 bp, Artificial sequence
  SiRNA target sequence
gtaaagttattttaaatggag

SEQ ID NO: 54016 - DNA, 21 bp, Artificial sequence
  SiRNA target sequence
taaagttattttaaatggaga

SEQ ID NO: 54017 - DNA, 21 bp, Artificial sequence
  SiRNA target sequence
aaagttattttaaatggagaa

SEQ ID NO: 54018 - DNA, 21 bp, Artificial sequence
  SiRNA target sequence
aagttattttaaatggagaaa

SEQ ID NO: 54019 - DNA, 21 bp, Artificial sequence
  SiRNA target sequence
agttattttaaatggagaaag

SEQ ID NO: 54020 - DNA, 21 bp, Artificial sequence
  SiRNA target sequence
gttattttaaatggagaaagg

SEQ ID NO: 54021 - DNA, 21 bp, Artificial sequence
  SiRNA target sequence
ttattttaaatggagaaaggg

SEQ ID NO: 54022 - DNA, 21 bp, Artificial sequence
  SiRNA target sequence
tattttaaatggagaaagggt

SEQ ID NO: 54023 - DNA, 21 bp, Artificial sequence
  SiRNA target sequence
attttaaatggagaaagggtt

SEQ ID NO: 54024 - DNA, 21 bp, Artificial sequence
  SiRNA target sequence
ttttaaatggagaaagggttt

SEQ ID NO: 54025 - DNA, 21 bp, Artificial sequence
  SiRNA target sequence
tttaaatggagaaagggtttt

SEQ ID NO: 54026 - DNA, 21 bp, Artificial sequence
  SiRNA target sequence
ttaaatggagaaagggttttg

SEQ ID NO: 54027 - DNA, 21 bp, Artificial sequence
  SiRNA target sequence
taaatggagaaagggttttga

SEQ ID NO: 54028 - DNA, 21 bp, Artificial sequence
  SiRNA target sequence
aaatggagaaagggttttgag

SEQ ID NO: 54029 - DNA, 21 bp, Artificial sequence
  SiRNA target sequence
aatggagaaagggttttgagt

SEQ ID NO: 54030 - DNA, 21 bp, Artificial sequence
  SiRNA target sequence
atggagaaagggttttgagta

SEQ ID NO: 54031 - DNA, 21 bp, Artificial sequence
  SiRNA target sequence
tggagaaagggttttgagtat

SEQ ID NO: 54032 - DNA, 21 bp, Artificial sequence
  SiRNA target sequence
ggagaaagggttttgagtatt

SEQ ID NO: 54033 - DNA, 21 bp, Artificial sequence
  SiRNA target sequence
gagaaagggttttgagtattt

SEQ ID NO: 54034 - DNA, 21 bp, Artificial sequence
  SiRNA target sequence
agaaagggttttgagtatttt

SEQ ID NO: 54035 - DNA, 21 bp, Artificial sequence
  SiRNA target sequence
gaaagggttttgagtattttg

SEQ ID NO: 54036 - DNA, 21 bp, Artificial sequence
  SiRNA target sequence
aaagggttttgagtattttga

SEQ ID NO: 54037 - DNA, 21 bp, Artificial sequence
  SiRNA target sequence
aagggttttgagtattttgaa

SEQ ID NO: 54038 - DNA, 21 bp, Artificial sequence
  SiRNA target sequence
agggttttgagtattttgaaa

SEQ ID NO: 54039 - DNA, 21 bp, Artificial sequence
  SiRNA target sequence
gggttttgagtattttgaaaa

SEQ ID NO: 54040 - DNA, 21 bp, Artificial sequence
  SiRNA target sequence
ggttttgagtattttgaaaaa

SEQ ID NO: 54041 - DNA, 21 bp, Artificial sequence
  SiRNA target sequence
gttttgagtattttgaaaaaa

SEQ ID NO: 54042 - DNA, 21 bp, Artificial sequence
  SiRNA target sequence
ttttgagtattttgaaaaaaa

SEQ ID NO: 54043 - DNA, 21 bp, Artificial sequence
  SiRNA target sequence
tttgagtattttgaaaaaaat

SEQ ID NO: 54044 - DNA, 21 bp, Artificial sequence
  SiRNA target sequence
ttgagtattttgaaaaaaatt

SEQ ID NO: 54045 - DNA, 21 bp, Artificial sequence
  SiRNA target sequence
tgagtattttgaaaaaaattt

SEQ ID NO: 54046 - DNA, 21 bp, Artificial sequence
  SiRNA target sequence
gagtattttgaaaaaaatttc

SEQ ID NO: 54047 - DNA, 21 bp, Artificial sequence
  SiRNA target sequence
agtattttgaaaaaaatttct

SEQ ID NO: 54048 - DNA, 21 bp, Artificial sequence
  SiRNA target sequence
gtattttgaaaaaaatttctg

SEQ ID NO: 54049 - DNA, 21 bp, Artificial sequence
  SiRNA target sequence
tattttgaaaaaaatttctga

SEQ ID NO: 54050 - DNA, 21 bp, Artificial sequence
  SiRNA target sequence
attttgaaaaaaatttctgaa

SEQ ID NO: 54051 - DNA, 21 bp, Artificial sequence
  SiRNA target sequence
ttttgaaaaaaatttctgaac

SEQ ID NO: 54052 - DNA, 21 bp, Artificial sequence
  SiRNA target sequence
tttgaaaaaaatttctgaaca

SEQ ID NO: 54053 - DNA, 21 bp, Artificial sequence
  SiRNA target sequence
ttgaaaaaaatttctgaacaa

SEQ ID NO: 54054 - DNA, 21 bp, Artificial sequence
  SiRNA target sequence
tgaaaaaaatttctgaacaag

SEQ ID NO: 54055 - DNA, 21 bp, Artificial sequence
  SiRNA target sequence
gaaaaaaatttctgaacaaga

SEQ ID NO: 54056 - DNA, 21 bp, Artificial sequence
  SiRNA target sequence
aaaaaaatttctgaacaagat

SEQ ID NO: 54057 - DNA, 21 bp, Artificial sequence
  SiRNA target sequence
aaaaaatttctgaacaagatg

SEQ ID NO: 54058 - DNA, 21 bp, Artificial sequence
  SiRNA target sequence
aaaaatttctgaacaagatgc

SEQ ID NO: 54059 - DNA, 21 bp, Artificial sequence
  SiRNA target sequence
aaaatttctgaacaagatgct

SEQ ID NO: 54060 - DNA, 21 bp, Artificial sequence
  SiRNA target sequence
aaatttctgaacaagatgcta

SEQ ID NO: 54061 - DNA, 21 bp, Artificial sequence
  SiRNA target sequence
aatttctgaacaagatgctaa

SEQ ID NO: 54062 - DNA, 21 bp, Artificial sequence
  SiRNA target sequence
atttctgaacaagatgctaat

SEQ ID NO: 54063 - DNA, 21 bp, Artificial sequence
  SiRNA target sequence
tttctgaacaagatgctaatt

SEQ ID NO: 54064 - DNA, 21 bp, Artificial sequence
  SiRNA target sequence
ttctgaacaagatgctaatta

SEQ ID NO: 54065 - DNA, 21 bp, Artificial sequence
  SiRNA target sequence
tctgaacaagatgctaattat

SEQ ID NO: 54066 - DNA, 21 bp, Artificial sequence
  SiRNA target sequence
ctgaacaagatgctaattata

SEQ ID NO: 54067 - DNA, 21 bp, Artificial sequence
  SiRNA target sequence
tgaacaagatgctaattatat

SEQ ID NO: 54068 - DNA, 21 bp, Artificial sequence
  SiRNA target sequence
gaacaagatgctaattatatg

SEQ ID NO: 54069 - DNA, 21 bp, Artificial sequence
  SiRNA target sequence
aacaagatgctaattatatgg

SEQ ID NO: 54070 - DNA, 21 bp, Artificial sequence
  SiRNA target sequence
acaagatgctaattatatggg

SEQ ID NO: 54071 - DNA, 21 bp, Artificial sequence
  SiRNA target sequence
caagatgctaattatatggga

SEQ ID NO: 54072 - DNA, 21 bp, Artificial sequence
  SiRNA target sequence
aagatgctaattatatgggat

SEQ ID NO: 54073 - DNA, 21 bp, Artificial sequence
  SiRNA target sequence
agatgctaattatatgggatt

SEQ ID NO: 54074 - DNA, 21 bp, Artificial sequence
  SiRNA target sequence
gatgctaattatatgggattt

SEQ ID NO: 54075 - DNA, 21 bp, Artificial sequence
  SiRNA target sequence
atgctaattatatgggatttg

SEQ ID NO: 54076 - DNA, 21 bp, Artificial sequence
  SiRNA target sequence
tgctaattatatgggatttga

SEQ ID NO: 54077 - DNA, 21 bp, Artificial sequence
  SiRNA target sequence
gctaattatatgggatttgat

SEQ ID NO: 54078 - DNA, 21 bp, Artificial sequence
  SiRNA target sequence
ctaattatatgggatttgatt

SEQ ID NO: 54079 - DNA, 21 bp, Artificial sequence
  SiRNA target sequence
taattatatgggatttgattt

SEQ ID NO: 54080 - DNA, 21 bp, Artificial sequence
  SiRNA target sequence
aattatatgggatttgatttt

SEQ ID NO: 54081 - DNA, 21 bp, Artificial sequence
  SiRNA target sequence
attatatgggatttgattttg

SEQ ID NO: 54082 - DNA, 21 bp, Artificial sequence
  SiRNA target sequence
ttatatgggatttgattttgt

SEQ ID NO: 54083 - DNA, 21 bp, Artificial sequence
  SiRNA target sequence
tatatgggatttgattttgtt

SEQ ID NO: 54084 - DNA, 21 bp, Artificial sequence
  SiRNA target sequence
atatgggatttgattttgtta

SEQ ID NO: 54085 - DNA, 21 bp, Artificial sequence
  SiRNA target sequence
tatgggatttgattttgttaa

SEQ ID NO: 54086 - DNA, 21 bp, Artificial sequence
  SiRNA target sequence
atgggatttgattttgttaat

SEQ ID NO: 54087 - DNA, 21 bp, Artificial sequence
  SiRNA target sequence
tgggatttgattttgttaata

SEQ ID NO: 54088 - DNA, 21 bp, Artificial sequence
  SiRNA target sequence
gggatttgattttgttaatag

SEQ ID NO: 54089 - DNA, 21 bp, Artificial sequence
  SiRNA target sequence
ggatttgattttgttaatagt

SEQ ID NO: 54090 - DNA, 21 bp, Artificial sequence
  SiRNA target sequence
gatttgattttgttaatagta

SEQ ID NO: 54091 - DNA, 21 bp, Artificial sequence
  SiRNA target sequence
atttgattttgttaatagtaa

SEQ ID NO: 54092 - DNA, 21 bp, Artificial sequence
  SiRNA target sequence
tttgattttgttaatagtaaa

SEQ ID NO: 54093 - DNA, 21 bp, Artificial sequence
  SiRNA target sequence
ttgattttgttaatagtaaac

SEQ ID NO: 54094 - DNA, 21 bp, Artificial sequence
  SiRNA target sequence
tgattttgttaatagtaaacc

SEQ ID NO: 54095 - DNA, 21 bp, Artificial sequence
  SiRNA target sequence
gattttgttaatagtaaaccc

SEQ ID NO: 54096 - DNA, 21 bp, Artificial sequence
  SiRNA target sequence
attttgttaatagtaaacccg

SEQ ID NO: 54097 - DNA, 21 bp, Artificial sequence
  SiRNA target sequence
ttttgttaatagtaaacccga

SEQ ID NO: 54098 - DNA, 21 bp, Artificial sequence
  SiRNA target sequence
tttgttaatagtaaacccgaa

SEQ ID NO: 54099 - DNA, 21 bp, Artificial sequence
  SiRNA target sequence
ttgttaatagtaaacccgaat

SEQ ID NO: 54100 - DNA, 21 bp, Artificial sequence
  SiRNA target sequence
tgttaatagtaaacccgaatg

SEQ ID NO: 54101 - DNA, 21 bp, Artificial sequence
  SiRNA target sequence
gttaatagtaaacccgaatgg

SEQ ID NO: 54102 - DNA, 21 bp, Artificial sequence
  SiRNA target sequence
ttaatagtaaacccgaatggt

SEQ ID NO: 54103 - DNA, 21 bp, Artificial sequence
  SiRNA target sequence
taatagtaaacccgaatggtt

SEQ ID NO: 54104 - DNA, 21 bp, Artificial sequence
  SiRNA target sequence
aatagtaaacccgaatggtta

SEQ ID NO: 54105 - DNA, 21 bp, Artificial sequence
  SiRNA target sequence
atagtaaacccgaatggttaa

SEQ ID NO: 54106 - DNA, 21 bp, Artificial sequence
  SiRNA target sequence
tagtaaacccgaatggttaat

SEQ ID NO: 54107 - DNA, 21 bp, Artificial sequence
  SiRNA target sequence
agtaaacccgaatggttaatt

SEQ ID NO: 54108 - DNA, 21 bp, Artificial sequence
  SiRNA target sequence
gtaaacccgaatggttaattt

SEQ ID NO: 54109 - DNA, 21 bp, Artificial sequence
  SiRNA target sequence
taaacccgaatggttaatttt

SEQ ID NO: 54110 - DNA, 21 bp, Artificial sequence
  SiRNA target sequence
aaacccgaatggttaattttg

SEQ ID NO: 54111 - DNA, 21 bp, Artificial sequence
  SiRNA target sequence
aacccgaatggttaattttga

SEQ ID NO: 54112 - DNA, 21 bp, Artificial sequence
  SiRNA target sequence
acccgaatggttaattttgac

SEQ ID NO: 54113 - DNA, 21 bp, Artificial sequence
  SiRNA target sequence
cccgaatggttaattttgact

SEQ ID NO: 54114 - DNA, 21 bp, Artificial sequence
  SiRNA target sequence
ccgaatggttaattttgactg

SEQ ID NO: 54115 - DNA, 21 bp, Artificial sequence
  SiRNA target sequence
cgaatggttaattttgactgt

SEQ ID NO: 54116 - DNA, 21 bp, Artificial sequence
  SiRNA target sequence
gaatggttaattttgactgtt

SEQ ID NO: 54117 - DNA, 21 bp, Artificial sequence
  SiRNA target sequence
aatggttaattttgactgttt

SEQ ID NO: 54118 - DNA, 21 bp, Artificial sequence
  SiRNA target sequence
atggttaattttgactgtttt

SEQ ID NO: 54119 - DNA, 21 bp, Artificial sequence
  SiRNA target sequence
tggttaattttgactgttttg

SEQ ID NO: 54120 - DNA, 21 bp, Artificial sequence
  SiRNA target sequence
ggttaattttgactgttttgc

SEQ ID NO: 54121 - DNA, 21 bp, Artificial sequence
  SiRNA target sequence
gttaattttgactgttttgct

SEQ ID NO: 54122 - DNA, 21 bp, Artificial sequence
  SiRNA target sequence
ttaattttgactgttttgcta

SEQ ID NO: 54123 - DNA, 21 bp, Artificial sequence
  SiRNA target sequence
taattttgactgttttgctag

SEQ ID NO: 54124 - DNA, 21 bp, Artificial sequence
  SiRNA target sequence
aattttgactgttttgctagt

SEQ ID NO: 54125 - DNA, 21 bp, Artificial sequence
  SiRNA target sequence
attttgactgttttgctagtt

SEQ ID NO: 54126 - DNA, 21 bp, Artificial sequence
  SiRNA target sequence
ttttgactgttttgctagttc

SEQ ID NO: 54127 - DNA, 21 bp, Artificial sequence
  SiRNA target sequence
tttgactgttttgctagttcc

SEQ ID NO: 54128 - DNA, 21 bp, Artificial sequence
  SiRNA target sequence
ttgactgttttgctagttcct

SEQ ID NO: 54129 - DNA, 21 bp, Artificial sequence
  SiRNA target sequence
tgactgttttgctagttcctc

SEQ ID NO: 54130 - DNA, 21 bp, Artificial sequence
  SiRNA target sequence
gactgttttgctagttcctcc

SEQ ID NO: 54131 - DNA, 21 bp, Artificial sequence
  SiRNA target sequence
actgttttgctagttcctcct

SEQ ID NO: 54132 - DNA, 21 bp, Artificial sequence
  SiRNA target sequence
ctgttttgctagttcctcctc

SEQ ID NO: 54133 - DNA, 21 bp, Artificial sequence
  SiRNA target sequence
tgttttgctagttcctcctcc

SEQ ID NO: 54134 - DNA, 21 bp, Artificial sequence
  SiRNA target sequence
gttttgctagttcctcctcct

SEQ ID NO: 54135 - DNA, 21 bp, Artificial sequence
  SiRNA target sequence
ttttgctagttcctcctcctt

SEQ ID NO: 54136 - DNA, 21 bp, Artificial sequence
  SiRNA target sequence
tttgctagttcctcctccttc

SEQ ID NO: 54137 - DNA, 21 bp, Artificial sequence
  SiRNA target sequence
ttgctagttcctcctccttct

SEQ ID NO: 54138 - DNA, 21 bp, Artificial sequence
  SiRNA target sequence
tgctagttcctcctccttctg

SEQ ID NO: 54139 - DNA, 21 bp, Artificial sequence
  SiRNA target sequence
gctagttcctcctccttctgt

SEQ ID NO: 54140 - DNA, 21 bp, Artificial sequence
  SiRNA target sequence
ctagttcctcctccttctgta

SEQ ID NO: 54141 - DNA, 21 bp, Artificial sequence
  SiRNA target sequence
tagttcctcctccttctgtaa

SEQ ID NO: 54142 - DNA, 21 bp, Artificial sequence
  SiRNA target sequence
agttcctcctccttctgtaag

SEQ ID NO: 54143 - DNA, 21 bp, Artificial sequence
  SiRNA target sequence
gttcctcctccttctgtaaga

SEQ ID NO: 54144 - DNA, 21 bp, Artificial sequence
  SiRNA target sequence
ttcctcctccttctgtaagac

SEQ ID NO: 54145 - DNA, 21 bp, Artificial sequence
  SiRNA target sequence
tcctcctccttctgtaagacc

SEQ ID NO: 54146 - DNA, 21 bp, Artificial sequence
  SiRNA target sequence
cctcctccttctgtaagacct

SEQ ID NO: 54147 - DNA, 21 bp, Artificial sequence
  SiRNA target sequence
ctcctccttctgtaagacctt

SEQ ID NO: 54148 - DNA, 21 bp, Artificial sequence
  SiRNA target sequence
tcctccttctgtaagaccttc

SEQ ID NO: 54149 - DNA, 21 bp, Artificial sequence
  SiRNA target sequence
cctccttctgtaagaccttct

SEQ ID NO: 54150 - DNA, 21 bp, Artificial sequence
  SiRNA target sequence
ctccttctgtaagaccttcta

SEQ ID NO: 54151 - DNA, 21 bp, Artificial sequence
  SiRNA target sequence
tccttctgtaagaccttctat

SEQ ID NO: 54152 - DNA, 21 bp, Artificial sequence
  SiRNA target sequence
ccttctgtaagaccttctatt

SEQ ID NO: 54153 - DNA, 21 bp, Artificial sequence
  SiRNA target sequence
cttctgtaagaccttctattg

SEQ ID NO: 54154 - DNA, 21 bp, Artificial sequence
  SiRNA target sequence
ttctgtaagaccttctattgt

SEQ ID NO: 54155 - DNA, 21 bp, Artificial sequence
  SiRNA target sequence
tctgtaagaccttctattgtt

SEQ ID NO: 54156 - DNA, 21 bp, Artificial sequence
  SiRNA target sequence
ctgtaagaccttctattgtta

SEQ ID NO: 54157 - DNA, 21 bp, Artificial sequence
  SiRNA target sequence
tgtaagaccttctattgttat

SEQ ID NO: 54158 - DNA, 21 bp, Artificial sequence
  SiRNA target sequence
gtaagaccttctattgttatg

SEQ ID NO: 54159 - DNA, 21 bp, Artificial sequence
  SiRNA target sequence
taagaccttctattgttatgg

SEQ ID NO: 54160 - DNA, 21 bp, Artificial sequence
  SiRNA target sequence
aagaccttctattgttatgga

SEQ ID NO: 54161 - DNA, 21 bp, Artificial sequence
  SiRNA target sequence
agaccttctattgttatggag

SEQ ID NO: 54162 - DNA, 21 bp, Artificial sequence
  SiRNA target sequence
gaccttctattgttatggagg

SEQ ID NO: 54163 - DNA, 21 bp, Artificial sequence
  SiRNA target sequence
accttctattgttatggaggg

SEQ ID NO: 54164 - DNA, 21 bp, Artificial sequence
  SiRNA target sequence
ccttctattgttatggaggga

SEQ ID NO: 54165 - DNA, 21 bp, Artificial sequence
  SiRNA target sequence
cttctattgttatggagggaa

SEQ ID NO: 54166 - DNA, 21 bp, Artificial sequence
  SiRNA target sequence
ttctattgttatggagggaat

SEQ ID NO: 54167 - DNA, 21 bp, Artificial sequence
  SiRNA target sequence
tctattgttatggagggaatg

SEQ ID NO: 54168 - DNA, 21 bp, Artificial sequence
  SiRNA target sequence
ctattgttatggagggaatgt

SEQ ID NO: 54169 - DNA, 21 bp, Artificial sequence
  SiRNA target sequence
tattgttatggagggaatgtt

SEQ ID NO: 54170 - DNA, 21 bp, Artificial sequence
  SiRNA target sequence
attgttatggagggaatgtta

SEQ ID NO: 54171 - DNA, 21 bp, Artificial sequence
  SiRNA target sequence
ttgttatggagggaatgttaa

SEQ ID NO: 54172 - DNA, 21 bp, Artificial sequence
  SiRNA target sequence
tgttatggagggaatgttaag

SEQ ID NO: 54173 - DNA, 21 bp, Artificial sequence
  SiRNA target sequence
gttatggagggaatgttaaga

SEQ ID NO: 54174 - DNA, 21 bp, Artificial sequence
  SiRNA target sequence
ttatggagggaatgttaagag

SEQ ID NO: 54175 - DNA, 21 bp, Artificial sequence
  SiRNA target sequence
tatggagggaatgttaagagc

SEQ ID NO: 54176 - DNA, 21 bp, Artificial sequence
  SiRNA target sequence
atggagggaatgttaagagca

SEQ ID NO: 54177 - DNA, 21 bp, Artificial sequence
  SiRNA target sequence
tggagggaatgttaagagcag

SEQ ID NO: 54178 - DNA, 21 bp, Artificial sequence
  SiRNA target sequence
ggagggaatgttaagagcaga

SEQ ID NO: 54179 - DNA, 21 bp, Artificial sequence
  SiRNA target sequence
gagggaatgttaagagcagaa

SEQ ID NO: 54180 - DNA, 21 bp, Artificial sequence
  SiRNA target sequence
agggaatgttaagagcagaag

SEQ ID NO: 54181 - DNA, 21 bp, Artificial sequence
  SiRNA target sequence
gggaatgttaagagcagaaga

SEQ ID NO: 54182 - DNA, 21 bp, Artificial sequence
  SiRNA target sequence
ggaatgttaagagcagaagat

SEQ ID NO: 54183 - DNA, 21 bp, Artificial sequence
  SiRNA target sequence
gaatgttaagagcagaagatg

SEQ ID NO: 54184 - DNA, 21 bp, Artificial sequence
  SiRNA target sequence
aatgttaagagcagaagatga

SEQ ID NO: 54185 - DNA, 21 bp, Artificial sequence
  SiRNA target sequence
atgttaagagcagaagatgat

SEQ ID NO: 54186 - DNA, 21 bp, Artificial sequence
  SiRNA target sequence
tgttaagagcagaagatgatc

SEQ ID NO: 54187 - DNA, 21 bp, Artificial sequence
  SiRNA target sequence
gttaagagcagaagatgatct

SEQ ID NO: 54188 - DNA, 21 bp, Artificial sequence
  SiRNA target sequence
ttaagagcagaagatgatcta

SEQ ID NO: 54189 - DNA, 21 bp, Artificial sequence
  SiRNA target sequence
taagagcagaagatgatctaa

SEQ ID NO: 54190 - DNA, 21 bp, Artificial sequence
  SiRNA target sequence
aagagcagaagatgatctaac

SEQ ID NO: 54191 - DNA, 21 bp, Artificial sequence
  SiRNA target sequence
agagcagaagatgatctaaca

SEQ ID NO: 54192 - DNA, 21 bp, Artificial sequence
  SiRNA target sequence
gagcagaagatgatctaacac

SEQ ID NO: 54193 - DNA, 21 bp, Artificial sequence
  SiRNA target sequence
agcagaagatgatctaacaca

SEQ ID NO: 54194 - DNA, 21 bp, Artificial sequence
  SiRNA target sequence
gcagaagatgatctaacacac

SEQ ID NO: 54195 - DNA, 21 bp, Artificial sequence
  SiRNA target sequence
cagaagatgatctaacacaca

SEQ ID NO: 54196 - DNA, 21 bp, Artificial sequence
  SiRNA target sequence
agaagatgatctaacacacaa

SEQ ID NO: 54197 - DNA, 21 bp, Artificial sequence
  SiRNA target sequence
gaagatgatctaacacacaaa

SEQ ID NO: 54198 - DNA, 21 bp, Artificial sequence
  SiRNA target sequence
aagatgatctaacacacaaat

SEQ ID NO: 54199 - DNA, 21 bp, Artificial sequence
  SiRNA target sequence
agatgatctaacacacaaatt

SEQ ID NO: 54200 - DNA, 21 bp, Artificial sequence
  SiRNA target sequence
gatgatctaacacacaaattg

SEQ ID NO: 54201 - DNA, 21 bp, Artificial sequence
  SiRNA target sequence
atgatctaacacacaaattgg

SEQ ID NO: 54202 - DNA, 21 bp, Artificial sequence
  SiRNA target sequence
tgatctaacacacaaattggc

SEQ ID NO: 54203 - DNA, 21 bp, Artificial sequence
  SiRNA target sequence
gatctaacacacaaattggct

SEQ ID NO: 54204 - DNA, 21 bp, Artificial sequence
  SiRNA target sequence
atctaacacacaaattggctg

SEQ ID NO: 54205 - DNA, 21 bp, Artificial sequence
  SiRNA target sequence
tctaacacacaaattggctga

SEQ ID NO: 54206 - DNA, 21 bp, Artificial sequence
  SiRNA target sequence
ctaacacacaaattggctgat

SEQ ID NO: 54207 - DNA, 21 bp, Artificial sequence
  SiRNA target sequence
taacacacaaattggctgata

SEQ ID NO: 54208 - DNA, 21 bp, Artificial sequence
  SiRNA target sequence
aacacacaaattggctgatat

SEQ ID NO: 54209 - DNA, 21 bp, Artificial sequence
  SiRNA target sequence
acacacaaattggctgatatt

SEQ ID NO: 54210 - DNA, 21 bp, Artificial sequence
  SiRNA target sequence
cacacaaattggctgatatta

SEQ ID NO: 54211 - DNA, 21 bp, Artificial sequence
  SiRNA target sequence
acacaaattggctgatattat

SEQ ID NO: 54212 - DNA, 21 bp, Artificial sequence
  SiRNA target sequence
cacaaattggctgatattata

SEQ ID NO: 54213 - DNA, 21 bp, Artificial sequence
  SiRNA target sequence
acaaattggctgatattataa

SEQ ID NO: 54214 - DNA, 21 bp, Artificial sequence
  SiRNA target sequence
caaattggctgatattataaa

SEQ ID NO: 54215 - DNA, 21 bp, Artificial sequence
  SiRNA target sequence
aaattggctgatattataaaa

SEQ ID NO: 54216 - DNA, 21 bp, Artificial sequence
  SiRNA target sequence
aattggctgatattataaaag

SEQ ID NO: 54217 - DNA, 21 bp, Artificial sequence
  SiRNA target sequence
attggctgatattataaaagc

SEQ ID NO: 54218 - DNA, 21 bp, Artificial sequence
  SiRNA target sequence
ttggctgatattataaaagca

SEQ ID NO: 54219 - DNA, 21 bp, Artificial sequence
  SiRNA target sequence
tggctgatattataaaagcaa

SEQ ID NO: 54220 - DNA, 21 bp, Artificial sequence
  SiRNA target sequence
ggctgatattataaaagcaaa

SEQ ID NO: 54221 - DNA, 21 bp, Artificial sequence
  SiRNA target sequence
gctgatattataaaagcaaat

SEQ ID NO: 54222 - DNA, 21 bp, Artificial sequence
  SiRNA target sequence
ctgatattataaaagcaaata

SEQ ID NO: 54223 - DNA, 21 bp, Artificial sequence
  SiRNA target sequence
tgatattataaaagcaaatac

SEQ ID NO: 54224 - DNA, 21 bp, Artificial sequence
  SiRNA target sequence
gatattataaaagcaaataca

SEQ ID NO: 54225 - DNA, 21 bp, Artificial sequence
  SiRNA target sequence
atattataaaagcaaatacat

SEQ ID NO: 54226 - DNA, 21 bp, Artificial sequence
  SiRNA target sequence
tattataaaagcaaatacata

SEQ ID NO: 54227 - DNA, 21 bp, Artificial sequence
  SiRNA target sequence
attataaaagcaaatacatat

SEQ ID NO: 54228 - DNA, 21 bp, Artificial sequence
  SiRNA target sequence
ttataaaagcaaatacatatt

SEQ ID NO: 54229 - DNA, 21 bp, Artificial sequence
  SiRNA target sequence
tataaaagcaaatacatattt

SEQ ID NO: 54230 - DNA, 21 bp, Artificial sequence
  SiRNA target sequence
ataaaagcaaatacatattta

SEQ ID NO: 54231 - DNA, 21 bp, Artificial sequence
  SiRNA target sequence
taaaagcaaatacatatttaa

SEQ ID NO: 54232 - DNA, 21 bp, Artificial sequence
  SiRNA target sequence
aaaagcaaatacatatttaaa

SEQ ID NO: 54233 - DNA, 21 bp, Artificial sequence
  SiRNA target sequence
aaagcaaatacatatttaaaa

SEQ ID NO: 54234 - DNA, 21 bp, Artificial sequence
  SiRNA target sequence
aagcaaatacatatttaaaaa

SEQ ID NO: 54235 - DNA, 21 bp, Artificial sequence
  SiRNA target sequence
agcaaatacatatttaaaaaa

SEQ ID NO: 54236 - DNA, 21 bp, Artificial sequence
  SiRNA target sequence
gcaaatacatatttaaaaaaa

SEQ ID NO: 54237 - DNA, 21 bp, Artificial sequence
  SiRNA target sequence
caaatacatatttaaaaaaat

SEQ ID NO: 54238 - DNA, 21 bp, Artificial sequence
  SiRNA target sequence
aaatacatatttaaaaaaata

SEQ ID NO: 54239 - DNA, 21 bp, Artificial sequence
  SiRNA target sequence
aatacatatttaaaaaaatat

SEQ ID NO: 54240 - DNA, 21 bp, Artificial sequence
  SiRNA target sequence
atacatatttaaaaaaatatg

SEQ ID NO: 54241 - DNA, 21 bp, Artificial sequence
  SiRNA target sequence
tacatatttaaaaaaatatga

SEQ ID NO: 54242 - DNA, 21 bp, Artificial sequence
  SiRNA target sequence
acatatttaaaaaaatatgag

SEQ ID NO: 54243 - DNA, 21 bp, Artificial sequence
  SiRNA target sequence
catatttaaaaaaatatgagt

SEQ ID NO: 54244 - DNA, 21 bp, Artificial sequence
  SiRNA target sequence
atatttaaaaaaatatgagtt

SEQ ID NO: 54245 - DNA, 21 bp, Artificial sequence
  SiRNA target sequence
tatttaaaaaaatatgagttg

SEQ ID NO: 54246 - DNA, 21 bp, Artificial sequence
  SiRNA target sequence
atttaaaaaaatatgagttgg

SEQ ID NO: 54247 - DNA, 21 bp, Artificial sequence
  SiRNA target sequence
tttaaaaaaatatgagttgga

SEQ ID NO: 54248 - DNA, 21 bp, Artificial sequence
  SiRNA target sequence
ttaaaaaaatatgagttggaa

SEQ ID NO: 54249 - DNA, 21 bp, Artificial sequence
  SiRNA target sequence
taaaaaaatatgagttggaag

SEQ ID NO: 54250 - DNA, 21 bp, Artificial sequence
  SiRNA target sequence
aaaaaaatatgagttggaagg

SEQ ID NO: 54251 - DNA, 21 bp, Artificial sequence
  SiRNA target sequence
aaaaaatatgagttggaaggc

SEQ ID NO: 54252 - DNA, 21 bp, Artificial sequence
  SiRNA target sequence
aaaaatatgagttggaaggcg

SEQ ID NO: 54253 - DNA, 21 bp, Artificial sequence
  SiRNA target sequence
aaaatatgagttggaaggcgc

SEQ ID NO: 54254 - DNA, 21 bp, Artificial sequence
  SiRNA target sequence
aaatatgagttggaaggcgct

SEQ ID NO: 54255 - DNA, 21 bp, Artificial sequence
  SiRNA target sequence
aatatgagttggaaggcgctc

SEQ ID NO: 54256 - DNA, 21 bp, Artificial sequence
  SiRNA target sequence
atatgagttggaaggcgctcc

SEQ ID NO: 54257 - DNA, 21 bp, Artificial sequence
  SiRNA target sequence
tatgagttggaaggcgctcct

SEQ ID NO: 54258 - DNA, 21 bp, Artificial sequence
  SiRNA target sequence
atgagttggaaggcgctcctg

SEQ ID NO: 54259 - DNA, 21 bp, Artificial sequence
  SiRNA target sequence
tgagttggaaggcgctcctgg

SEQ ID NO: 54260 - DNA, 21 bp, Artificial sequence
  SiRNA target sequence
gagttggaaggcgctcctggt

SEQ ID NO: 54261 - DNA, 21 bp, Artificial sequence
  SiRNA target sequence
agttggaaggcgctcctggtc

SEQ ID NO: 54262 - DNA, 21 bp, Artificial sequence
  SiRNA target sequence
gttggaaggcgctcctggtca

SEQ ID NO: 54263 - DNA, 21 bp, Artificial sequence
  SiRNA target sequence
ttggaaggcgctcctggtcat

SEQ ID NO: 54264 - DNA, 21 bp, Artificial sequence
  SiRNA target sequence
tggaaggcgctcctggtcatg

SEQ ID NO: 54265 - DNA, 21 bp, Artificial sequence
  SiRNA target sequence
ggaaggcgctcctggtcatgt

SEQ ID NO: 54266 - DNA, 21 bp, Artificial sequence
  SiRNA target sequence
gaaggcgctcctggtcatgtt

SEQ ID NO: 54267 - DNA, 21 bp, Artificial sequence
  SiRNA target sequence
aaggcgctcctggtcatgtta

SEQ ID NO: 54268 - DNA, 21 bp, Artificial sequence
  SiRNA target sequence
aggcgctcctggtcatgttat

SEQ ID NO: 54269 - DNA, 21 bp, Artificial sequence
  SiRNA target sequence
ggcgctcctggtcatgttata

SEQ ID NO: 54270 - DNA, 21 bp, Artificial sequence
  SiRNA target sequence
gcgctcctggtcatgttataa

SEQ ID NO: 54271 - DNA, 21 bp, Artificial sequence
  SiRNA target sequence
cgctcctggtcatgttataag

SEQ ID NO: 54272 - DNA, 21 bp, Artificial sequence
  SiRNA target sequence
gctcctggtcatgttataagg

SEQ ID NO: 54273 - DNA, 21 bp, Artificial sequence
  SiRNA target sequence
ctcctggtcatgttataaggg

SEQ ID NO: 54274 - DNA, 21 bp, Artificial sequence
  SiRNA target sequence
tcctggtcatgttataaggga

SEQ ID NO: 54275 - DNA, 21 bp, Artificial sequence
  SiRNA target sequence
cctggtcatgttataagggat

SEQ ID NO: 54276 - DNA, 21 bp, Artificial sequence
  SiRNA target sequence
ctggtcatgttataagggatt

SEQ ID NO: 54277 - DNA, 21 bp, Artificial sequence
  SiRNA target sequence
tggtcatgttataagggatta

SEQ ID NO: 54278 - DNA, 21 bp, Artificial sequence
  SiRNA target sequence
ggtcatgttataagggattat

SEQ ID NO: 54279 - DNA, 21 bp, Artificial sequence
  SiRNA target sequence
gtcatgttataagggattatg

SEQ ID NO: 54280 - DNA, 21 bp, Artificial sequence
  SiRNA target sequence
tcatgttataagggattatga

SEQ ID NO: 54281 - DNA, 21 bp, Artificial sequence
  SiRNA target sequence
catgttataagggattatgaa

SEQ ID NO: 54282 - DNA, 21 bp, Artificial sequence
  SiRNA target sequence
atgttataagggattatgaac

SEQ ID NO: 54283 - DNA, 21 bp, Artificial sequence
  SiRNA target sequence
tgttataagggattatgaaca

SEQ ID NO: 54284 - DNA, 21 bp, Artificial sequence
  SiRNA target sequence
gttataagggattatgaacaa

SEQ ID NO: 54285 - DNA, 21 bp, Artificial sequence
  SiRNA target sequence
ttataagggattatgaacaat

SEQ ID NO: 54286 - DNA, 21 bp, Artificial sequence
  SiRNA target sequence
tataagggattatgaacaatt

SEQ ID NO: 54287 - DNA, 21 bp, Artificial sequence
  SiRNA target sequence
ataagggattatgaacaatta

SEQ ID NO: 54288 - DNA, 21 bp, Artificial sequence
  SiRNA target sequence
taagggattatgaacaattac

SEQ ID NO: 54289 - DNA, 21 bp, Artificial sequence
  SiRNA target sequence
aagggattatgaacaattact

SEQ ID NO: 54290 - DNA, 21 bp, Artificial sequence
  SiRNA target sequence
agggattatgaacaattacta

SEQ ID NO: 54291 - DNA, 21 bp, Artificial sequence
  SiRNA target sequence
gggattatgaacaattactac

SEQ ID NO: 54292 - DNA, 21 bp, Artificial sequence
  SiRNA target sequence
ggattatgaacaattactaca

SEQ ID NO: 54293 - DNA, 21 bp, Artificial sequence
  SiRNA target sequence
gattatgaacaattactacaa

SEQ ID NO: 54294 - DNA, 21 bp, Artificial sequence
  SiRNA target sequence
attatgaacaattactacaat

SEQ ID NO: 54295 - DNA, 21 bp, Artificial sequence
  SiRNA target sequence
ttatgaacaattactacaatt

SEQ ID NO: 54296 - DNA, 21 bp, Artificial sequence
  SiRNA target sequence
tatgaacaattactacaattt

SEQ ID NO: 54297 - DNA, 21 bp, Artificial sequence
  SiRNA target sequence
atgaacaattactacaatttc

SEQ ID NO: 54298 - DNA, 21 bp, Artificial sequence
  SiRNA target sequence
tgaacaattactacaatttca

SEQ ID NO: 54299 - DNA, 21 bp, Artificial sequence
  SiRNA target sequence
gaacaattactacaatttcat

SEQ ID NO: 54300 - DNA, 21 bp, Artificial sequence
  SiRNA target sequence
aacaattactacaatttcata

SEQ ID NO: 54301 - DNA, 21 bp, Artificial sequence
  SiRNA target sequence
acaattactacaatttcatat

SEQ ID NO: 54302 - DNA, 21 bp, Artificial sequence
  SiRNA target sequence
caattactacaatttcatatg

SEQ ID NO: 54303 - DNA, 21 bp, Artificial sequence
  SiRNA target sequence
aattactacaatttcatatgg

SEQ ID NO: 54304 - DNA, 21 bp, Artificial sequence
  SiRNA target sequence
attactacaatttcatatggc

SEQ ID NO: 54305 - DNA, 21 bp, Artificial sequence
  SiRNA target sequence
ttactacaatttcatatggct

SEQ ID NO: 54306 - DNA, 21 bp, Artificial sequence
  SiRNA target sequence
tactacaatttcatatggcta

SEQ ID NO: 54307 - DNA, 21 bp, Artificial sequence
  SiRNA target sequence
actacaatttcatatggctac

SEQ ID NO: 54308 - DNA, 21 bp, Artificial sequence
  SiRNA target sequence
ctacaatttcatatggctaca

SEQ ID NO: 54309 - DNA, 21 bp, Artificial sequence
  SiRNA target sequence
tacaatttcatatggctacaa

SEQ ID NO: 54310 - DNA, 21 bp, Artificial sequence
  SiRNA target sequence
acaatttcatatggctacaat

SEQ ID NO: 54311 - DNA, 21 bp, Artificial sequence
  SiRNA target sequence
caatttcatatggctacaatg

SEQ ID NO: 54312 - DNA, 21 bp, Artificial sequence
  SiRNA target sequence
aatttcatatggctacaatgg

SEQ ID NO: 54313 - DNA, 21 bp, Artificial sequence
  SiRNA target sequence
atttcatatggctacaatggt

SEQ ID NO: 54314 - DNA, 21 bp, Artificial sequence
  SiRNA target sequence
tttcatatggctacaatggta

SEQ ID NO: 54315 - DNA, 21 bp, Artificial sequence
  SiRNA target sequence
ttcatatggctacaatggtag

SEQ ID NO: 54316 - DNA, 21 bp, Artificial sequence
  SiRNA target sequence
tcatatggctacaatggtaga

SEQ ID NO: 54317 - DNA, 21 bp, Artificial sequence
  SiRNA target sequence
catatggctacaatggtagat

SEQ ID NO: 54318 - DNA, 21 bp, Artificial sequence
  SiRNA target sequence
atatggctacaatggtagata

SEQ ID NO: 54319 - DNA, 21 bp, Artificial sequence
  SiRNA target sequence
tatggctacaatggtagataa

SEQ ID NO: 54320 - DNA, 21 bp, Artificial sequence
  SiRNA target sequence
atggctacaatggtagataat

SEQ ID NO: 54321 - DNA, 21 bp, Artificial sequence
  SiRNA target sequence
tggctacaatggtagataatg

SEQ ID NO: 54322 - DNA, 21 bp, Artificial sequence
  SiRNA target sequence
ggctacaatggtagataatga

SEQ ID NO: 54323 - DNA, 21 bp, Artificial sequence
  SiRNA target sequence
gctacaatggtagataatgat

SEQ ID NO: 54324 - DNA, 21 bp, Artificial sequence
  SiRNA target sequence
ctacaatggtagataatgatt

SEQ ID NO: 54325 - DNA, 21 bp, Artificial sequence
  SiRNA target sequence
tacaatggtagataatgattt

SEQ ID NO: 54326 - DNA, 21 bp, Artificial sequence
  SiRNA target sequence
acaatggtagataatgattta

SEQ ID NO: 54327 - DNA, 21 bp, Artificial sequence
  SiRNA target sequence
caatggtagataatgatttaa

SEQ ID NO: 54328 - DNA, 21 bp, Artificial sequence
  SiRNA target sequence
aatggtagataatgatttaag

SEQ ID NO: 54329 - DNA, 21 bp, Artificial sequence
  SiRNA target sequence
atggtagataatgatttaagt

SEQ ID NO: 54330 - DNA, 21 bp, Artificial sequence
  SiRNA target sequence
tggtagataatgatttaagtg

SEQ ID NO: 54331 - DNA, 21 bp, Artificial sequence
  SiRNA target sequence
ggtagataatgatttaagtgg

SEQ ID NO: 54332 - DNA, 21 bp, Artificial sequence
  SiRNA target sequence
gtagataatgatttaagtgga

SEQ ID NO: 54333 - DNA, 21 bp, Artificial sequence
  SiRNA target sequence
tagataatgatttaagtggac

SEQ ID NO: 54334 - DNA, 21 bp, Artificial sequence
  SiRNA target sequence
agataatgatttaagtggaca

SEQ ID NO: 54335 - DNA, 21 bp, Artificial sequence
  SiRNA target sequence
gataatgatttaagtggacaa

SEQ ID NO: 54336 - DNA, 21 bp, Artificial sequence
  SiRNA target sequence
ataatgatttaagtggacaac

SEQ ID NO: 54337 - DNA, 21 bp, Artificial sequence
  SiRNA target sequence
taatgatttaagtggacaacc

SEQ ID NO: 54338 - DNA, 21 bp, Artificial sequence
  SiRNA target sequence
aatgatttaagtggacaacca

SEQ ID NO: 54339 - DNA, 21 bp, Artificial sequence
  SiRNA target sequence
atgatttaagtggacaaccac

SEQ ID NO: 54340 - DNA, 21 bp, Artificial sequence
  SiRNA target sequence
tgatttaagtggacaaccaca

SEQ ID NO: 54341 - DNA, 21 bp, Artificial sequence
  SiRNA target sequence
gatttaagtggacaaccacaa

SEQ ID NO: 54342 - DNA, 21 bp, Artificial sequence
  SiRNA target sequence
atttaagtggacaaccacaag

SEQ ID NO: 54343 - DNA, 21 bp, Artificial sequence
  SiRNA target sequence
tttaagtggacaaccacaagc

SEQ ID NO: 54344 - DNA, 21 bp, Artificial sequence
  SiRNA target sequence
ttaagtggacaaccacaagct

SEQ ID NO: 54345 - DNA, 21 bp, Artificial sequence
  SiRNA target sequence
taagtggacaaccacaagctt

SEQ ID NO: 54346 - DNA, 21 bp, Artificial sequence
  SiRNA target sequence
aagtggacaaccacaagcttt

SEQ ID NO: 54347 - DNA, 21 bp, Artificial sequence
  SiRNA target sequence
agtggacaaccacaagcttta

SEQ ID NO: 54348 - DNA, 21 bp, Artificial sequence
  SiRNA target sequence
gtggacaaccacaagctttac

SEQ ID NO: 54349 - DNA, 21 bp, Artificial sequence
  SiRNA target sequence
tggacaaccacaagctttaca

SEQ ID NO: 54350 - DNA, 21 bp, Artificial sequence
  SiRNA target sequence
ggacaaccacaagctttacaa

SEQ ID NO: 54351 - DNA, 21 bp, Artificial sequence
  SiRNA target sequence
gacaaccacaagctttacaaa

SEQ ID NO: 54352 - DNA, 21 bp, Artificial sequence
  SiRNA target sequence
acaaccacaagctttacaaaa

SEQ ID NO: 54353 - DNA, 21 bp, Artificial sequence
  SiRNA target sequence
caaccacaagctttacaaaaa

SEQ ID NO: 54354 - DNA, 21 bp, Artificial sequence
  SiRNA target sequence
aaccacaagctttacaaaaaa

SEQ ID NO: 54355 - DNA, 21 bp, Artificial sequence
  SiRNA target sequence
accacaagctttacaaaaaag

SEQ ID NO: 54356 - DNA, 21 bp, Artificial sequence
  SiRNA target sequence
ccacaagctttacaaaaaagt

SEQ ID NO: 54357 - DNA, 21 bp, Artificial sequence
  SiRNA target sequence
cacaagctttacaaaaaagtg

SEQ ID NO: 54358 - DNA, 21 bp, Artificial sequence
  SiRNA target sequence
acaagctttacaaaaaagtgg

SEQ ID NO: 54359 - DNA, 21 bp, Artificial sequence
  SiRNA target sequence
caagctttacaaaaaagtgga

SEQ ID NO: 54360 - DNA, 21 bp, Artificial sequence
  SiRNA target sequence
aagctttacaaaaaagtggaa

SEQ ID NO: 54361 - DNA, 21 bp, Artificial sequence
  SiRNA target sequence
agctttacaaaaaagtggaag

SEQ ID NO: 54362 - DNA, 21 bp, Artificial sequence
  SiRNA target sequence
gctttacaaaaaagtggaagg

SEQ ID NO: 54363 - DNA, 21 bp, Artificial sequence
  SiRNA target sequence
ctttacaaaaaagtggaaggc

SEQ ID NO: 54364 - DNA, 21 bp, Artificial sequence
  SiRNA target sequence
tttacaaaaaagtggaaggcc

SEQ ID NO: 54365 - DNA, 21 bp, Artificial sequence
  SiRNA target sequence
ttacaaaaaagtggaaggcct

SEQ ID NO: 54366 - DNA, 21 bp, Artificial sequence
  SiRNA target sequence
tacaaaaaagtggaaggccta

SEQ ID NO: 54367 - DNA, 21 bp, Artificial sequence
  SiRNA target sequence
acaaaaaagtggaaggcctat

SEQ ID NO: 54368 - DNA, 21 bp, Artificial sequence
  SiRNA target sequence
caaaaaagtggaaggcctata

SEQ ID NO: 54369 - DNA, 21 bp, Artificial sequence
  SiRNA target sequence
aaaaaagtggaaggcctataa

SEQ ID NO: 54370 - DNA, 21 bp, Artificial sequence
  SiRNA target sequence
aaaaagtggaaggcctataaa

SEQ ID NO: 54371 - DNA, 21 bp, Artificial sequence
  SiRNA target sequence
aaaagtggaaggcctataaag

SEQ ID NO: 54372 - DNA, 21 bp, Artificial sequence
  SiRNA target sequence
aaagtggaaggcctataaagt

SEQ ID NO: 54373 - DNA, 21 bp, Artificial sequence
  SiRNA target sequence
aagtggaaggcctataaagtc

SEQ ID NO: 54374 - DNA, 21 bp, Artificial sequence
  SiRNA target sequence
agtggaaggcctataaagtcg

SEQ ID NO: 54375 - DNA, 21 bp, Artificial sequence
  SiRNA target sequence
gtggaaggcctataaagtcga

SEQ ID NO: 54376 - DNA, 21 bp, Artificial sequence
  SiRNA target sequence
tggaaggcctataaagtcgat

SEQ ID NO: 54377 - DNA, 21 bp, Artificial sequence
  SiRNA target sequence
ggaaggcctataaagtcgatt

SEQ ID NO: 54378 - DNA, 21 bp, Artificial sequence
  SiRNA target sequence
gaaggcctataaagtcgatta

SEQ ID NO: 54379 - DNA, 21 bp, Artificial sequence
  SiRNA target sequence
aaggcctataaagtcgattag

SEQ ID NO: 54380 - DNA, 21 bp, Artificial sequence
  SiRNA target sequence
aggcctataaagtcgattagt

SEQ ID NO: 54381 - DNA, 21 bp, Artificial sequence
  SiRNA target sequence
ggcctataaagtcgattagtg

SEQ ID NO: 54382 - DNA, 21 bp, Artificial sequence
  SiRNA target sequence
gcctataaagtcgattagtgc

SEQ ID NO: 54383 - DNA, 21 bp, Artificial sequence
  SiRNA target sequence
cctataaagtcgattagtgct

SEQ ID NO: 54384 - DNA, 21 bp, Artificial sequence
  SiRNA target sequence
ctataaagtcgattagtgcta

SEQ ID NO: 54385 - DNA, 21 bp, Artificial sequence
  SiRNA target sequence
tataaagtcgattagtgctag

SEQ ID NO: 54386 - DNA, 21 bp, Artificial sequence
  SiRNA target sequence
ataaagtcgattagtgctaga

SEQ ID NO: 54387 - DNA, 21 bp, Artificial sequence
  SiRNA target sequence
taaagtcgattagtgctagat

SEQ ID NO: 54388 - DNA, 21 bp, Artificial sequence
  SiRNA target sequence
aaagtcgattagtgctagatt

SEQ ID NO: 54389 - DNA, 21 bp, Artificial sequence
  SiRNA target sequence
aagtcgattagtgctagatta

SEQ ID NO: 54390 - DNA, 21 bp, Artificial sequence
  SiRNA target sequence
agtcgattagtgctagattaa

SEQ ID NO: 54391 - DNA, 21 bp, Artificial sequence
  SiRNA target sequence
gtcgattagtgctagattaaa

SEQ ID NO: 54392 - DNA, 21 bp, Artificial sequence
  SiRNA target sequence
tcgattagtgctagattaaaa

SEQ ID NO: 54393 - DNA, 21 bp, Artificial sequence
  SiRNA target sequence
cgattagtgctagattaaaag

SEQ ID NO: 54394 - DNA, 21 bp, Artificial sequence
  SiRNA target sequence
gattagtgctagattaaaagg

SEQ ID NO: 54395 - DNA, 21 bp, Artificial sequence
  SiRNA target sequence
attagtgctagattaaaagga

SEQ ID NO: 54396 - DNA, 21 bp, Artificial sequence
  SiRNA target sequence
ttagtgctagattaaaaggaa

SEQ ID NO: 54397 - DNA, 21 bp, Artificial sequence
  SiRNA target sequence
tagtgctagattaaaaggaaa

SEQ ID NO: 54398 - DNA, 21 bp, Artificial sequence
  SiRNA target sequence
agtgctagattaaaaggaaaa

SEQ ID NO: 54399 - DNA, 21 bp, Artificial sequence
  SiRNA target sequence
gtgctagattaaaaggaaaag

SEQ ID NO: 54400 - DNA, 21 bp, Artificial sequence
  SiRNA target sequence
tgctagattaaaaggaaaaga

SEQ ID NO: 54401 - DNA, 21 bp, Artificial sequence
  SiRNA target sequence
gctagattaaaaggaaaagaa

SEQ ID NO: 54402 - DNA, 21 bp, Artificial sequence
  SiRNA target sequence
ctagattaaaaggaaaagaag

SEQ ID NO: 54403 - DNA, 21 bp, Artificial sequence
  SiRNA target sequence
tagattaaaaggaaaagaagg

SEQ ID NO: 54404 - DNA, 21 bp, Artificial sequence
  SiRNA target sequence
agattaaaaggaaaagaaggt

SEQ ID NO: 54405 - DNA, 21 bp, Artificial sequence
  SiRNA target sequence
gattaaaaggaaaagaaggtc

SEQ ID NO: 54406 - DNA, 21 bp, Artificial sequence
  SiRNA target sequence
attaaaaggaaaagaaggtcg

SEQ ID NO: 54407 - DNA, 21 bp, Artificial sequence
  SiRNA target sequence
ttaaaaggaaaagaaggtcga

SEQ ID NO: 54408 - DNA, 21 bp, Artificial sequence
  SiRNA target sequence
taaaaggaaaagaaggtcgag

SEQ ID NO: 54409 - DNA, 21 bp, Artificial sequence
  SiRNA target sequence
aaaaggaaaagaaggtcgagt

SEQ ID NO: 54410 - DNA, 21 bp, Artificial sequence
  SiRNA target sequence
aaaggaaaagaaggtcgagta

SEQ ID NO: 54411 - DNA, 21 bp, Artificial sequence
  SiRNA target sequence
aaggaaaagaaggtcgagtac

SEQ ID NO: 54412 - DNA, 21 bp, Artificial sequence
  SiRNA target sequence
aggaaaagaaggtcgagtacg

SEQ ID NO: 54413 - DNA, 21 bp, Artificial sequence
  SiRNA target sequence
ggaaaagaaggtcgagtacga

SEQ ID NO: 54414 - DNA, 21 bp, Artificial sequence
  SiRNA target sequence
gaaaagaaggtcgagtacgag

SEQ ID NO: 54415 - DNA, 21 bp, Artificial sequence
  SiRNA target sequence
aaaagaaggtcgagtacgagg

SEQ ID NO: 54416 - DNA, 21 bp, Artificial sequence
  SiRNA target sequence
aaagaaggtcgagtacgagga

SEQ ID NO: 54417 - DNA, 21 bp, Artificial sequence
  SiRNA target sequence
aagaaggtcgagtacgaggaa

SEQ ID NO: 54418 - DNA, 21 bp, Artificial sequence
  SiRNA target sequence
agaaggtcgagtacgaggaaa

SEQ ID NO: 54419 - DNA, 21 bp, Artificial sequence
  SiRNA target sequence
gaaggtcgagtacgaggaaat

SEQ ID NO: 54420 - DNA, 21 bp, Artificial sequence
  SiRNA target sequence
aaggtcgagtacgaggaaatt

SEQ ID NO: 54421 - DNA, 21 bp, Artificial sequence
  SiRNA target sequence
aggtcgagtacgaggaaattt

SEQ ID NO: 54422 - DNA, 21 bp, Artificial sequence
  SiRNA target sequence
ggtcgagtacgaggaaatttg

SEQ ID NO: 54423 - DNA, 21 bp, Artificial sequence
  SiRNA target sequence
gtcgagtacgaggaaatttga

SEQ ID NO: 54424 - DNA, 21 bp, Artificial sequence
  SiRNA target sequence
tcgagtacgaggaaatttgat

SEQ ID NO: 54425 - DNA, 21 bp, Artificial sequence
  SiRNA target sequence
cgagtacgaggaaatttgatg

SEQ ID NO: 54426 - DNA, 21 bp, Artificial sequence
  SiRNA target sequence
gagtacgaggaaatttgatgg

SEQ ID NO: 54427 - DNA, 21 bp, Artificial sequence
  SiRNA target sequence
agtacgaggaaatttgatggg

SEQ ID NO: 54428 - DNA, 21 bp, Artificial sequence
  SiRNA target sequence
gtacgaggaaatttgatgggc

SEQ ID NO: 54429 - DNA, 21 bp, Artificial sequence
  SiRNA target sequence
tacgaggaaatttgatgggca

SEQ ID NO: 54430 - DNA, 21 bp, Artificial sequence
  SiRNA target sequence
acgaggaaatttgatgggcaa

SEQ ID NO: 54431 - DNA, 21 bp, Artificial sequence
  SiRNA target sequence
cgaggaaatttgatgggcaaa

SEQ ID NO: 54432 - DNA, 21 bp, Artificial sequence
  SiRNA target sequence
gaggaaatttgatgggcaaaa

SEQ ID NO: 54433 - DNA, 21 bp, Artificial sequence
  SiRNA target sequence
aggaaatttgatgggcaaaag

SEQ ID NO: 54434 - DNA, 21 bp, Artificial sequence
  SiRNA target sequence
ggaaatttgatgggcaaaagg

SEQ ID NO: 54435 - DNA, 21 bp, Artificial sequence
  SiRNA target sequence
gaaatttgatgggcaaaaggg

SEQ ID NO: 54436 - DNA, 21 bp, Artificial sequence
  SiRNA target sequence
aaatttgatgggcaaaagggt

SEQ ID NO: 54437 - DNA, 21 bp, Artificial sequence
  SiRNA target sequence
aatttgatgggcaaaagggta

SEQ ID NO: 54438 - DNA, 21 bp, Artificial sequence
  SiRNA target sequence
atttgatgggcaaaagggtag

SEQ ID NO: 54439 - DNA, 21 bp, Artificial sequence
  SiRNA target sequence
tttgatgggcaaaagggtaga

SEQ ID NO: 54440 - DNA, 21 bp, Artificial sequence
  SiRNA target sequence
ttgatgggcaaaagggtagat

SEQ ID NO: 54441 - DNA, 21 bp, Artificial sequence
  SiRNA target sequence
tgatgggcaaaagggtagatt

SEQ ID NO: 54442 - DNA, 21 bp, Artificial sequence
  SiRNA target sequence
gatgggcaaaagggtagattt

SEQ ID NO: 54443 - DNA, 21 bp, Artificial sequence
  SiRNA target sequence
atgggcaaaagggtagatttt

SEQ ID NO: 54444 - DNA, 21 bp, Artificial sequence
  SiRNA target sequence
tgggcaaaagggtagatttta

SEQ ID NO: 54445 - DNA, 21 bp, Artificial sequence
  SiRNA target sequence
gggcaaaagggtagattttag

SEQ ID NO: 54446 - DNA, 21 bp, Artificial sequence
  SiRNA target sequence
ggcaaaagggtagattttagt

SEQ ID NO: 54447 - DNA, 21 bp, Artificial sequence
  SiRNA target sequence
gcaaaagggtagattttagtg

SEQ ID NO: 54448 - DNA, 21 bp, Artificial sequence
  SiRNA target sequence
caaaagggtagattttagtgc

SEQ ID NO: 54449 - DNA, 21 bp, Artificial sequence
  SiRNA target sequence
aaaagggtagattttagtgca

SEQ ID NO: 54450 - DNA, 21 bp, Artificial sequence
  SiRNA target sequence
aaagggtagattttagtgcaa

SEQ ID NO: 54451 - DNA, 21 bp, Artificial sequence
  SiRNA target sequence
aagggtagattttagtgcaag

SEQ ID NO: 54452 - DNA, 21 bp, Artificial sequence
  SiRNA target sequence
agggtagattttagtgcaaga

SEQ ID NO: 54453 - DNA, 21 bp, Artificial sequence
  SiRNA target sequence
gggtagattttagtgcaagat

SEQ ID NO: 54454 - DNA, 21 bp, Artificial sequence
  SiRNA target sequence
ggtagattttagtgcaagatc

SEQ ID NO: 54455 - DNA, 21 bp, Artificial sequence
  SiRNA target sequence
gtagattttagtgcaagatct

SEQ ID NO: 54456 - DNA, 21 bp, Artificial sequence
  SiRNA target sequence
tagattttagtgcaagatctg

SEQ ID NO: 54457 - DNA, 21 bp, Artificial sequence
  SiRNA target sequence
agattttagtgcaagatctgt

SEQ ID NO: 54458 - DNA, 21 bp, Artificial sequence
  SiRNA target sequence
gattttagtgcaagatctgtt

SEQ ID NO: 54459 - DNA, 21 bp, Artificial sequence
  SiRNA target sequence
attttagtgcaagatctgtta

SEQ ID NO: 54460 - DNA, 21 bp, Artificial sequence
  SiRNA target sequence
ttttagtgcaagatctgttat

SEQ ID NO: 54461 - DNA, 21 bp, Artificial sequence
  SiRNA target sequence
tttagtgcaagatctgttatc

SEQ ID NO: 54462 - DNA, 21 bp, Artificial sequence
  SiRNA target sequence
ttagtgcaagatctgttatca

SEQ ID NO: 54463 - DNA, 21 bp, Artificial sequence
  SiRNA target sequence
tagtgcaagatctgttatcac

SEQ ID NO: 54464 - DNA, 21 bp, Artificial sequence
  SiRNA target sequence
agtgcaagatctgttatcaca

SEQ ID NO: 54465 - DNA, 21 bp, Artificial sequence
  SiRNA target sequence
gtgcaagatctgttatcacac

SEQ ID NO: 54466 - DNA, 21 bp, Artificial sequence
  SiRNA target sequence
tgcaagatctgttatcacacc

SEQ ID NO: 54467 - DNA, 21 bp, Artificial sequence
  SiRNA target sequence
gcaagatctgttatcacacca

SEQ ID NO: 54468 - DNA, 21 bp, Artificial sequence
  SiRNA target sequence
caagatctgttatcacaccag

SEQ ID NO: 54469 - DNA, 21 bp, Artificial sequence
  SiRNA target sequence
aagatctgttatcacaccaga

SEQ ID NO: 54470 - DNA, 21 bp, Artificial sequence
  SiRNA target sequence
agatctgttatcacaccagat

SEQ ID NO: 54471 - DNA, 21 bp, Artificial sequence
  SiRNA target sequence
gatctgttatcacaccagatg

SEQ ID NO: 54472 - DNA, 21 bp, Artificial sequence
  SiRNA target sequence
atctgttatcacaccagatgc

SEQ ID NO: 54473 - DNA, 21 bp, Artificial sequence
  SiRNA target sequence
tctgttatcacaccagatgca

SEQ ID NO: 54474 - DNA, 21 bp, Artificial sequence
  SiRNA target sequence
ctgttatcacaccagatgcaa

SEQ ID NO: 54475 - DNA, 21 bp, Artificial sequence
  SiRNA target sequence
tgttatcacaccagatgcaaa

SEQ ID NO: 54476 - DNA, 21 bp, Artificial sequence
  SiRNA target sequence
gttatcacaccagatgcaaat

SEQ ID NO: 54477 - DNA, 21 bp, Artificial sequence
  SiRNA target sequence
ttatcacaccagatgcaaata

SEQ ID NO: 54478 - DNA, 21 bp, Artificial sequence
  SiRNA target sequence
tatcacaccagatgcaaatat

SEQ ID NO: 54479 - DNA, 21 bp, Artificial sequence
  SiRNA target sequence
atcacaccagatgcaaatatt

SEQ ID NO: 54480 - DNA, 21 bp, Artificial sequence
  SiRNA target sequence
tcacaccagatgcaaatattt

SEQ ID NO: 54481 - DNA, 21 bp, Artificial sequence
  SiRNA target sequence
cacaccagatgcaaatatttc

SEQ ID NO: 54482 - DNA, 21 bp, Artificial sequence
  SiRNA target sequence
acaccagatgcaaatatttca

SEQ ID NO: 54483 - DNA, 21 bp, Artificial sequence
  SiRNA target sequence
caccagatgcaaatatttcat

SEQ ID NO: 54484 - DNA, 21 bp, Artificial sequence
  SiRNA target sequence
accagatgcaaatatttcatt

SEQ ID NO: 54485 - DNA, 21 bp, Artificial sequence
  SiRNA target sequence
ccagatgcaaatatttcatta

SEQ ID NO: 54486 - DNA, 21 bp, Artificial sequence
  SiRNA target sequence
cagatgcaaatatttcattaa

SEQ ID NO: 54487 - DNA, 21 bp, Artificial sequence
  SiRNA target sequence
agatgcaaatatttcattaat

SEQ ID NO: 54488 - DNA, 21 bp, Artificial sequence
  SiRNA target sequence
gatgcaaatatttcattaata

SEQ ID NO: 54489 - DNA, 21 bp, Artificial sequence
  SiRNA target sequence
atgcaaatatttcattaatag

SEQ ID NO: 54490 - DNA, 21 bp, Artificial sequence
  SiRNA target sequence
tgcaaatatttcattaataga

SEQ ID NO: 54491 - DNA, 21 bp, Artificial sequence
  SiRNA target sequence
gcaaatatttcattaatagaa

SEQ ID NO: 54492 - DNA, 21 bp, Artificial sequence
  SiRNA target sequence
caaatatttcattaatagaac

SEQ ID NO: 54493 - DNA, 21 bp, Artificial sequence
  SiRNA target sequence
aaatatttcattaatagaact

SEQ ID NO: 54494 - DNA, 21 bp, Artificial sequence
  SiRNA target sequence
aatatttcattaatagaactt

SEQ ID NO: 54495 - DNA, 21 bp, Artificial sequence
  SiRNA target sequence
atatttcattaatagaacttg

SEQ ID NO: 54496 - DNA, 21 bp, Artificial sequence
  SiRNA target sequence
tatttcattaatagaacttgg

SEQ ID NO: 54497 - DNA, 21 bp, Artificial sequence
  SiRNA target sequence
atttcattaatagaacttgga

SEQ ID NO: 54498 - DNA, 21 bp, Artificial sequence
  SiRNA target sequence
tttcattaatagaacttggag

SEQ ID NO: 54499 - DNA, 21 bp, Artificial sequence
  SiRNA target sequence
ttcattaatagaacttggagt

SEQ ID NO: 54500 - DNA, 21 bp, Artificial sequence
  SiRNA target sequence
tcattaatagaacttggagtt

SEQ ID NO: 54501 - DNA, 21 bp, Artificial sequence
  SiRNA target sequence
cattaatagaacttggagttc

SEQ ID NO: 54502 - DNA, 21 bp, Artificial sequence
  SiRNA target sequence
attaatagaacttggagttcc

SEQ ID NO: 54503 - DNA, 21 bp, Artificial sequence
  SiRNA target sequence
ttaatagaacttggagttcca

SEQ ID NO: 54504 - DNA, 21 bp, Artificial sequence
  SiRNA target sequence
taatagaacttggagttccag

SEQ ID NO: 54505 - DNA, 21 bp, Artificial sequence
  SiRNA target sequence
aatagaacttggagttccagt

SEQ ID NO: 54506 - DNA, 21 bp, Artificial sequence
  SiRNA target sequence
atagaacttggagttccagta

SEQ ID NO: 54507 - DNA, 21 bp, Artificial sequence
  SiRNA target sequence
tagaacttggagttccagtag

SEQ ID NO: 54508 - DNA, 21 bp, Artificial sequence
  SiRNA target sequence
agaacttggagttccagtaga

SEQ ID NO: 54509 - DNA, 21 bp, Artificial sequence
  SiRNA target sequence
gaacttggagttccagtagaa

SEQ ID NO: 54510 - DNA, 21 bp, Artificial sequence
  SiRNA target sequence
aacttggagttccagtagaaa

SEQ ID NO: 54511 - DNA, 21 bp, Artificial sequence
  SiRNA target sequence
acttggagttccagtagaaat

SEQ ID NO: 54512 - DNA, 21 bp, Artificial sequence
  SiRNA target sequence
cttggagttccagtagaaatt

SEQ ID NO: 54513 - DNA, 21 bp, Artificial sequence
  SiRNA target sequence
ttggagttccagtagaaattg

SEQ ID NO: 54514 - DNA, 21 bp, Artificial sequence
  SiRNA target sequence
tggagttccagtagaaattgc

SEQ ID NO: 54515 - DNA, 21 bp, Artificial sequence
  SiRNA target sequence
ggagttccagtagaaattgct

SEQ ID NO: 54516 - DNA, 21 bp, Artificial sequence
  SiRNA target sequence
gagttccagtagaaattgcta

SEQ ID NO: 54517 - DNA, 21 bp, Artificial sequence
  SiRNA target sequence
agttccagtagaaattgctaa

SEQ ID NO: 54518 - DNA, 21 bp, Artificial sequence
  SiRNA target sequence
gttccagtagaaattgctaaa

SEQ ID NO: 54519 - DNA, 21 bp, Artificial sequence
  SiRNA target sequence
ttccagtagaaattgctaaaa

SEQ ID NO: 54520 - DNA, 21 bp, Artificial sequence
  SiRNA target sequence
tccagtagaaattgctaaaat

SEQ ID NO: 54521 - DNA, 21 bp, Artificial sequence
  SiRNA target sequence
ccagtagaaattgctaaaatt

SEQ ID NO: 54522 - DNA, 21 bp, Artificial sequence
  SiRNA target sequence
cagtagaaattgctaaaattc

SEQ ID NO: 54523 - DNA, 21 bp, Artificial sequence
  SiRNA target sequence
agtagaaattgctaaaattca

SEQ ID NO: 54524 - DNA, 21 bp, Artificial sequence
  SiRNA target sequence
  misc_feature (21)..(21): n is a, c, g, or t
gtagaaattgctaaaattcan

SEQ ID NO: 54525 - DNA, 21 bp, Artificial sequence
  SiRNA target sequence
  misc_feature (20)..(20): n is a, c, g, or t
tagaaattgctaaaattcana

SEQ ID NO: 54526 - DNA, 21 bp, Artificial sequence
  SiRNA target sequence
  misc_feature (19)..(19): n is a, c, g, or t
agaaattgctaaaattcanac

SEQ ID NO: 54527 - DNA, 21 bp, Artificial sequence
  SiRNA target sequence
  misc_feature (18)..(18): n is a, c, g, or t
gaaattgctaaaattcanaca

SEQ ID NO: 54528 - DNA, 21 bp, Artificial sequence
  SiRNA target sequence
  misc_feature (17)..(17): n is a, c, g, or t
aaattgctaaaattcanacat

SEQ ID NO: 54529 - DNA, 21 bp, Artificial sequence
  SiRNA target sequence
  misc_feature (16)..(16): n is a, c, g, or t
aattgctaaaattcanacatt

SEQ ID NO: 54530 - DNA, 21 bp, Artificial sequence
  SiRNA target sequence
  misc_feature (15)..(15): n is a, c, g, or t
attgctaaaattcanacattt

SEQ ID NO: 54531 - DNA, 21 bp, Artificial sequence
  SiRNA target sequence
  misc_feature (14)..(14): n is a, c, g, or t
ttgctaaaattcanacatttc

SEQ ID NO: 54532 - DNA, 21 bp, Artificial sequence
  SiRNA target sequence
  misc_feature (13)..(13): n is a, c, g, or t
tgctaaaattcanacatttcc

SEQ ID NO: 54533 - DNA, 21 bp, Artificial sequence
  SiRNA target sequence
  misc_feature (12)..(12): n is a, c, g, or t
gctaaaattcanacatttcct

SEQ ID NO: 54534 - DNA, 21 bp, Artificial sequence
  SiRNA target sequence
  misc_feature (11)..(11): n is a, c, g, or t
ctaaaattcanacatttcctg

SEQ ID NO: 54535 - DNA, 21 bp, Artificial sequence
  SiRNA target sequence
  misc_feature (10)..(10): n is a, c, g, or t
taaaattcanacatttcctga

SEQ ID NO: 54536 - DNA, 21 bp, Artificial sequence
  SiRNA target sequence
  misc_feature (9)..(9): n is a, c, g, or t
aaaattcanacatttcctgaa

SEQ ID NO: 54537 - DNA, 21 bp, Artificial sequence
  SiRNA target sequence
  misc_feature (8)..(8): n is a, c, g, or t
aaattcanacatttcctgaag

SEQ ID NO: 54538 - DNA, 21 bp, Artificial sequence
  SiRNA target sequence
  misc_feature (7)..(7): n is a, c, g, or t
aattcanacatttcctgaagc

SEQ ID NO: 54539 - DNA, 21 bp, Artificial sequence
  SiRNA target sequence
  misc_feature (6)..(6): n is a, c, g, or t
attcanacatttcctgaagca

SEQ ID NO: 54540 - DNA, 21 bp, Artificial sequence
  SiRNA target sequence
  misc_feature (5)..(5): n is a, c, g, or t
ttcanacatttcctgaagcaa

SEQ ID NO: 54541 - DNA, 21 bp, Artificial sequence
  SiRNA target sequence
  misc_feature (4)..(4): n is a, c, g, or t
tcanacatttcctgaagcaat

SEQ ID NO: 54542 - DNA, 21 bp, Artificial sequence
  SiRNA target sequence
  misc_feature (3)..(3): n is a, c, g, or t
canacatttcctgaagcaatc

SEQ ID NO: 54543 - DNA, 21 bp, Artificial sequence
  SiRNA target sequence
  misc_feature (2)..(2): n is a, c, g, or t
anacatttcctgaagcaatca

SEQ ID NO: 54544 - DNA, 21 bp, Artificial sequence
  SiRNA target sequence
  misc_feature (1)..(1): n is a, c, g, or t
nacatttcctgaagcaatcac

SEQ ID NO: 54545 - DNA, 21 bp, Artificial sequence
  SiRNA target sequence
acatttcctgaagcaatcacc

SEQ ID NO: 54546 - DNA, 21 bp, Artificial sequence
  SiRNA target sequence
catttcctgaagcaatcacct

SEQ ID NO: 54547 - DNA, 21 bp, Artificial sequence
  SiRNA target sequence
atttcctgaagcaatcacctc

SEQ ID NO: 54548 - DNA, 21 bp, Artificial sequence
  SiRNA target sequence
tttcctgaagcaatcacctca

SEQ ID NO: 54549 - DNA, 21 bp, Artificial sequence
  SiRNA target sequence
ttcctgaagcaatcacctcat

SEQ ID NO: 54550 - DNA, 21 bp, Artificial sequence
  SiRNA target sequence
tcctgaagcaatcacctcata

SEQ ID NO: 54551 - DNA, 21 bp, Artificial sequence
  SiRNA target sequence
cctgaagcaatcacctcatac

SEQ ID NO: 54552 - DNA, 21 bp, Artificial sequence
  SiRNA target sequence
ctgaagcaatcacctcataca

SEQ ID NO: 54553 - DNA, 21 bp, Artificial sequence
  SiRNA target sequence
tgaagcaatcacctcatacaa

SEQ ID NO: 54554 - DNA, 21 bp, Artificial sequence
  SiRNA target sequence
gaagcaatcacctcatacaat

SEQ ID NO: 54555 - DNA, 21 bp, Artificial sequence
  SiRNA target sequence
aagcaatcacctcatacaata

SEQ ID NO: 54556 - DNA, 21 bp, Artificial sequence
  SiRNA target sequence
agcaatcacctcatacaatat

SEQ ID NO: 54557 - DNA, 21 bp, Artificial sequence
  SiRNA target sequence
gcaatcacctcatacaatatt

SEQ ID NO: 54558 - DNA, 21 bp, Artificial sequence
  SiRNA target sequence
caatcacctcatacaatattc

SEQ ID NO: 54559 - DNA, 21 bp, Artificial sequence
  SiRNA target sequence
aatcacctcatacaatattca

SEQ ID NO: 54560 - DNA, 21 bp, Artificial sequence
  SiRNA target sequence
atcacctcatacaatattcac

SEQ ID NO: 54561 - DNA, 21 bp, Artificial sequence
  SiRNA target sequence
tcacctcatacaatattcaca

SEQ ID NO: 54562 - DNA, 21 bp, Artificial sequence
  SiRNA target sequence
cacctcatacaatattcacaa

SEQ ID NO: 54563 - DNA, 21 bp, Artificial sequence
  SiRNA target sequence
acctcatacaatattcacaag

SEQ ID NO: 54564 - DNA, 21 bp, Artificial sequence
  SiRNA target sequence
cctcatacaatattcacaagt

SEQ ID NO: 54565 - DNA, 21 bp, Artificial sequence
  SiRNA target sequence
ctcatacaatattcacaagtt

SEQ ID NO: 54566 - DNA, 21 bp, Artificial sequence
  SiRNA target sequence
tcatacaatattcacaagttg

SEQ ID NO: 54567 - DNA, 21 bp, Artificial sequence
  SiRNA target sequence
catacaatattcacaagttgt

SEQ ID NO: 54568 - DNA, 21 bp, Artificial sequence
  SiRNA target sequence
atacaatattcacaagttgtc

SEQ ID NO: 54569 - DNA, 21 bp, Artificial sequence
  SiRNA target sequence
tacaatattcacaagttgtct

SEQ ID NO: 54570 - DNA, 21 bp, Artificial sequence
  SiRNA target sequence
acaatattcacaagttgtctg

SEQ ID NO: 54571 - DNA, 21 bp, Artificial sequence
  SiRNA target sequence
caatattcacaagttgtctga

SEQ ID NO: 54572 - DNA, 21 bp, Artificial sequence
  SiRNA target sequence
aatattcacaagttgtctgaa

SEQ ID NO: 54573 - DNA, 21 bp, Artificial sequence
  SiRNA target sequence
atattcacaagttgtctgaac

SEQ ID NO: 54574 - DNA, 21 bp, Artificial sequence
  SiRNA target sequence
tattcacaagttgtctgaact

SEQ ID NO: 54575 - DNA, 21 bp, Artificial sequence
  SiRNA target sequence
attcacaagttgtctgaactt

SEQ ID NO: 54576 - DNA, 21 bp, Artificial sequence
  SiRNA target sequence
ttcacaagttgtctgaacttg

SEQ ID NO: 54577 - DNA, 21 bp, Artificial sequence
  SiRNA target sequence
tcacaagttgtctgaacttgt

SEQ ID NO: 54578 - DNA, 21 bp, Artificial sequence
  SiRNA target sequence
cacaagttgtctgaacttgta

SEQ ID NO: 54579 - DNA, 21 bp, Artificial sequence
  SiRNA target sequence
acaagttgtctgaacttgtat

SEQ ID NO: 54580 - DNA, 21 bp, Artificial sequence
  SiRNA target sequence
caagttgtctgaacttgtatc

SEQ ID NO: 54581 - DNA, 21 bp, Artificial sequence
  SiRNA target sequence
aagttgtctgaacttgtatca

SEQ ID NO: 54582 - DNA, 21 bp, Artificial sequence
  SiRNA target sequence
agttgtctgaacttgtatcaa

SEQ ID NO: 54583 - DNA, 21 bp, Artificial sequence
  SiRNA target sequence
gttgtctgaacttgtatcaaa

SEQ ID NO: 54584 - DNA, 21 bp, Artificial sequence
  SiRNA target sequence
ttgtctgaacttgtatcaaat

SEQ ID NO: 54585 - DNA, 21 bp, Artificial sequence
  SiRNA target sequence
tgtctgaacttgtatcaaatg

SEQ ID NO: 54586 - DNA, 21 bp, Artificial sequence
  SiRNA target sequence
gtctgaacttgtatcaaatgg

SEQ ID NO: 54587 - DNA, 21 bp, Artificial sequence
  SiRNA target sequence
tctgaacttgtatcaaatgga

SEQ ID NO: 54588 - DNA, 21 bp, Artificial sequence
  SiRNA target sequence
ctgaacttgtatcaaatggac

SEQ ID NO: 54589 - DNA, 21 bp, Artificial sequence
  SiRNA target sequence
tgaacttgtatcaaatggacc

SEQ ID NO: 54590 - DNA, 21 bp, Artificial sequence
  SiRNA target sequence
gaacttgtatcaaatggacca

SEQ ID NO: 54591 - DNA, 21 bp, Artificial sequence
  SiRNA target sequence
aacttgtatcaaatggaccaa

SEQ ID NO: 54592 - DNA, 21 bp, Artificial sequence
  SiRNA target sequence
acttgtatcaaatggaccaaa

SEQ ID NO: 54593 - DNA, 21 bp, Artificial sequence
  SiRNA target sequence
cttgtatcaaatggaccaaac

SEQ ID NO: 54594 - DNA, 21 bp, Artificial sequence
  SiRNA target sequence
ttgtatcaaatggaccaaacg

SEQ ID NO: 54595 - DNA, 21 bp, Artificial sequence
  SiRNA target sequence
tgtatcaaatggaccaaacga

SEQ ID NO: 54596 - DNA, 21 bp, Artificial sequence
  SiRNA target sequence
gtatcaaatggaccaaacgaa

SEQ ID NO: 54597 - DNA, 21 bp, Artificial sequence
  SiRNA target sequence
tatcaaatggaccaaacgaat

SEQ ID NO: 54598 - DNA, 21 bp, Artificial sequence
  SiRNA target sequence
atcaaatggaccaaacgaata

SEQ ID NO: 54599 - DNA, 21 bp, Artificial sequence
  SiRNA target sequence
tcaaatggaccaaacgaatat

SEQ ID NO: 54600 - DNA, 21 bp, Artificial sequence
  SiRNA target sequence
caaatggaccaaacgaatatc

SEQ ID NO: 54601 - DNA, 21 bp, Artificial sequence
  SiRNA target sequence
aaatggaccaaacgaatatcc

SEQ ID NO: 54602 - DNA, 21 bp, Artificial sequence
  SiRNA target sequence
aatggaccaaacgaatatcct

SEQ ID NO: 54603 - DNA, 21 bp, Artificial sequence
  SiRNA target sequence
atggaccaaacgaatatcctg

SEQ ID NO: 54604 - DNA, 21 bp, Artificial sequence
  SiRNA target sequence
tggaccaaacgaatatcctgg

SEQ ID NO: 54605 - DNA, 21 bp, Artificial sequence
  SiRNA target sequence
ggaccaaacgaatatcctggt

SEQ ID NO: 54606 - DNA, 21 bp, Artificial sequence
  SiRNA target sequence
gaccaaacgaatatcctggtg

SEQ ID NO: 54607 - DNA, 21 bp, Artificial sequence
  SiRNA target sequence
accaaacgaatatcctggtgc

SEQ ID NO: 54608 - DNA, 21 bp, Artificial sequence
  SiRNA target sequence
ccaaacgaatatcctggtgca

SEQ ID NO: 54609 - DNA, 21 bp, Artificial sequence
  SiRNA target sequence
caaacgaatatcctggtgcaa

SEQ ID NO: 54610 - DNA, 21 bp, Artificial sequence
  SiRNA target sequence
aaacgaatatcctggtgcaaa

SEQ ID NO: 54611 - DNA, 21 bp, Artificial sequence
  SiRNA target sequence
aacgaatatcctggtgcaaat

SEQ ID NO: 54612 - DNA, 21 bp, Artificial sequence
  SiRNA target sequence
acgaatatcctggtgcaaatt

SEQ ID NO: 54613 - DNA, 21 bp, Artificial sequence
  SiRNA target sequence
cgaatatcctggtgcaaatta

SEQ ID NO: 54614 - DNA, 21 bp, Artificial sequence
  SiRNA target sequence
gaatatcctggtgcaaattat

SEQ ID NO: 54615 - DNA, 21 bp, Artificial sequence
  SiRNA target sequence
aatatcctggtgcaaattatg

SEQ ID NO: 54616 - DNA, 21 bp, Artificial sequence
  SiRNA target sequence
atatcctggtgcaaattatgt

SEQ ID NO: 54617 - DNA, 21 bp, Artificial sequence
  SiRNA target sequence
tatcctggtgcaaattatgtt

SEQ ID NO: 54618 - DNA, 21 bp, Artificial sequence
  SiRNA target sequence
atcctggtgcaaattatgtta

SEQ ID NO: 54619 - DNA, 21 bp, Artificial sequence
  SiRNA target sequence
tcctggtgcaaattatgttat

SEQ ID NO: 54620 - DNA, 21 bp, Artificial sequence
  SiRNA target sequence
cctggtgcaaattatgttata

SEQ ID NO: 54621 - DNA, 21 bp, Artificial sequence
  SiRNA target sequence
ctggtgcaaattatgttataa

SEQ ID NO: 54622 - DNA, 21 bp, Artificial sequence
  SiRNA target sequence
tggtgcaaattatgttataag

SEQ ID NO: 54623 - DNA, 21 bp, Artificial sequence
  SiRNA target sequence
ggtgcaaattatgttataaga

SEQ ID NO: 54624 - DNA, 21 bp, Artificial sequence
  SiRNA target sequence
gtgcaaattatgttataagat

SEQ ID NO: 54625 - DNA, 21 bp, Artificial sequence
  SiRNA target sequence
tgcaaattatgttataagatc

SEQ ID NO: 54626 - DNA, 21 bp, Artificial sequence
  SiRNA target sequence
gcaaattatgttataagatct

SEQ ID NO: 54627 - DNA, 21 bp, Artificial sequence
  SiRNA target sequence
caaattatgttataagatctg

SEQ ID NO: 54628 - DNA, 21 bp, Artificial sequence
  SiRNA target sequence
aaattatgttataagatctga

SEQ ID NO: 54629 - DNA, 21 bp, Artificial sequence
  SiRNA target sequence
aattatgttataagatctgat

SEQ ID NO: 54630 - DNA, 21 bp, Artificial sequence
  SiRNA target sequence
attatgttataagatctgatg

SEQ ID NO: 54631 - DNA, 21 bp, Artificial sequence
  SiRNA target sequence
ttatgttataagatctgatgg

SEQ ID NO: 54632 - DNA, 21 bp, Artificial sequence
  SiRNA target sequence
tatgttataagatctgatggt

SEQ ID NO: 54633 - DNA, 21 bp, Artificial sequence
  SiRNA target sequence
atgttataagatctgatggtc

SEQ ID NO: 54634 - DNA, 21 bp, Artificial sequence
  SiRNA target sequence
tgttataagatctgatggtca

SEQ ID NO: 54635 - DNA, 21 bp, Artificial sequence
  SiRNA target sequence
gttataagatctgatggtcaa

SEQ ID NO: 54636 - DNA, 21 bp, Artificial sequence
  SiRNA target sequence
ttataagatctgatggtcaaa

SEQ ID NO: 54637 - DNA, 21 bp, Artificial sequence
  SiRNA target sequence
tataagatctgatggtcaaag

SEQ ID NO: 54638 - DNA, 21 bp, Artificial sequence
  SiRNA target sequence
ataagatctgatggtcaaaga

SEQ ID NO: 54639 - DNA, 21 bp, Artificial sequence
  SiRNA target sequence
taagatctgatggtcaaagaa

SEQ ID NO: 54640 - DNA, 21 bp, Artificial sequence
  SiRNA target sequence
aagatctgatggtcaaagaat

SEQ ID NO: 54641 - DNA, 21 bp, Artificial sequence
  SiRNA target sequence
agatctgatggtcaaagaatt

SEQ ID NO: 54642 - DNA, 21 bp, Artificial sequence
  SiRNA target sequence
gatctgatggtcaaagaattg

SEQ ID NO: 54643 - DNA, 21 bp, Artificial sequence
  SiRNA target sequence
atctgatggtcaaagaattga

SEQ ID NO: 54644 - DNA, 21 bp, Artificial sequence
  SiRNA target sequence
tctgatggtcaaagaattgat

SEQ ID NO: 54645 - DNA, 21 bp, Artificial sequence
  SiRNA target sequence
ctgatggtcaaagaattgatc

SEQ ID NO: 54646 - DNA, 21 bp, Artificial sequence
  SiRNA target sequence
tgatggtcaaagaattgatct

SEQ ID NO: 54647 - DNA, 21 bp, Artificial sequence
  SiRNA target sequence
gatggtcaaagaattgatcta

SEQ ID NO: 54648 - DNA, 21 bp, Artificial sequence
  SiRNA target sequence
atggtcaaagaattgatctaa

SEQ ID NO: 54649 - DNA, 21 bp, Artificial sequence
  SiRNA target sequence
tggtcaaagaattgatctaaa

SEQ ID NO: 54650 - DNA, 21 bp, Artificial sequence
  SiRNA target sequence
ggtcaaagaattgatctaaaa

SEQ ID NO: 54651 - DNA, 21 bp, Artificial sequence
  SiRNA target sequence
gtcaaagaattgatctaaaat

SEQ ID NO: 54652 - DNA, 21 bp, Artificial sequence
  SiRNA target sequence
tcaaagaattgatctaaaatt

SEQ ID NO: 54653 - DNA, 21 bp, Artificial sequence
  SiRNA target sequence
caaagaattgatctaaaattt

SEQ ID NO: 54654 - DNA, 21 bp, Artificial sequence
  SiRNA target sequence
aaagaattgatctaaaattta

SEQ ID NO: 54655 - DNA, 21 bp, Artificial sequence
  SiRNA target sequence
aagaattgatctaaaatttaa

SEQ ID NO: 54656 - DNA, 21 bp, Artificial sequence
  SiRNA target sequence
agaattgatctaaaatttaat

SEQ ID NO: 54657 - DNA, 21 bp, Artificial sequence
  SiRNA target sequence
gaattgatctaaaatttaata

SEQ ID NO: 54658 - DNA, 21 bp, Artificial sequence
  SiRNA target sequence
aattgatctaaaatttaatag

SEQ ID NO: 54659 - DNA, 21 bp, Artificial sequence
  SiRNA target sequence
attgatctaaaatttaataga

SEQ ID NO: 54660 - DNA, 21 bp, Artificial sequence
  SiRNA target sequence
ttgatctaaaatttaatagaa

SEQ ID NO: 54661 - DNA, 21 bp, Artificial sequence
  SiRNA target sequence
tgatctaaaatttaatagaag

SEQ ID NO: 54662 - DNA, 21 bp, Artificial sequence
  SiRNA target sequence
gatctaaaatttaatagaagt

SEQ ID NO: 54663 - DNA, 21 bp, Artificial sequence
  SiRNA target sequence
atctaaaatttaatagaagtg

SEQ ID NO: 54664 - DNA, 21 bp, Artificial sequence
  SiRNA target sequence
tctaaaatttaatagaagtga

SEQ ID NO: 54665 - DNA, 21 bp, Artificial sequence
  SiRNA target sequence
ctaaaatttaatagaagtgat

SEQ ID NO: 54666 - DNA, 21 bp, Artificial sequence
  SiRNA target sequence
taaaatttaatagaagtgata

SEQ ID NO: 54667 - DNA, 21 bp, Artificial sequence
  SiRNA target sequence
aaaatttaatagaagtgatat

SEQ ID NO: 54668 - DNA, 21 bp, Artificial sequence
  SiRNA target sequence
aaatttaatagaagtgatatt

SEQ ID NO: 54669 - DNA, 21 bp, Artificial sequence
  SiRNA target sequence
aatttaatagaagtgatatta

SEQ ID NO: 54670 - DNA, 21 bp, Artificial sequence
  SiRNA target sequence
atttaatagaagtgatattaa

SEQ ID NO: 54671 - DNA, 21 bp, Artificial sequence
  SiRNA target sequence
tttaatagaagtgatattaaa

SEQ ID NO: 54672 - DNA, 21 bp, Artificial sequence
  SiRNA target sequence
ttaatagaagtgatattaaat

SEQ ID NO: 54673 - DNA, 21 bp, Artificial sequence
  SiRNA target sequence
taatagaagtgatattaaatt

SEQ ID NO: 54674 - DNA, 21 bp, Artificial sequence
  SiRNA target sequence
aatagaagtgatattaaatta

SEQ ID NO: 54675 - DNA, 21 bp, Artificial sequence
  SiRNA target sequence
atagaagtgatattaaattag

SEQ ID NO: 54676 - DNA, 21 bp, Artificial sequence
  SiRNA target sequence
tagaagtgatattaaattaga

SEQ ID NO: 54677 - DNA, 21 bp, Artificial sequence
  SiRNA target sequence
agaagtgatattaaattagaa

SEQ ID NO: 54678 - DNA, 21 bp, Artificial sequence
  SiRNA target sequence
gaagtgatattaaattagaag

SEQ ID NO: 54679 - DNA, 21 bp, Artificial sequence
  SiRNA target sequence
aagtgatattaaattagaaga

SEQ ID NO: 54680 - DNA, 21 bp, Artificial sequence
  SiRNA target sequence
agtgatattaaattagaagag

SEQ ID NO: 54681 - DNA, 21 bp, Artificial sequence
  SiRNA target sequence
gtgatattaaattagaagagg

SEQ ID NO: 54682 - DNA, 21 bp, Artificial sequence
  SiRNA target sequence
tgatattaaattagaagaggg

SEQ ID NO: 54683 - DNA, 21 bp, Artificial sequence
  SiRNA target sequence
gatattaaattagaagaggga

SEQ ID NO: 54684 - DNA, 21 bp, Artificial sequence
  SiRNA target sequence
atattaaattagaagagggat

SEQ ID NO: 54685 - DNA, 21 bp, Artificial sequence
  SiRNA target sequence
tattaaattagaagagggata

SEQ ID NO: 54686 - DNA, 21 bp, Artificial sequence
  SiRNA target sequence
attaaattagaagagggatat

SEQ ID NO: 54687 - DNA, 21 bp, Artificial sequence
  SiRNA target sequence
ttaaattagaagagggatata

SEQ ID NO: 54688 - DNA, 21 bp, Artificial sequence
  SiRNA target sequence
taaattagaagagggatatat

SEQ ID NO: 54689 - DNA, 21 bp, Artificial sequence
  SiRNA target sequence
aaattagaagagggatatatt

SEQ ID NO: 54690 - DNA, 21 bp, Artificial sequence
  SiRNA target sequence
aattagaagagggatatattg

SEQ ID NO: 54691 - DNA, 21 bp, Artificial sequence
  SiRNA target sequence
attagaagagggatatattgt

SEQ ID NO: 54692 - DNA, 21 bp, Artificial sequence
  SiRNA target sequence
ttagaagagggatatattgtc

SEQ ID NO: 54693 - DNA, 21 bp, Artificial sequence
  SiRNA target sequence
tagaagagggatatattgtcg

SEQ ID NO: 54694 - DNA, 21 bp, Artificial sequence
  SiRNA target sequence
agaagagggatatattgtcga

SEQ ID NO: 54695 - DNA, 21 bp, Artificial sequence
  SiRNA target sequence
gaagagggatatattgtcgaa

SEQ ID NO: 54696 - DNA, 21 bp, Artificial sequence
  SiRNA target sequence
aagagggatatattgtcgaaa

SEQ ID NO: 54697 - DNA, 21 bp, Artificial sequence
  SiRNA target sequence
agagggatatattgtcgaaag

SEQ ID NO: 54698 - DNA, 21 bp, Artificial sequence
  SiRNA target sequence
gagggatatattgtcgaaaga

SEQ ID NO: 54699 - DNA, 21 bp, Artificial sequence
  SiRNA target sequence
agggatatattgtcgaaagac

SEQ ID NO: 54700 - DNA, 21 bp, Artificial sequence
  SiRNA target sequence
gggatatattgtcgaaagaca

SEQ ID NO: 54701 - DNA, 21 bp, Artificial sequence
  SiRNA target sequence
ggatatattgtcgaaagacat

SEQ ID NO: 54702 - DNA, 21 bp, Artificial sequence
  SiRNA target sequence
gatatattgtcgaaagacata

SEQ ID NO: 54703 - DNA, 21 bp, Artificial sequence
  SiRNA target sequence
atatattgtcgaaagacatat

SEQ ID NO: 54704 - DNA, 21 bp, Artificial sequence
  SiRNA target sequence
tatattgtcgaaagacatatg

SEQ ID NO: 54705 - DNA, 21 bp, Artificial sequence
  SiRNA target sequence
atattgtcgaaagacatatgc

SEQ ID NO: 54706 - DNA, 21 bp, Artificial sequence
  SiRNA target sequence
tattgtcgaaagacatatgca

SEQ ID NO: 54707 - DNA, 21 bp, Artificial sequence
  SiRNA target sequence
attgtcgaaagacatatgcaa

SEQ ID NO: 54708 - DNA, 21 bp, Artificial sequence
  SiRNA target sequence
ttgtcgaaagacatatgcaaa

SEQ ID NO: 54709 - DNA, 21 bp, Artificial sequence
  SiRNA target sequence
tgtcgaaagacatatgcaaaa

SEQ ID NO: 54710 - DNA, 21 bp, Artificial sequence
  SiRNA target sequence
gtcgaaagacatatgcaaaat

SEQ ID NO: 54711 - DNA, 21 bp, Artificial sequence
  SiRNA target sequence
tcgaaagacatatgcaaaatg

SEQ ID NO: 54712 - DNA, 21 bp, Artificial sequence
  SiRNA target sequence
cgaaagacatatgcaaaatgg

SEQ ID NO: 54713 - DNA, 21 bp, Artificial sequence
  SiRNA target sequence
gaaagacatatgcaaaatggg

SEQ ID NO: 54714 - DNA, 21 bp, Artificial sequence
  SiRNA target sequence
aaagacatatgcaaaatgggg

SEQ ID NO: 54715 - DNA, 21 bp, Artificial sequence
  SiRNA target sequence
aagacatatgcaaaatgggga

SEQ ID NO: 54716 - DNA, 21 bp, Artificial sequence
  SiRNA target sequence
  misc_feature (21)..(21): n is a, c, g, or t
agacatatgcaaaatggggan

SEQ ID NO: 54717 - DNA, 21 bp, Artificial sequence
  SiRNA target sequence
  misc_feature (20)..(20): n is a, c, g, or t
gacatatgcaaaatggggana

SEQ ID NO: 54718 - DNA, 21 bp, Artificial sequence
  SiRNA target sequence
  misc_feature (19)..(19): n is a, c, g, or t
acatatgcaaaatgggganat

SEQ ID NO: 54719 - DNA, 21 bp, Artificial sequence
  SiRNA target sequence
  misc_feature (18)..(18): n is a, c, g, or t
catatgcaaaatgggganata

SEQ ID NO: 54720 - DNA, 21 bp, Artificial sequence
  SiRNA target sequence
  misc_feature (17)..(17): n is a, c, g, or t
atatgcaaaatgggganatag

SEQ ID NO: 54721 - DNA, 21 bp, Artificial sequence
  SiRNA target sequence
  misc_feature (16)..(16): n is a, c, g, or t
tatgcaaaatgggganatagt

SEQ ID NO: 54722 - DNA, 21 bp, Artificial sequence
  SiRNA target sequence
  misc_feature (15)..(15): n is a, c, g, or t
  misc_feature (21)..(21): n is a, c, g, or t
atgcaaaatgggganatagtn

SEQ ID NO: 54723 - DNA, 21 bp, Artificial sequence
  SiRNA target sequence
  misc_feature (14)..(14): n is a, c, g, or t
  misc_feature (20)..(21): n is a, c, g, or t
tgcaaaatgggganatagtnn

SEQ ID NO: 54724 - DNA, 21 bp, Artificial sequence
  SiRNA target sequence
  misc_feature (13)..(13): n is a, c, g, or t
  misc_feature (19)..(20): n is a, c, g, or t
gcaaaatgggganatagtnnt

SEQ ID NO: 54725 - DNA, 21 bp, Artificial sequence
  SiRNA target sequence
  misc_feature (12)..(12): n is a, c, g, or t
  misc_feature (18)..(19): n is a, c, g, or t
caaaatgggganatagtnnta

SEQ ID NO: 54726 - DNA, 21 bp, Artificial sequence
  SiRNA target sequence
  misc_feature (11)..(11): n is a, c, g, or t
  misc_feature (17)..(18): n is a, c, g, or t
aaaatgggganatagtnntat

SEQ ID NO: 54727 - DNA, 21 bp, Artificial sequence
  SiRNA target sequence
  misc_feature (10)..(10): n is a, c, g, or t
  misc_feature (16)..(17): n is a, c, g, or t
aaatgggganatagtnntatt

SEQ ID NO: 54728 - DNA, 21 bp, Artificial sequence
  SiRNA target sequence
  misc_feature (9)..(9): n is a, c, g, or t
  misc_feature (15)..(16): n is a, c, g, or t
aatgggganatagtnntattt

SEQ ID NO: 54729 - DNA, 21 bp, Artificial sequence
  SiRNA target sequence
  misc_feature (8)..(8): n is a, c, g, or t
  misc_feature (14)..(15): n is a, c, g, or t
atgggganatagtnntattta

SEQ ID NO: 54730 - DNA, 21 bp, Artificial sequence
  SiRNA target sequence
  misc_feature (7)..(7): n is a, c, g, or t
  misc_feature (13)..(14): n is a, c, g, or t
tgggganatagtnntatttaa

SEQ ID NO: 54731 - DNA, 21 bp, Artificial sequence
  SiRNA target sequence
  misc_feature (6)..(6): n is a, c, g, or t
  misc_feature (12)..(13): n is a, c, g, or t
gggganatagtnntatttaat

SEQ ID NO: 54732 - DNA, 21 bp, Artificial sequence
  SiRNA target sequence
  misc_feature (5)..(5): n is a, c, g, or t
  misc_feature (11)..(12): n is a, c, g, or t
ggganatagtnntatttaata

SEQ ID NO: 54733 - DNA, 21 bp, Artificial sequence
  SiRNA target sequence
  misc_feature (4)..(4): n is a, c, g, or t
  misc_feature (10)..(11): n is a, c, g, or t
gganatagtnntatttaatag

SEQ ID NO: 54734 - DNA, 21 bp, Artificial sequence
  SiRNA target sequence
  misc_feature (3)..(3): n is a, c, g, or t
  misc_feature (9)..(10): n is a, c, g, or t
ganatagtnntatttaataga

SEQ ID NO: 54735 - DNA, 21 bp, Artificial sequence
  SiRNA target sequence
  misc_feature (2)..(2): n is a, c, g, or t
  misc_feature (8)..(9): n is a, c, g, or t
anatagtnntatttaatagac

SEQ ID NO: 54736 - DNA, 21 bp, Artificial sequence
  SiRNA target sequence
  misc_feature (1)..(1): n is a, c, g, or t
  misc_feature (7)..(8): n is a, c, g, or t
natagtnntatttaatagaca

SEQ ID NO: 54737 - DNA, 21 bp, Artificial sequence
  SiRNA target sequence
  misc_feature (6)..(7): n is a, c, g, or t
atagtnntatttaatagacaa

SEQ ID NO: 54738 - DNA, 21 bp, Artificial sequence
  SiRNA target sequence
  misc_feature (5)..(6): n is a, c, g, or t
tagtnntatttaatagacaac

SEQ ID NO: 54739 - DNA, 21 bp, Artificial sequence
  SiRNA target sequence
  misc_feature (4)..(5): n is a, c, g, or t
agtnntatttaatagacaacc

SEQ ID NO: 54740 - DNA, 21 bp, Artificial sequence
  SiRNA target sequence
  misc_feature (3)..(4): n is a, c, g, or t
gtnntatttaatagacaacct

SEQ ID NO: 54741 - DNA, 21 bp, Artificial sequence
  SiRNA target sequence
  misc_feature (2)..(3): n is a, c, g, or t
tnntatttaatagacaacctt

SEQ ID NO: 54742 - DNA, 21 bp, Artificial sequence
  SiRNA target sequence
  misc_feature (1)..(2): n is a, c, g, or t
nntatttaatagacaaccttc

SEQ ID NO: 54743 - DNA, 21 bp, Artificial sequence
  SiRNA target sequence
  misc_feature (1)..(1): n is a, c, g, or t
ntatttaatagacaaccttca

SEQ ID NO: 54744 - DNA, 21 bp, Artificial sequence
  SiRNA target sequence
tatttaatagacaaccttcat

SEQ ID NO: 54745 - DNA, 21 bp, Artificial sequence
  SiRNA target sequence
atttaatagacaaccttcatt

SEQ ID NO: 54746 - DNA, 21 bp, Artificial sequence
  SiRNA target sequence
tttaatagacaaccttcatta

SEQ ID NO: 54747 - DNA, 21 bp, Artificial sequence
  SiRNA target sequence
ttaatagacaaccttcattac

SEQ ID NO: 54748 - DNA, 21 bp, Artificial sequence
  SiRNA target sequence
taatagacaaccttcattaca

SEQ ID NO: 54749 - DNA, 21 bp, Artificial sequence
  SiRNA target sequence
aatagacaaccttcattacat

SEQ ID NO: 54750 - DNA, 21 bp, Artificial sequence
  SiRNA target sequence
atagacaaccttcattacata

SEQ ID NO: 54751 - DNA, 21 bp, Artificial sequence
  SiRNA target sequence
tagacaaccttcattacataa

SEQ ID NO: 54752 - DNA, 21 bp, Artificial sequence
  SiRNA target sequence
agacaaccttcattacataaa

SEQ ID NO: 54753 - DNA, 21 bp, Artificial sequence
  SiRNA target sequence
gacaaccttcattacataaaa

SEQ ID NO: 54754 - DNA, 21 bp, Artificial sequence
  SiRNA target sequence
acaaccttcattacataaaat

SEQ ID NO: 54755 - DNA, 21 bp, Artificial sequence
  SiRNA target sequence
caaccttcattacataaaatg

SEQ ID NO: 54756 - DNA, 21 bp, Artificial sequence
  SiRNA target sequence
aaccttcattacataaaatgt

SEQ ID NO: 54757 - DNA, 21 bp, Artificial sequence
  SiRNA target sequence
accttcattacataaaatgtc

SEQ ID NO: 54758 - DNA, 21 bp, Artificial sequence
  SiRNA target sequence
ccttcattacataaaatgtct

SEQ ID NO: 54759 - DNA, 21 bp, Artificial sequence
  SiRNA target sequence
cttcattacataaaatgtcta

SEQ ID NO: 54760 - DNA, 21 bp, Artificial sequence
  SiRNA target sequence
ttcattacataaaatgtctat

SEQ ID NO: 54761 - DNA, 21 bp, Artificial sequence
  SiRNA target sequence
tcattacataaaatgtctatg

SEQ ID NO: 54762 - DNA, 21 bp, Artificial sequence
  SiRNA target sequence
cattacataaaatgtctatga

SEQ ID NO: 54763 - DNA, 21 bp, Artificial sequence
  SiRNA target sequence
attacataaaatgtctatgat

SEQ ID NO: 54764 - DNA, 21 bp, Artificial sequence
  SiRNA target sequence
ttacataaaatgtctatgatg

SEQ ID NO: 54765 - DNA, 21 bp, Artificial sequence
  SiRNA target sequence
tacataaaatgtctatgatgg

SEQ ID NO: 54766 - DNA, 21 bp, Artificial sequence
  SiRNA target sequence
acataaaatgtctatgatggg

SEQ ID NO: 54767 - DNA, 21 bp, Artificial sequence
  SiRNA target sequence
cataaaatgtctatgatgggt

SEQ ID NO: 54768 - DNA, 21 bp, Artificial sequence
  SiRNA target sequence
ataaaatgtctatgatgggtc

SEQ ID NO: 54769 - DNA, 21 bp, Artificial sequence
  SiRNA target sequence
taaaatgtctatgatgggtca

SEQ ID NO: 54770 - DNA, 21 bp, Artificial sequence
  SiRNA target sequence
aaaatgtctatgatgggtcat

SEQ ID NO: 54771 - DNA, 21 bp, Artificial sequence
  SiRNA target sequence
aaatgtctatgatgggtcatt

SEQ ID NO: 54772 - DNA, 21 bp, Artificial sequence
  SiRNA target sequence
aatgtctatgatgggtcatta

SEQ ID NO: 54773 - DNA, 21 bp, Artificial sequence
  SiRNA target sequence
atgtctatgatgggtcattac

SEQ ID NO: 54774 - DNA, 21 bp, Artificial sequence
  SiRNA target sequence
tgtctatgatgggtcattacg

SEQ ID NO: 54775 - DNA, 21 bp, Artificial sequence
  SiRNA target sequence
gtctatgatgggtcattacgt

SEQ ID NO: 54776 - DNA, 21 bp, Artificial sequence
  SiRNA target sequence
tctatgatgggtcattacgtc

SEQ ID NO: 54777 - DNA, 21 bp, Artificial sequence
  SiRNA target sequence
ctatgatgggtcattacgtca

SEQ ID NO: 54778 - DNA, 21 bp, Artificial sequence
  SiRNA target sequence
tatgatgggtcattacgtcag

SEQ ID NO: 54779 - DNA, 21 bp, Artificial sequence
  SiRNA target sequence
atgatgggtcattacgtcaga

SEQ ID NO: 54780 - DNA, 21 bp, Artificial sequence
  SiRNA target sequence
tgatgggtcattacgtcagag

SEQ ID NO: 54781 - DNA, 21 bp, Artificial sequence
  SiRNA target sequence
gatgggtcattacgtcagagt

SEQ ID NO: 54782 - DNA, 21 bp, Artificial sequence
  SiRNA target sequence
atgggtcattacgtcagagtg

SEQ ID NO: 54783 - DNA, 21 bp, Artificial sequence
  SiRNA target sequence
tgggtcattacgtcagagtga

SEQ ID NO: 54784 - DNA, 21 bp, Artificial sequence
  SiRNA target sequence
gggtcattacgtcagagtgat

SEQ ID NO: 54785 - DNA, 21 bp, Artificial sequence
  SiRNA target sequence
ggtcattacgtcagagtgatg

SEQ ID NO: 54786 - DNA, 21 bp, Artificial sequence
  SiRNA target sequence
gtcattacgtcagagtgatgg

SEQ ID NO: 54787 - DNA, 21 bp, Artificial sequence
  SiRNA target sequence
tcattacgtcagagtgatgga

SEQ ID NO: 54788 - DNA, 21 bp, Artificial sequence
  SiRNA target sequence
cattacgtcagagtgatggaa

SEQ ID NO: 54789 - DNA, 21 bp, Artificial sequence
  SiRNA target sequence
attacgtcagagtgatggaag

SEQ ID NO: 54790 - DNA, 21 bp, Artificial sequence
  SiRNA target sequence
ttacgtcagagtgatggaagg

SEQ ID NO: 54791 - DNA, 21 bp, Artificial sequence
  SiRNA target sequence
tacgtcagagtgatggaagga

SEQ ID NO: 54792 - DNA, 21 bp, Artificial sequence
  SiRNA target sequence
acgtcagagtgatggaaggaa

SEQ ID NO: 54793 - DNA, 21 bp, Artificial sequence
  SiRNA target sequence
cgtcagagtgatggaaggaaa

SEQ ID NO: 54794 - DNA, 21 bp, Artificial sequence
  SiRNA target sequence
gtcagagtgatggaaggaaaa

SEQ ID NO: 54795 - DNA, 21 bp, Artificial sequence
  SiRNA target sequence
tcagagtgatggaaggaaaaa

SEQ ID NO: 54796 - DNA, 21 bp, Artificial sequence
  SiRNA target sequence
cagagtgatggaaggaaaaac

SEQ ID NO: 54797 - DNA, 21 bp, Artificial sequence
  SiRNA target sequence
  misc_feature (21)..(21): n is a, c, g, or t
agagtgatggaaggaaaaacn

SEQ ID NO: 54798 - DNA, 21 bp, Artificial sequence
  SiRNA target sequence
  misc_feature (20)..(20): n is a, c, g, or t
gagtgatggaaggaaaaacnt

SEQ ID NO: 54799 - DNA, 21 bp, Artificial sequence
  SiRNA target sequence
  misc_feature (19)..(19): n is a, c, g, or t
agtgatggaaggaaaaacntt

SEQ ID NO: 54800 - DNA, 21 bp, Artificial sequence
  SiRNA target sequence
  misc_feature (18)..(18): n is a, c, g, or t
gtgatggaaggaaaaacnttt

SEQ ID NO: 54801 - DNA, 21 bp, Artificial sequence
  SiRNA target sequence
  misc_feature (17)..(17): n is a, c, g, or t
tgatggaaggaaaaacnttta

SEQ ID NO: 54802 - DNA, 21 bp, Artificial sequence
  SiRNA target sequence
  misc_feature (16)..(16): n is a, c, g, or t
gatggaaggaaaaacntttag

SEQ ID NO: 54803 - DNA, 21 bp, Artificial sequence
  SiRNA target sequence
  misc_feature (15)..(15): n is a, c, g, or t
atggaaggaaaaacntttaga

SEQ ID NO: 54804 - DNA, 21 bp, Artificial sequence
  SiRNA target sequence
  misc_feature (14)..(14): n is a, c, g, or t
tggaaggaaaaacntttagat

SEQ ID NO: 54805 - DNA, 21 bp, Artificial sequence
  SiRNA target sequence
  misc_feature (13)..(13): n is a, c, g, or t
ggaaggaaaaacntttagatt

SEQ ID NO: 54806 - DNA, 21 bp, Artificial sequence
  SiRNA target sequence
  misc_feature (12)..(12): n is a, c, g, or t
gaaggaaaaacntttagatta

SEQ ID NO: 54807 - DNA, 21 bp, Artificial sequence
  SiRNA target sequence
  misc_feature (11)..(11): n is a, c, g, or t
aaggaaaaacntttagattaa

SEQ ID NO: 54808 - DNA, 21 bp, Artificial sequence
  SiRNA target sequence
  misc_feature (10)..(10): n is a, c, g, or t
aggaaaaacntttagattaaa

SEQ ID NO: 54809 - DNA, 21 bp, Artificial sequence
  SiRNA target sequence
  misc_feature (9)..(9): n is a, c, g, or t
ggaaaaacntttagattaaat

SEQ ID NO: 54810 - DNA, 21 bp, Artificial sequence
  SiRNA target sequence
  misc_feature (8)..(8): n is a, c, g, or t
gaaaaacntttagattaaatt

SEQ ID NO: 54811 - DNA, 21 bp, Artificial sequence
  SiRNA target sequence
  misc_feature (7)..(7): n is a, c, g, or t
aaaaacntttagattaaattt

SEQ ID NO: 54812 - DNA, 21 bp, Artificial sequence
  SiRNA target sequence
  misc_feature (6)..(6): n is a, c, g, or t
aaaacntttagattaaatttg

SEQ ID NO: 54813 - DNA, 21 bp, Artificial sequence
  SiRNA target sequence
  misc_feature (5)..(5): n is a, c, g, or t
aaacntttagattaaatttga

SEQ ID NO: 54814 - DNA, 21 bp, Artificial sequence
  SiRNA target sequence
  misc_feature (4)..(4): n is a, c, g, or t
aacntttagattaaatttgag

SEQ ID NO: 54815 - DNA, 21 bp, Artificial sequence
  SiRNA target sequence
  misc_feature (3)..(3): n is a, c, g, or t
acntttagattaaatttgagt

SEQ ID NO: 54816 - DNA, 21 bp, Artificial sequence
  SiRNA target sequence
  misc_feature (2)..(2): n is a, c, g, or t
cntttagattaaatttgagtg

SEQ ID NO: 54817 - DNA, 21 bp, Artificial sequence
  SiRNA target sequence
  misc_feature (1)..(1): n is a, c, g, or t
ntttagattaaatttgagtgt

SEQ ID NO: 54818 - DNA, 21 bp, Artificial sequence
  SiRNA target sequence
tttagattaaatttgagtgtc

SEQ ID NO: 54819 - DNA, 21 bp, Artificial sequence
  SiRNA target sequence
ttagattaaatttgagtgtca

SEQ ID NO: 54820 - DNA, 21 bp, Artificial sequence
  SiRNA target sequence
tagattaaatttgagtgtcac

SEQ ID NO: 54821 - DNA, 21 bp, Artificial sequence
  SiRNA target sequence
agattaaatttgagtgtcaca

SEQ ID NO: 54822 - DNA, 21 bp, Artificial sequence
  SiRNA target sequence
gattaaatttgagtgtcacaa

SEQ ID NO: 54823 - DNA, 21 bp, Artificial sequence
  SiRNA target sequence
attaaatttgagtgtcacaac

SEQ ID NO: 54824 - DNA, 21 bp, Artificial sequence
  SiRNA target sequence
ttaaatttgagtgtcacaact

SEQ ID NO: 54825 - DNA, 21 bp, Artificial sequence
  SiRNA target sequence
taaatttgagtgtcacaactc

SEQ ID NO: 54826 - DNA, 21 bp, Artificial sequence
  SiRNA target sequence
aaatttgagtgtcacaactcc

SEQ ID NO: 54827 - DNA, 21 bp, Artificial sequence
  SiRNA target sequence
aatttgagtgtcacaactccg

SEQ ID NO: 54828 - DNA, 21 bp, Artificial sequence
  SiRNA target sequence
atttgagtgtcacaactccgt

SEQ ID NO: 54829 - DNA, 21 bp, Artificial sequence
  SiRNA target sequence
tttgagtgtcacaactccgta

SEQ ID NO: 54830 - DNA, 21 bp, Artificial sequence
  SiRNA target sequence
ttgagtgtcacaactccgtat

SEQ ID NO: 54831 - DNA, 21 bp, Artificial sequence
  SiRNA target sequence
tgagtgtcacaactccgtata

SEQ ID NO: 54832 - DNA, 21 bp, Artificial sequence
  SiRNA target sequence
gagtgtcacaactccgtataa

SEQ ID NO: 54833 - DNA, 21 bp, Artificial sequence
  SiRNA target sequence
agtgtcacaactccgtataat

SEQ ID NO: 54834 - DNA, 21 bp, Artificial sequence
  SiRNA target sequence
gtgtcacaactccgtataatg

SEQ ID NO: 54835 - DNA, 21 bp, Artificial sequence
  SiRNA target sequence
tgtcacaactccgtataatgc

SEQ ID NO: 54836 - DNA, 21 bp, Artificial sequence
  SiRNA target sequence
gtcacaactccgtataatgca

SEQ ID NO: 54837 - DNA, 21 bp, Artificial sequence
  SiRNA target sequence
tcacaactccgtataatgcag

SEQ ID NO: 54838 - DNA, 21 bp, Artificial sequence
  SiRNA target sequence
cacaactccgtataatgcaga

SEQ ID NO: 54839 - DNA, 21 bp, Artificial sequence
  SiRNA target sequence
acaactccgtataatgcagat

SEQ ID NO: 54840 - DNA, 21 bp, Artificial sequence
  SiRNA target sequence
caactccgtataatgcagatt

SEQ ID NO: 54841 - DNA, 21 bp, Artificial sequence
  SiRNA target sequence
aactccgtataatgcagattt

SEQ ID NO: 54842 - DNA, 21 bp, Artificial sequence
  SiRNA target sequence
actccgtataatgcagatttt

SEQ ID NO: 54843 - DNA, 21 bp, Artificial sequence
  SiRNA target sequence
ctccgtataatgcagattttg

SEQ ID NO: 54844 - DNA, 21 bp, Artificial sequence
  SiRNA target sequence
tccgtataatgcagattttga

SEQ ID NO: 54845 - DNA, 21 bp, Artificial sequence
  SiRNA target sequence
ccgtataatgcagattttgac

SEQ ID NO: 54846 - DNA, 21 bp, Artificial sequence
  SiRNA target sequence
cgtataatgcagattttgacg

SEQ ID NO: 54847 - DNA, 21 bp, Artificial sequence
  SiRNA target sequence
gtataatgcagattttgacgg

SEQ ID NO: 54848 - DNA, 21 bp, Artificial sequence
  SiRNA target sequence
tataatgcagattttgacgga

SEQ ID NO: 54849 - DNA, 21 bp, Artificial sequence
  SiRNA target sequence
ataatgcagattttgacggag

SEQ ID NO: 54850 - DNA, 21 bp, Artificial sequence
  SiRNA target sequence
taatgcagattttgacggaga

SEQ ID NO: 54851 - DNA, 21 bp, Artificial sequence
  SiRNA target sequence
aatgcagattttgacggagat

SEQ ID NO: 54852 - DNA, 21 bp, Artificial sequence
  SiRNA target sequence
atgcagattttgacggagatg

SEQ ID NO: 54853 - DNA, 21 bp, Artificial sequence
  SiRNA target sequence
tgcagattttgacggagatga

SEQ ID NO: 54854 - DNA, 21 bp, Artificial sequence
  SiRNA target sequence
gcagattttgacggagatgaa

SEQ ID NO: 54855 - DNA, 21 bp, Artificial sequence
  SiRNA target sequence
cagattttgacggagatgaaa

SEQ ID NO: 54856 - DNA, 21 bp, Artificial sequence
  SiRNA target sequence
agattttgacggagatgaaat

SEQ ID NO: 54857 - DNA, 21 bp, Artificial sequence
  SiRNA target sequence
gattttgacggagatgaaatg

SEQ ID NO: 54858 - DNA, 21 bp, Artificial sequence
  SiRNA target sequence
attttgacggagatgaaatga

SEQ ID NO: 54859 - DNA, 21 bp, Artificial sequence
  SiRNA target sequence
ttttgacggagatgaaatgaa

SEQ ID NO: 54860 - DNA, 21 bp, Artificial sequence
  SiRNA target sequence
tttgacggagatgaaatgaat

SEQ ID NO: 54861 - DNA, 21 bp, Artificial sequence
  SiRNA target sequence
ttgacggagatgaaatgaatt

SEQ ID NO: 54862 - DNA, 21 bp, Artificial sequence
  SiRNA target sequence
tgacggagatgaaatgaattt

SEQ ID NO: 54863 - DNA, 21 bp, Artificial sequence
  SiRNA target sequence
gacggagatgaaatgaattta

SEQ ID NO: 54864 - DNA, 21 bp, Artificial sequence
  SiRNA target sequence
acggagatgaaatgaatttac

SEQ ID NO: 54865 - DNA, 21 bp, Artificial sequence
  SiRNA target sequence
cggagatgaaatgaatttaca

SEQ ID NO: 54866 - DNA, 21 bp, Artificial sequence
  SiRNA target sequence
ggagatgaaatgaatttacac

SEQ ID NO: 54867 - DNA, 21 bp, Artificial sequence
  SiRNA target sequence
gagatgaaatgaatttacaca

SEQ ID NO: 54868 - DNA, 21 bp, Artificial sequence
  SiRNA target sequence
agatgaaatgaatttacacat

SEQ ID NO: 54869 - DNA, 21 bp, Artificial sequence
  SiRNA target sequence
gatgaaatgaatttacacatg

SEQ ID NO: 54870 - DNA, 21 bp, Artificial sequence
  SiRNA target sequence
atgaaatgaatttacacatgc

SEQ ID NO: 54871 - DNA, 21 bp, Artificial sequence
  SiRNA target sequence
tgaaatgaatttacacatgcc

SEQ ID NO: 54872 - DNA, 21 bp, Artificial sequence
  SiRNA target sequence
gaaatgaatttacacatgcca

SEQ ID NO: 54873 - DNA, 21 bp, Artificial sequence
  SiRNA target sequence
aaatgaatttacacatgccac

SEQ ID NO: 54874 - DNA, 21 bp, Artificial sequence
  SiRNA target sequence
aatgaatttacacatgccaca

SEQ ID NO: 54875 - DNA, 21 bp, Artificial sequence
  SiRNA target sequence
atgaatttacacatgccacaa

SEQ ID NO: 54876 - DNA, 21 bp, Artificial sequence
  SiRNA target sequence
tgaatttacacatgccacaat

SEQ ID NO: 54877 - DNA, 21 bp, Artificial sequence
  SiRNA target sequence
gaatttacacatgccacaatc

SEQ ID NO: 54878 - DNA, 21 bp, Artificial sequence
  SiRNA target sequence
aatttacacatgccacaatca

SEQ ID NO: 54879 - DNA, 21 bp, Artificial sequence
  SiRNA target sequence
atttacacatgccacaatcac

SEQ ID NO: 54880 - DNA, 21 bp, Artificial sequence
  SiRNA target sequence
tttacacatgccacaatcaca

SEQ ID NO: 54881 - DNA, 21 bp, Artificial sequence
  SiRNA target sequence
ttacacatgccacaatcacat

SEQ ID NO: 54882 - DNA, 21 bp, Artificial sequence
  SiRNA target sequence
tacacatgccacaatcacata

SEQ ID NO: 54883 - DNA, 21 bp, Artificial sequence
  SiRNA target sequence
acacatgccacaatcacataa

SEQ ID NO: 54884 - DNA, 21 bp, Artificial sequence
  SiRNA target sequence
cacatgccacaatcacataat

SEQ ID NO: 54885 - DNA, 21 bp, Artificial sequence
  SiRNA target sequence
acatgccacaatcacataatt

SEQ ID NO: 54886 - DNA, 21 bp, Artificial sequence
  SiRNA target sequence
catgccacaatcacataattc

SEQ ID NO: 54887 - DNA, 21 bp, Artificial sequence
  SiRNA target sequence
atgccacaatcacataattca

SEQ ID NO: 54888 - DNA, 21 bp, Artificial sequence
  SiRNA target sequence
tgccacaatcacataattcaa

SEQ ID NO: 54889 - DNA, 21 bp, Artificial sequence
  SiRNA target sequence
gccacaatcacataattcaag

SEQ ID NO: 54890 - DNA, 21 bp, Artificial sequence
  SiRNA target sequence
ccacaatcacataattcaaga

SEQ ID NO: 54891 - DNA, 21 bp, Artificial sequence
  SiRNA target sequence
cacaatcacataattcaagag

SEQ ID NO: 54892 - DNA, 21 bp, Artificial sequence
  SiRNA target sequence
acaatcacataattcaagagc

SEQ ID NO: 54893 - DNA, 21 bp, Artificial sequence
  SiRNA target sequence
caatcacataattcaagagca

SEQ ID NO: 54894 - DNA, 21 bp, Artificial sequence
  SiRNA target sequence
aatcacataattcaagagcag

SEQ ID NO: 54895 - DNA, 21 bp, Artificial sequence
  SiRNA target sequence
atcacataattcaagagcaga

SEQ ID NO: 54896 - DNA, 21 bp, Artificial sequence
  SiRNA target sequence
tcacataattcaagagcagag

SEQ ID NO: 54897 - DNA, 21 bp, Artificial sequence
  SiRNA target sequence
cacataattcaagagcagagc

SEQ ID NO: 54898 - DNA, 21 bp, Artificial sequence
  SiRNA target sequence
acataattcaagagcagagct

SEQ ID NO: 54899 - DNA, 21 bp, Artificial sequence
  SiRNA target sequence
cataattcaagagcagagctt

SEQ ID NO: 54900 - DNA, 21 bp, Artificial sequence
  SiRNA target sequence
ataattcaagagcagagcttg

SEQ ID NO: 54901 - DNA, 21 bp, Artificial sequence
  SiRNA target sequence
taattcaagagcagagcttga

SEQ ID NO: 54902 - DNA, 21 bp, Artificial sequence
  SiRNA target sequence
aattcaagagcagagcttgaa

SEQ ID NO: 54903 - DNA, 21 bp, Artificial sequence
  SiRNA target sequence
attcaagagcagagcttgaag

SEQ ID NO: 54904 - DNA, 21 bp, Artificial sequence
  SiRNA target sequence
ttcaagagcagagcttgaaga

SEQ ID NO: 54905 - DNA, 21 bp, Artificial sequence
  SiRNA target sequence
tcaagagcagagcttgaagaa

SEQ ID NO: 54906 - DNA, 21 bp, Artificial sequence
  SiRNA target sequence
caagagcagagcttgaagaac

SEQ ID NO: 54907 - DNA, 21 bp, Artificial sequence
  SiRNA target sequence
aagagcagagcttgaagaact

SEQ ID NO: 54908 - DNA, 21 bp, Artificial sequence
  SiRNA target sequence
agagcagagcttgaagaactc

SEQ ID NO: 54909 - DNA, 21 bp, Artificial sequence
  SiRNA target sequence
gagcagagcttgaagaactct

SEQ ID NO: 54910 - DNA, 21 bp, Artificial sequence
  SiRNA target sequence
agcagagcttgaagaactctg

SEQ ID NO: 54911 - DNA, 21 bp, Artificial sequence
  SiRNA target sequence
gcagagcttgaagaactctgt

SEQ ID NO: 54912 - DNA, 21 bp, Artificial sequence
  SiRNA target sequence
cagagcttgaagaactctgtc

SEQ ID NO: 54913 - DNA, 21 bp, Artificial sequence
  SiRNA target sequence
agagcttgaagaactctgtct

SEQ ID NO: 54914 - DNA, 21 bp, Artificial sequence
  SiRNA target sequence
gagcttgaagaactctgtctg

SEQ ID NO: 54915 - DNA, 21 bp, Artificial sequence
  SiRNA target sequence
agcttgaagaactctgtctgg

SEQ ID NO: 54916 - DNA, 21 bp, Artificial sequence
  SiRNA target sequence
gcttgaagaactctgtctggt

SEQ ID NO: 54917 - DNA, 21 bp, Artificial sequence
  SiRNA target sequence
cttgaagaactctgtctggta

SEQ ID NO: 54918 - DNA, 21 bp, Artificial sequence
  SiRNA target sequence
ttgaagaactctgtctggtat

SEQ ID NO: 54919 - DNA, 21 bp, Artificial sequence
  SiRNA target sequence
tgaagaactctgtctggtatc

SEQ ID NO: 54920 - DNA, 21 bp, Artificial sequence
  SiRNA target sequence
gaagaactctgtctggtatct

SEQ ID NO: 54921 - DNA, 21 bp, Artificial sequence
  SiRNA target sequence
aagaactctgtctggtatcta

SEQ ID NO: 54922 - DNA, 21 bp, Artificial sequence
  SiRNA target sequence
agaactctgtctggtatctaa

SEQ ID NO: 54923 - DNA, 21 bp, Artificial sequence
  SiRNA target sequence
gaactctgtctggtatctaaa

SEQ ID NO: 54924 - DNA, 21 bp, Artificial sequence
  SiRNA target sequence
aactctgtctggtatctaaac

SEQ ID NO: 54925 - DNA, 21 bp, Artificial sequence
  SiRNA target sequence
actctgtctggtatctaaaca

SEQ ID NO: 54926 - DNA, 21 bp, Artificial sequence
  SiRNA target sequence
ctctgtctggtatctaaacaa

SEQ ID NO: 54927 - DNA, 21 bp, Artificial sequence
  SiRNA target sequence
tctgtctggtatctaaacaag

SEQ ID NO: 54928 - DNA, 21 bp, Artificial sequence
  SiRNA target sequence
ctgtctggtatctaaacaagt

SEQ ID NO: 54929 - DNA, 21 bp, Artificial sequence
  SiRNA target sequence
tgtctggtatctaaacaagta

SEQ ID NO: 54930 - DNA, 21 bp, Artificial sequence
  SiRNA target sequence
gtctggtatctaaacaagtat

SEQ ID NO: 54931 - DNA, 21 bp, Artificial sequence
  SiRNA target sequence
tctggtatctaaacaagtatt

SEQ ID NO: 54932 - DNA, 21 bp, Artificial sequence
  SiRNA target sequence
ctggtatctaaacaagtattg

SEQ ID NO: 54933 - DNA, 21 bp, Artificial sequence
  SiRNA target sequence
tggtatctaaacaagtattga

SEQ ID NO: 54934 - DNA, 21 bp, Artificial sequence
  SiRNA target sequence
ggtatctaaacaagtattgac

SEQ ID NO: 54935 - DNA, 21 bp, Artificial sequence
  SiRNA target sequence
gtatctaaacaagtattgaca

SEQ ID NO: 54936 - DNA, 21 bp, Artificial sequence
  SiRNA target sequence
tatctaaacaagtattgacac

SEQ ID NO: 54937 - DNA, 21 bp, Artificial sequence
  SiRNA target sequence
atctaaacaagtattgacacc

SEQ ID NO: 54938 - DNA, 21 bp, Artificial sequence
  SiRNA target sequence
tctaaacaagtattgacacca

SEQ ID NO: 54939 - DNA, 21 bp, Artificial sequence
  SiRNA target sequence
ctaaacaagtattgacaccac

SEQ ID NO: 54940 - DNA, 21 bp, Artificial sequence
  SiRNA target sequence
taaacaagtattgacaccaca

SEQ ID NO: 54941 - DNA, 21 bp, Artificial sequence
  SiRNA target sequence
aaacaagtattgacaccacaa

SEQ ID NO: 54942 - DNA, 21 bp, Artificial sequence
  SiRNA target sequence
aacaagtattgacaccacaag

SEQ ID NO: 54943 - DNA, 21 bp, Artificial sequence
  SiRNA target sequence
acaagtattgacaccacaagc

SEQ ID NO: 54944 - DNA, 21 bp, Artificial sequence
  SiRNA target sequence
caagtattgacaccacaagct

SEQ ID NO: 54945 - DNA, 21 bp, Artificial sequence
  SiRNA target sequence
aagtattgacaccacaagcta

SEQ ID NO: 54946 - DNA, 21 bp, Artificial sequence
  SiRNA target sequence
agtattgacaccacaagctaa

SEQ ID NO: 54947 - DNA, 21 bp, Artificial sequence
  SiRNA target sequence
gtattgacaccacaagctaat

SEQ ID NO: 54948 - DNA, 21 bp, Artificial sequence
  SiRNA target sequence
tattgacaccacaagctaatc

SEQ ID NO: 54949 - DNA, 21 bp, Artificial sequence
  SiRNA target sequence
attgacaccacaagctaatcg

SEQ ID NO: 54950 - DNA, 21 bp, Artificial sequence
  SiRNA target sequence
ttgacaccacaagctaatcgt

SEQ ID NO: 54951 - DNA, 21 bp, Artificial sequence
  SiRNA target sequence
tgacaccacaagctaatcgtc

SEQ ID NO: 54952 - DNA, 21 bp, Artificial sequence
  SiRNA target sequence
gacaccacaagctaatcgtcc

SEQ ID NO: 54953 - DNA, 21 bp, Artificial sequence
  SiRNA target sequence
acaccacaagctaatcgtcct

SEQ ID NO: 54954 - DNA, 21 bp, Artificial sequence
  SiRNA target sequence
caccacaagctaatcgtccta

SEQ ID NO: 54955 - DNA, 21 bp, Artificial sequence
  SiRNA target sequence
accacaagctaatcgtcctat

SEQ ID NO: 54956 - DNA, 21 bp, Artificial sequence
  SiRNA target sequence
ccacaagctaatcgtcctata

SEQ ID NO: 54957 - DNA, 21 bp, Artificial sequence
  SiRNA target sequence
cacaagctaatcgtcctataa

SEQ ID NO: 54958 - DNA, 21 bp, Artificial sequence
  SiRNA target sequence
acaagctaatcgtcctataat

SEQ ID NO: 54959 - DNA, 21 bp, Artificial sequence
  SiRNA target sequence
caagctaatcgtcctataatg

SEQ ID NO: 54960 - DNA, 21 bp, Artificial sequence
  SiRNA target sequence
aagctaatcgtcctataatgg

SEQ ID NO: 54961 - DNA, 21 bp, Artificial sequence
  SiRNA target sequence
agctaatcgtcctataatggg

SEQ ID NO: 54962 - DNA, 21 bp, Artificial sequence
  SiRNA target sequence
gctaatcgtcctataatgggt

SEQ ID NO: 54963 - DNA, 21 bp, Artificial sequence
  SiRNA target sequence
ctaatcgtcctataatgggta

SEQ ID NO: 54964 - DNA, 21 bp, Artificial sequence
  SiRNA target sequence
taatcgtcctataatgggtat

SEQ ID NO: 54965 - DNA, 21 bp, Artificial sequence
  SiRNA target sequence
aatcgtcctataatgggtatt

SEQ ID NO: 54966 - DNA, 21 bp, Artificial sequence
  SiRNA target sequence
atcgtcctataatgggtattg

SEQ ID NO: 54967 - DNA, 21 bp, Artificial sequence
  SiRNA target sequence
tcgtcctataatgggtattgt

SEQ ID NO: 54968 - DNA, 21 bp, Artificial sequence
  SiRNA target sequence
cgtcctataatgggtattgta

SEQ ID NO: 54969 - DNA, 21 bp, Artificial sequence
  SiRNA target sequence
gtcctataatgggtattgtac

SEQ ID NO: 54970 - DNA, 21 bp, Artificial sequence
  SiRNA target sequence
tcctataatgggtattgtaca

SEQ ID NO: 54971 - DNA, 21 bp, Artificial sequence
  SiRNA target sequence
cctataatgggtattgtacaa

SEQ ID NO: 54972 - DNA, 21 bp, Artificial sequence
  SiRNA target sequence
ctataatgggtattgtacaag

SEQ ID NO: 54973 - DNA, 21 bp, Artificial sequence
  SiRNA target sequence
tataatgggtattgtacaaga

SEQ ID NO: 54974 - DNA, 21 bp, Artificial sequence
  SiRNA target sequence
  misc_feature (21)..(21): n is a, c, g, or t
ataatgggtattgtacaagan

SEQ ID NO: 54975 - DNA, 21 bp, Artificial sequence
  SiRNA target sequence
  misc_feature (20)..(20): n is a, c, g, or t
taatgggtattgtacaagana

SEQ ID NO: 54976 - DNA, 21 bp, Artificial sequence
  SiRNA target sequence
  misc_feature (19)..(19): n is a, c, g, or t
aatgggtattgtacaaganac

SEQ ID NO: 54977 - DNA, 21 bp, Artificial sequence
  SiRNA target sequence
  misc_feature (18)..(18): n is a, c, g, or t
atgggtattgtacaaganaca

SEQ ID NO: 54978 - DNA, 21 bp, Artificial sequence
  SiRNA target sequence
  misc_feature (17)..(17): n is a, c, g, or t
tgggtattgtacaaganacac

SEQ ID NO: 54979 - DNA, 21 bp, Artificial sequence
  SiRNA target sequence
  misc_feature (16)..(16): n is a, c, g, or t
gggtattgtacaaganacact

SEQ ID NO: 54980 - DNA, 21 bp, Artificial sequence
  SiRNA target sequence
  misc_feature (15)..(15): n is a, c, g, or t
ggtattgtacaaganacacta

SEQ ID NO: 54981 - DNA, 21 bp, Artificial sequence
  SiRNA target sequence
  misc_feature (14)..(14): n is a, c, g, or t
gtattgtacaaganacactaa

SEQ ID NO: 54982 - DNA, 21 bp, Artificial sequence
  SiRNA target sequence
  misc_feature (13)..(13): n is a, c, g, or t
tattgtacaaganacactaac

SEQ ID NO: 54983 - DNA, 21 bp, Artificial sequence
  SiRNA target sequence
  misc_feature (12)..(12): n is a, c, g, or t
attgtacaaganacactaact

SEQ ID NO: 54984 - DNA, 21 bp, Artificial sequence
  SiRNA target sequence
  misc_feature (11)..(11): n is a, c, g, or t
ttgtacaaganacactaactg

SEQ ID NO: 54985 - DNA, 21 bp, Artificial sequence
  SiRNA target sequence
  misc_feature (10)..(10): n is a, c, g, or t
tgtacaaganacactaactgg

SEQ ID NO: 54986 - DNA, 21 bp, Artificial sequence
  SiRNA target sequence
  misc_feature (9)..(9): n is a, c, g, or t
gtacaaganacactaactgga

SEQ ID NO: 54987 - DNA, 21 bp, Artificial sequence
  SiRNA target sequence
  misc_feature (8)..(8): n is a, c, g, or t
tacaaganacactaactggac

SEQ ID NO: 54988 - DNA, 21 bp, Artificial sequence
  SiRNA target sequence
  misc_feature (7)..(7): n is a, c, g, or t
acaaganacactaactggact

SEQ ID NO: 54989 - DNA, 21 bp, Artificial sequence
  SiRNA target sequence
  misc_feature (6)..(6): n is a, c, g, or t
caaganacactaactggactt

SEQ ID NO: 54990 - DNA, 21 bp, Artificial sequence
  SiRNA target sequence
  misc_feature (5)..(5): n is a, c, g, or t
aaganacactaactggacttc

SEQ ID NO: 54991 - DNA, 21 bp, Artificial sequence
  SiRNA target sequence
  misc_feature (4)..(4): n is a, c, g, or t
aganacactaactggacttcg

SEQ ID NO: 54992 - DNA, 21 bp, Artificial sequence
  SiRNA target sequence
  misc_feature (3)..(3): n is a, c, g, or t
ganacactaactggacttcgt

SEQ ID NO: 54993 - DNA, 21 bp, Artificial sequence
  SiRNA target sequence
  misc_feature (2)..(2): n is a, c, g, or t
anacactaactggacttcgtt

SEQ ID NO: 54994 - DNA, 21 bp, Artificial sequence
  SiRNA target sequence
  misc_feature (1)..(1): n is a, c, g, or t
nacactaactggacttcgttt

SEQ ID NO: 54995 - DNA, 21 bp, Artificial sequence
  SiRNA target sequence
acactaactggacttcgtttg

SEQ ID NO: 54996 - DNA, 21 bp, Artificial sequence
  SiRNA target sequence
cactaactggacttcgtttgt

SEQ ID NO: 54997 - DNA, 21 bp, Artificial sequence
  SiRNA target sequence
actaactggacttcgtttgtt

SEQ ID NO: 54998 - DNA, 21 bp, Artificial sequence
  SiRNA target sequence
ctaactggacttcgtttgttt

SEQ ID NO: 54999 - DNA, 21 bp, Artificial sequence
  SiRNA target sequence
taactggacttcgtttgttta

SEQ ID NO: 55000 - DNA, 21 bp, Artificial sequence
  SiRNA target sequence
aactggacttcgtttgtttac

SEQ ID NO: 55001 - DNA, 21 bp, Artificial sequence
  SiRNA target sequence
actggacttcgtttgtttact

SEQ ID NO: 55002 - DNA, 21 bp, Artificial sequence
  SiRNA target sequence
ctggacttcgtttgtttactt

SEQ ID NO: 55003 - DNA, 21 bp, Artificial sequence
  SiRNA target sequence
tggacttcgtttgtttacttt

SEQ ID NO: 55004 - DNA, 21 bp, Artificial sequence
  SiRNA target sequence
ggacttcgtttgtttacttta

SEQ ID NO: 55005 - DNA, 21 bp, Artificial sequence
  SiRNA target sequence
gacttcgtttgtttactttaa

SEQ ID NO: 55006 - DNA, 21 bp, Artificial sequence
  SiRNA target sequence
acttcgtttgtttactttaag

SEQ ID NO: 55007 - DNA, 21 bp, Artificial sequence
  SiRNA target sequence
cttcgtttgtttactttaaga

SEQ ID NO: 55008 - DNA, 21 bp, Artificial sequence
  SiRNA target sequence
ttcgtttgtttactttaagag

SEQ ID NO: 55009 - DNA, 21 bp, Artificial sequence
  SiRNA target sequence
tcgtttgtttactttaagaga

SEQ ID NO: 55010 - DNA, 21 bp, Artificial sequence
  SiRNA target sequence
cgtttgtttactttaagagac

SEQ ID NO: 55011 - DNA, 21 bp, Artificial sequence
  SiRNA target sequence
gtttgtttactttaagagact

SEQ ID NO: 55012 - DNA, 21 bp, Artificial sequence
  SiRNA target sequence
tttgtttactttaagagactc

SEQ ID NO: 55013 - DNA, 21 bp, Artificial sequence
  SiRNA target sequence
ttgtttactttaagagactcg

SEQ ID NO: 55014 - DNA, 21 bp, Artificial sequence
  SiRNA target sequence
tgtttactttaagagactcgt

SEQ ID NO: 55015 - DNA, 21 bp, Artificial sequence
  SiRNA target sequence
gtttactttaagagactcgtt

SEQ ID NO: 55016 - DNA, 21 bp, Artificial sequence
  SiRNA target sequence
tttactttaagagactcgttt

SEQ ID NO: 55017 - DNA, 21 bp, Artificial sequence
  SiRNA target sequence
ttactttaagagactcgtttt

SEQ ID NO: 55018 - DNA, 21 bp, Artificial sequence
  SiRNA target sequence
tactttaagagactcgttttt

SEQ ID NO: 55019 - DNA, 21 bp, Artificial sequence
  SiRNA target sequence
actttaagagactcgtttttt

SEQ ID NO: 55020 - DNA, 21 bp, Artificial sequence
  SiRNA target sequence
ctttaagagactcgttttttg

SEQ ID NO: 55021 - DNA, 21 bp, Artificial sequence
  SiRNA target sequence
tttaagagactcgttttttga

SEQ ID NO: 55022 - DNA, 21 bp, Artificial sequence
  SiRNA target sequence
ttaagagactcgttttttgat

SEQ ID NO: 55023 - DNA, 21 bp, Artificial sequence
  SiRNA target sequence
taagagactcgttttttgata

SEQ ID NO: 55024 - DNA, 21 bp, Artificial sequence
  SiRNA target sequence
aagagactcgttttttgataa

SEQ ID NO: 55025 - DNA, 21 bp, Artificial sequence
  SiRNA target sequence
agagactcgttttttgataaa

SEQ ID NO: 55026 - DNA, 21 bp, Artificial sequence
  SiRNA target sequence
gagactcgttttttgataaac

SEQ ID NO: 55027 - DNA, 21 bp, Artificial sequence
  SiRNA target sequence
agactcgttttttgataaacg

SEQ ID NO: 55028 - DNA, 21 bp, Artificial sequence
  SiRNA target sequence
gactcgttttttgataaacga

SEQ ID NO: 55029 - DNA, 21 bp, Artificial sequence
  SiRNA target sequence
actcgttttttgataaacgag

SEQ ID NO: 55030 - DNA, 21 bp, Artificial sequence
  SiRNA target sequence
ctcgttttttgataaacgaga

SEQ ID NO: 55031 - DNA, 21 bp, Artificial sequence
  SiRNA target sequence
tcgttttttgataaacgagaa

SEQ ID NO: 55032 - DNA, 21 bp, Artificial sequence
  SiRNA target sequence
cgttttttgataaacgagaaa

SEQ ID NO: 55033 - DNA, 21 bp, Artificial sequence
  SiRNA target sequence
gttttttgataaacgagaaac

SEQ ID NO: 55034 - DNA, 21 bp, Artificial sequence
  SiRNA target sequence
ttttttgataaacgagaaacg

SEQ ID NO: 55035 - DNA, 21 bp, Artificial sequence
  SiRNA target sequence
tttttgataaacgagaaacga

SEQ ID NO: 55036 - DNA, 21 bp, Artificial sequence
  SiRNA target sequence
ttttgataaacgagaaacgat

SEQ ID NO: 55037 - DNA, 21 bp, Artificial sequence
  SiRNA target sequence
tttgataaacgagaaacgatg

SEQ ID NO: 55038 - DNA, 21 bp, Artificial sequence
  SiRNA target sequence
ttgataaacgagaaacgatgc

SEQ ID NO: 55039 - DNA, 21 bp, Artificial sequence
  SiRNA target sequence
tgataaacgagaaacgatgct

SEQ ID NO: 55040 - DNA, 21 bp, Artificial sequence
  SiRNA target sequence
gataaacgagaaacgatgcta

SEQ ID NO: 55041 - DNA, 21 bp, Artificial sequence
  SiRNA target sequence
ataaacgagaaacgatgctat

SEQ ID NO: 55042 - DNA, 21 bp, Artificial sequence
  SiRNA target sequence
taaacgagaaacgatgctatt

SEQ ID NO: 55043 - DNA, 21 bp, Artificial sequence
  SiRNA target sequence
aaacgagaaacgatgctatta

SEQ ID NO: 55044 - DNA, 21 bp, Artificial sequence
  SiRNA target sequence
aacgagaaacgatgctattac

SEQ ID NO: 55045 - DNA, 21 bp, Artificial sequence
  SiRNA target sequence
acgagaaacgatgctattact

SEQ ID NO: 55046 - DNA, 21 bp, Artificial sequence
  SiRNA target sequence
cgagaaacgatgctattactt

SEQ ID NO: 55047 - DNA, 21 bp, Artificial sequence
  SiRNA target sequence
gagaaacgatgctattacttt

SEQ ID NO: 55048 - DNA, 21 bp, Artificial sequence
  SiRNA target sequence
agaaacgatgctattacttta

SEQ ID NO: 55049 - DNA, 21 bp, Artificial sequence
  SiRNA target sequence
gaaacgatgctattactttat

SEQ ID NO: 55050 - DNA, 21 bp, Artificial sequence
  SiRNA target sequence
aaacgatgctattactttatt

SEQ ID NO: 55051 - DNA, 21 bp, Artificial sequence
  SiRNA target sequence
aacgatgctattactttattc

SEQ ID NO: 55052 - DNA, 21 bp, Artificial sequence
  SiRNA target sequence
acgatgctattactttattca

SEQ ID NO: 55053 - DNA, 21 bp, Artificial sequence
  SiRNA target sequence
cgatgctattactttattcag

SEQ ID NO: 55054 - DNA, 21 bp, Artificial sequence
  SiRNA target sequence
gatgctattactttattcagt

SEQ ID NO: 55055 - DNA, 21 bp, Artificial sequence
  SiRNA target sequence
atgctattactttattcagta

SEQ ID NO: 55056 - DNA, 21 bp, Artificial sequence
  SiRNA target sequence
tgctattactttattcagtag

SEQ ID NO: 55057 - DNA, 21 bp, Artificial sequence
  SiRNA target sequence
gctattactttattcagtaga

SEQ ID NO: 55058 - DNA, 21 bp, Artificial sequence
  SiRNA target sequence
ctattactttattcagtagat

SEQ ID NO: 55059 - DNA, 21 bp, Artificial sequence
  SiRNA target sequence
tattactttattcagtagatc

SEQ ID NO: 55060 - DNA, 21 bp, Artificial sequence
  SiRNA target sequence
attactttattcagtagatct

SEQ ID NO: 55061 - DNA, 21 bp, Artificial sequence
  SiRNA target sequence
ttactttattcagtagatctt

SEQ ID NO: 55062 - DNA, 21 bp, Artificial sequence
  SiRNA target sequence
tactttattcagtagatcttg

SEQ ID NO: 55063 - DNA, 21 bp, Artificial sequence
  SiRNA target sequence
actttattcagtagatcttga

SEQ ID NO: 55064 - DNA, 21 bp, Artificial sequence
  SiRNA target sequence
ctttattcagtagatcttgag

SEQ ID NO: 55065 - DNA, 21 bp, Artificial sequence
  SiRNA target sequence
tttattcagtagatcttgaga

SEQ ID NO: 55066 - DNA, 21 bp, Artificial sequence
  SiRNA target sequence
ttattcagtagatcttgagaa

SEQ ID NO: 55067 - DNA, 21 bp, Artificial sequence
  SiRNA target sequence
tattcagtagatcttgagaaa

SEQ ID NO: 55068 - DNA, 21 bp, Artificial sequence
  SiRNA target sequence
attcagtagatcttgagaaat

SEQ ID NO: 55069 - DNA, 21 bp, Artificial sequence
  SiRNA target sequence
ttcagtagatcttgagaaata

SEQ ID NO: 55070 - DNA, 21 bp, Artificial sequence
  SiRNA target sequence
tcagtagatcttgagaaatat

SEQ ID NO: 55071 - DNA, 21 bp, Artificial sequence
  SiRNA target sequence
cagtagatcttgagaaatatg

SEQ ID NO: 55072 - DNA, 21 bp, Artificial sequence
  SiRNA target sequence
agtagatcttgagaaatatga

SEQ ID NO: 55073 - DNA, 21 bp, Artificial sequence
  SiRNA target sequence
gtagatcttgagaaatatgaa

SEQ ID NO: 55074 - DNA, 21 bp, Artificial sequence
  SiRNA target sequence
tagatcttgagaaatatgaaa

SEQ ID NO: 55075 - DNA, 21 bp, Artificial sequence
  SiRNA target sequence
agatcttgagaaatatgaaaa

SEQ ID NO: 55076 - DNA, 21 bp, Artificial sequence
  SiRNA target sequence
gatcttgagaaatatgaaaat

SEQ ID NO: 55077 - DNA, 21 bp, Artificial sequence
  SiRNA target sequence
atcttgagaaatatgaaaatt

SEQ ID NO: 55078 - DNA, 21 bp, Artificial sequence
  SiRNA target sequence
tcttgagaaatatgaaaattt

SEQ ID NO: 55079 - DNA, 21 bp, Artificial sequence
  SiRNA target sequence
cttgagaaatatgaaaattta

SEQ ID NO: 55080 - DNA, 21 bp, Artificial sequence
  SiRNA target sequence
ttgagaaatatgaaaatttaa

SEQ ID NO: 55081 - DNA, 21 bp, Artificial sequence
  SiRNA target sequence
tgagaaatatgaaaatttaaa

SEQ ID NO: 55082 - DNA, 21 bp, Artificial sequence
  SiRNA target sequence
gagaaatatgaaaatttaaaa

SEQ ID NO: 55083 - DNA, 21 bp, Artificial sequence
  SiRNA target sequence
agaaatatgaaaatttaaaag

SEQ ID NO: 55084 - DNA, 21 bp, Artificial sequence
  SiRNA target sequence
gaaatatgaaaatttaaaaga

SEQ ID NO: 55085 - DNA, 21 bp, Artificial sequence
  SiRNA target sequence
aaatatgaaaatttaaaagaa

SEQ ID NO: 55086 - DNA, 21 bp, Artificial sequence
  SiRNA target sequence
aatatgaaaatttaaaagaag

SEQ ID NO: 55087 - DNA, 21 bp, Artificial sequence
  SiRNA target sequence
atatgaaaatttaaaagaagg

SEQ ID NO: 55088 - DNA, 21 bp, Artificial sequence
  SiRNA target sequence
tatgaaaatttaaaagaaggt

SEQ ID NO: 55089 - DNA, 21 bp, Artificial sequence
  SiRNA target sequence
atgaaaatttaaaagaaggtg

SEQ ID NO: 55090 - DNA, 21 bp, Artificial sequence
  SiRNA target sequence
tgaaaatttaaaagaaggtgg

SEQ ID NO: 55091 - DNA, 21 bp, Artificial sequence
  SiRNA target sequence
gaaaatttaaaagaaggtgga

SEQ ID NO: 55092 - DNA, 21 bp, Artificial sequence
  SiRNA target sequence
aaaatttaaaagaaggtggaa

SEQ ID NO: 55093 - DNA, 21 bp, Artificial sequence
  SiRNA target sequence
aaatttaaaagaaggtggaat

SEQ ID NO: 55094 - DNA, 21 bp, Artificial sequence
  SiRNA target sequence
aatttaaaagaaggtggaatt

SEQ ID NO: 55095 - DNA, 21 bp, Artificial sequence
  SiRNA target sequence
atttaaaagaaggtggaattt

SEQ ID NO: 55096 - DNA, 21 bp, Artificial sequence
  SiRNA target sequence
tttaaaagaaggtggaatttg

SEQ ID NO: 55097 - DNA, 21 bp, Artificial sequence
  SiRNA target sequence
ttaaaagaaggtggaatttgt

SEQ ID NO: 55098 - DNA, 21 bp, Artificial sequence
  SiRNA target sequence
taaaagaaggtggaatttgtg

SEQ ID NO: 55099 - DNA, 21 bp, Artificial sequence
  SiRNA target sequence
aaaagaaggtggaatttgtga

SEQ ID NO: 55100 - DNA, 21 bp, Artificial sequence
  SiRNA target sequence
aaagaaggtggaatttgtgaa

SEQ ID NO: 55101 - DNA, 21 bp, Artificial sequence
  SiRNA target sequence
aagaaggtggaatttgtgaat

SEQ ID NO: 55102 - DNA, 21 bp, Artificial sequence
  SiRNA target sequence
agaaggtggaatttgtgaatt

SEQ ID NO: 55103 - DNA, 21 bp, Artificial sequence
  SiRNA target sequence
gaaggtggaatttgtgaattt

SEQ ID NO: 55104 - DNA, 21 bp, Artificial sequence
  SiRNA target sequence
aaggtggaatttgtgaattta

SEQ ID NO: 55105 - DNA, 21 bp, Artificial sequence
  SiRNA target sequence
aggtggaatttgtgaatttat

SEQ ID NO: 55106 - DNA, 21 bp, Artificial sequence
  SiRNA target sequence
ggtggaatttgtgaatttatg

SEQ ID NO: 55107 - DNA, 21 bp, Artificial sequence
  SiRNA target sequence
gtggaatttgtgaatttatga

SEQ ID NO: 55108 - DNA, 21 bp, Artificial sequence
  SiRNA target sequence
tggaatttgtgaatttatgaa

SEQ ID NO: 55109 - DNA, 21 bp, Artificial sequence
  SiRNA target sequence
ggaatttgtgaatttatgaat

SEQ ID NO: 55110 - DNA, 21 bp, Artificial sequence
  SiRNA target sequence
  misc_feature (21)..(21): n is a, c, g, or t
gaatttgtgaatttatgaatn

SEQ ID NO: 55111 - DNA, 21 bp, Artificial sequence
  SiRNA target sequence
  misc_feature (20)..(20): n is a, c, g, or t
aatttgtgaatttatgaatng

SEQ ID NO: 55112 - DNA, 21 bp, Artificial sequence
  SiRNA target sequence
  misc_feature (19)..(19): n is a, c, g, or t
atttgtgaatttatgaatngt

SEQ ID NO: 55113 - DNA, 21 bp, Artificial sequence
  SiRNA target sequence
  misc_feature (18)..(18): n is a, c, g, or t
tttgtgaatttatgaatngtc

SEQ ID NO: 55114 - DNA, 21 bp, Artificial sequence
  SiRNA target sequence
  misc_feature (17)..(17): n is a, c, g, or t
ttgtgaatttatgaatngtcc

SEQ ID NO: 55115 - DNA, 21 bp, Artificial sequence
  SiRNA target sequence
  misc_feature (16)..(16): n is a, c, g, or t
tgtgaatttatgaatngtcca

SEQ ID NO: 55116 - DNA, 21 bp, Artificial sequence
  SiRNA target sequence
  misc_feature (15)..(15): n is a, c, g, or t
gtgaatttatgaatngtccag

SEQ ID NO: 55117 - DNA, 21 bp, Artificial sequence
  SiRNA target sequence
  misc_feature (14)..(14): n is a, c, g, or t
tgaatttatgaatngtccagc

SEQ ID NO: 55118 - DNA, 21 bp, Artificial sequence
  SiRNA target sequence
  misc_feature (13)..(13): n is a, c, g, or t
gaatttatgaatngtccagca

SEQ ID NO: 55119 - DNA, 21 bp, Artificial sequence
  SiRNA target sequence
  misc_feature (12)..(12): n is a, c, g, or t
aatttatgaatngtccagcaa

SEQ ID NO: 55120 - DNA, 21 bp, Artificial sequence
  SiRNA target sequence
  misc_feature (11)..(11): n is a, c, g, or t
atttatgaatngtccagcaat

SEQ ID NO: 55121 - DNA, 21 bp, Artificial sequence
  SiRNA target sequence
  misc_feature (10)..(10): n is a, c, g, or t
tttatgaatngtccagcaatt

SEQ ID NO: 55122 - DNA, 21 bp, Artificial sequence
  SiRNA target sequence
  misc_feature (9)..(9): n is a, c, g, or t
ttatgaatngtccagcaattt

SEQ ID NO: 55123 - DNA, 21 bp, Artificial sequence
  SiRNA target sequence
  misc_feature (8)..(8): n is a, c, g, or t
tatgaatngtccagcaatttc

SEQ ID NO: 55124 - DNA, 21 bp, Artificial sequence
  SiRNA target sequence
  misc_feature (7)..(7): n is a, c, g, or t
atgaatngtccagcaatttca

SEQ ID NO: 55125 - DNA, 21 bp, Artificial sequence
  SiRNA target sequence
  misc_feature (6)..(6): n is a, c, g, or t
tgaatngtccagcaatttcat

SEQ ID NO: 55126 - DNA, 21 bp, Artificial sequence
  SiRNA target sequence
  misc_feature (5)..(5): n is a, c, g, or t
gaatngtccagcaatttcata

SEQ ID NO: 55127 - DNA, 21 bp, Artificial sequence
  SiRNA target sequence
  misc_feature (4)..(4): n is a, c, g, or t
aatngtccagcaatttcatat

SEQ ID NO: 55128 - DNA, 21 bp, Artificial sequence
  SiRNA target sequence
  misc_feature (3)..(3): n is a, c, g, or t
atngtccagcaatttcatatc

SEQ ID NO: 55129 - DNA, 21 bp, Artificial sequence
  SiRNA target sequence
  misc_feature (2)..(2): n is a, c, g, or t
tngtccagcaatttcatatcc

SEQ ID NO: 55130 - DNA, 21 bp, Artificial sequence
  SiRNA target sequence
  misc_feature (1)..(1): n is a, c, g, or t
ngtccagcaatttcatatcca

SEQ ID NO: 55131 - DNA, 21 bp, Artificial sequence
  SiRNA target sequence
gtccagcaatttcatatccaa

SEQ ID NO: 55132 - DNA, 21 bp, Artificial sequence
  SiRNA target sequence
tccagcaatttcatatccaaa

SEQ ID NO: 55133 - DNA, 21 bp, Artificial sequence
  SiRNA target sequence
ccagcaatttcatatccaaag

SEQ ID NO: 55134 - DNA, 21 bp, Artificial sequence
  SiRNA target sequence
  misc_feature (21)..(21): n is a, c, g, or t
cagcaatttcatatccaaagn

SEQ ID NO: 55135 - DNA, 21 bp, Artificial sequence
  SiRNA target sequence
  misc_feature (20)..(20): n is a, c, g, or t
agcaatttcatatccaaagna

SEQ ID NO: 55136 - DNA, 21 bp, Artificial sequence
  SiRNA target sequence
  misc_feature (19)..(19): n is a, c, g, or t
gcaatttcatatccaaagnaa

SEQ ID NO: 55137 - DNA, 21 bp, Artificial sequence
  SiRNA target sequence
  misc_feature (18)..(18): n is a, c, g, or t
caatttcatatccaaagnaat

SEQ ID NO: 55138 - DNA, 21 bp, Artificial sequence
  SiRNA target sequence
  misc_feature (17)..(17): n is a, c, g, or t
aatttcatatccaaagnaata

SEQ ID NO: 55139 - DNA, 21 bp, Artificial sequence
  SiRNA target sequence
  misc_feature (16)..(16): n is a, c, g, or t
atttcatatccaaagnaatat

SEQ ID NO: 55140 - DNA, 21 bp, Artificial sequence
  SiRNA target sequence
  misc_feature (15)..(15): n is a, c, g, or t
tttcatatccaaagnaatatt

SEQ ID NO: 55141 - DNA, 21 bp, Artificial sequence
  SiRNA target sequence
  misc_feature (14)..(14): n is a, c, g, or t
ttcatatccaaagnaatattg

SEQ ID NO: 55142 - DNA, 21 bp, Artificial sequence
  SiRNA target sequence
  misc_feature (13)..(13): n is a, c, g, or t
tcatatccaaagnaatattgg

SEQ ID NO: 55143 - DNA, 21 bp, Artificial sequence
  SiRNA target sequence
  misc_feature (12)..(12): n is a, c, g, or t
catatccaaagnaatattgga

SEQ ID NO: 55144 - DNA, 21 bp, Artificial sequence
  SiRNA target sequence
  misc_feature (11)..(11): n is a, c, g, or t
atatccaaagnaatattggac

SEQ ID NO: 55145 - DNA, 21 bp, Artificial sequence
  SiRNA target sequence
  misc_feature (10)..(10): n is a, c, g, or t
tatccaaagnaatattggaca

SEQ ID NO: 55146 - DNA, 21 bp, Artificial sequence
  SiRNA target sequence
  misc_feature (9)..(9): n is a, c, g, or t
atccaaagnaatattggacag

SEQ ID NO: 55147 - DNA, 21 bp, Artificial sequence
  SiRNA target sequence
  misc_feature (8)..(8): n is a, c, g, or t
tccaaagnaatattggacagg

SEQ ID NO: 55148 - DNA, 21 bp, Artificial sequence
  SiRNA target sequence
  misc_feature (7)..(7): n is a, c, g, or t
ccaaagnaatattggacagga

SEQ ID NO: 55149 - DNA, 21 bp, Artificial sequence
  SiRNA target sequence
  misc_feature (6)..(6): n is a, c, g, or t
caaagnaatattggacaggaa

SEQ ID NO: 55150 - DNA, 21 bp, Artificial sequence
  SiRNA target sequence
  misc_feature (5)..(5): n is a, c, g, or t
aaagnaatattggacaggaaa

SEQ ID NO: 55151 - DNA, 21 bp, Artificial sequence
  SiRNA target sequence
  misc_feature (4)..(4): n is a, c, g, or t
aagnaatattggacaggaaaa

SEQ ID NO: 55152 - DNA, 21 bp, Artificial sequence
  SiRNA target sequence
  misc_feature (3)..(3): n is a, c, g, or t
agnaatattggacaggaaaac

SEQ ID NO: 55153 - DNA, 21 bp, Artificial sequence
  SiRNA target sequence
  misc_feature (2)..(2): n is a, c, g, or t
gnaatattggacaggaaaaca

SEQ ID NO: 55154 - DNA, 21 bp, Artificial sequence
  SiRNA target sequence
  misc_feature (1)..(1): n is a, c, g, or t
naatattggacaggaaaacaa

SEQ ID NO: 55155 - DNA, 21 bp, Artificial sequence
  SiRNA target sequence
aatattggacaggaaaacaaa

SEQ ID NO: 55156 - DNA, 21 bp, Artificial sequence
  SiRNA target sequence
atattggacaggaaaacaaat

SEQ ID NO: 55157 - DNA, 21 bp, Artificial sequence
  SiRNA target sequence
tattggacaggaaaacaaatt

SEQ ID NO: 55158 - DNA, 21 bp, Artificial sequence
  SiRNA target sequence
attggacaggaaaacaaatta

SEQ ID NO: 55159 - DNA, 21 bp, Artificial sequence
  SiRNA target sequence
ttggacaggaaaacaaattat

SEQ ID NO: 55160 - DNA, 21 bp, Artificial sequence
  SiRNA target sequence
tggacaggaaaacaaattatc

SEQ ID NO: 55161 - DNA, 21 bp, Artificial sequence
  SiRNA target sequence
ggacaggaaaacaaattatca

SEQ ID NO: 55162 - DNA, 21 bp, Artificial sequence
  SiRNA target sequence
gacaggaaaacaaattatcag

SEQ ID NO: 55163 - DNA, 21 bp, Artificial sequence
  SiRNA target sequence
acaggaaaacaaattatcagt

SEQ ID NO: 55164 - DNA, 21 bp, Artificial sequence
  SiRNA target sequence
caggaaaacaaattatcagtt

SEQ ID NO: 55165 - DNA, 21 bp, Artificial sequence
  SiRNA target sequence
aggaaaacaaattatcagttt

SEQ ID NO: 55166 - DNA, 21 bp, Artificial sequence
  SiRNA target sequence
ggaaaacaaattatcagtttt

SEQ ID NO: 55167 - DNA, 21 bp, Artificial sequence
  SiRNA target sequence
gaaaacaaattatcagtttta

SEQ ID NO: 55168 - DNA, 21 bp, Artificial sequence
  SiRNA target sequence
aaaacaaattatcagttttat

SEQ ID NO: 55169 - DNA, 21 bp, Artificial sequence
  SiRNA target sequence
aaacaaattatcagttttatt

SEQ ID NO: 55170 - DNA, 21 bp, Artificial sequence
  SiRNA target sequence
aacaaattatcagttttattt

SEQ ID NO: 55171 - DNA, 21 bp, Artificial sequence
  SiRNA target sequence
acaaattatcagttttatttt

SEQ ID NO: 55172 - DNA, 21 bp, Artificial sequence
  SiRNA target sequence
caaattatcagttttatttta

SEQ ID NO: 55173 - DNA, 21 bp, Artificial sequence
  SiRNA target sequence
aaattatcagttttattttac

SEQ ID NO: 55174 - DNA, 21 bp, Artificial sequence
  SiRNA target sequence
aattatcagttttattttacc

SEQ ID NO: 55175 - DNA, 21 bp, Artificial sequence
  SiRNA target sequence
attatcagttttattttacct

SEQ ID NO: 55176 - DNA, 21 bp, Artificial sequence
  SiRNA target sequence
ttatcagttttattttacctg

SEQ ID NO: 55177 - DNA, 21 bp, Artificial sequence
  SiRNA target sequence
tatcagttttattttacctga

SEQ ID NO: 55178 - DNA, 21 bp, Artificial sequence
  SiRNA target sequence
atcagttttattttacctgat

SEQ ID NO: 55179 - DNA, 21 bp, Artificial sequence
  SiRNA target sequence
tcagttttattttacctgata

SEQ ID NO: 55180 - DNA, 21 bp, Artificial sequence
  SiRNA target sequence
cagttttattttacctgatat

SEQ ID NO: 55181 - DNA, 21 bp, Artificial sequence
  SiRNA target sequence
agttttattttacctgatata

SEQ ID NO: 55182 - DNA, 21 bp, Artificial sequence
  SiRNA target sequence
gttttattttacctgatataa

SEQ ID NO: 55183 - DNA, 21 bp, Artificial sequence
  SiRNA target sequence
ttttattttacctgatataat

SEQ ID NO: 55184 - DNA, 21 bp, Artificial sequence
  SiRNA target sequence
tttattttacctgatataatt

SEQ ID NO: 55185 - DNA, 21 bp, Artificial sequence
  SiRNA target sequence
ttattttacctgatataattt

SEQ ID NO: 55186 - DNA, 21 bp, Artificial sequence
  SiRNA target sequence
tattttacctgatataatttt

SEQ ID NO: 55187 - DNA, 21 bp, Artificial sequence
  SiRNA target sequence
attttacctgatataattttt

SEQ ID NO: 55188 - DNA, 21 bp, Artificial sequence
  SiRNA target sequence
ttttacctgatataattttta

SEQ ID NO: 55189 - DNA, 21 bp, Artificial sequence
  SiRNA target sequence
tttacctgatataatttttaa

SEQ ID NO: 55190 - DNA, 21 bp, Artificial sequence
  SiRNA target sequence
ttacctgatataatttttaat

SEQ ID NO: 55191 - DNA, 21 bp, Artificial sequence
  SiRNA target sequence
tacctgatataatttttaatg

SEQ ID NO: 55192 - DNA, 21 bp, Artificial sequence
  SiRNA target sequence
acctgatataatttttaatgg

SEQ ID NO: 55193 - DNA, 21 bp, Artificial sequence
  SiRNA target sequence
cctgatataatttttaatgga

SEQ ID NO: 55194 - DNA, 21 bp, Artificial sequence
  SiRNA target sequence
ctgatataatttttaatggaa

SEQ ID NO: 55195 - DNA, 21 bp, Artificial sequence
  SiRNA target sequence
tgatataatttttaatggaaa

SEQ ID NO: 55196 - DNA, 21 bp, Artificial sequence
  SiRNA target sequence
gatataatttttaatggaaat

SEQ ID NO: 55197 - DNA, 21 bp, Artificial sequence
  SiRNA target sequence
atataatttttaatggaaatt

SEQ ID NO: 55198 - DNA, 21 bp, Artificial sequence
  SiRNA target sequence
tataatttttaatggaaattc

SEQ ID NO: 55199 - DNA, 21 bp, Artificial sequence
  SiRNA target sequence
ataatttttaatggaaattca

SEQ ID NO: 55200 - DNA, 21 bp, Artificial sequence
  SiRNA target sequence
taatttttaatggaaattcaa

SEQ ID NO: 55201 - DNA, 21 bp, Artificial sequence
  SiRNA target sequence
aatttttaatggaaattcaaa

SEQ ID NO: 55202 - DNA, 21 bp, Artificial sequence
  SiRNA target sequence
atttttaatggaaattcaaat

SEQ ID NO: 55203 - DNA, 21 bp, Artificial sequence
  SiRNA target sequence
tttttaatggaaattcaaatg

SEQ ID NO: 55204 - DNA, 21 bp, Artificial sequence
  SiRNA target sequence
ttttaatggaaattcaaatga

SEQ ID NO: 55205 - DNA, 21 bp, Artificial sequence
  SiRNA target sequence
tttaatggaaattcaaatgaa

SEQ ID NO: 55206 - DNA, 21 bp, Artificial sequence
  SiRNA target sequence
ttaatggaaattcaaatgaat

SEQ ID NO: 55207 - DNA, 21 bp, Artificial sequence
  SiRNA target sequence
taatggaaattcaaatgaatt

SEQ ID NO: 55208 - DNA, 21 bp, Artificial sequence
  SiRNA target sequence
aatggaaattcaaatgaattt

SEQ ID NO: 55209 - DNA, 21 bp, Artificial sequence
  SiRNA target sequence
atggaaattcaaatgaatttg

SEQ ID NO: 55210 - DNA, 21 bp, Artificial sequence
  SiRNA target sequence
tggaaattcaaatgaatttga

SEQ ID NO: 55211 - DNA, 21 bp, Artificial sequence
  SiRNA target sequence
ggaaattcaaatgaatttgat

SEQ ID NO: 55212 - DNA, 21 bp, Artificial sequence
  SiRNA target sequence
gaaattcaaatgaatttgatg

SEQ ID NO: 55213 - DNA, 21 bp, Artificial sequence
  SiRNA target sequence
aaattcaaatgaatttgatga

SEQ ID NO: 55214 - DNA, 21 bp, Artificial sequence
  SiRNA target sequence
  misc_feature (21)..(21): n is a, c, g, or t
aattcaaatgaatttgatgan

SEQ ID NO: 55215 - DNA, 21 bp, Artificial sequence
  SiRNA target sequence
  misc_feature (20)..(20): n is a, c, g, or t
attcaaatgaatttgatgang

SEQ ID NO: 55216 - DNA, 21 bp, Artificial sequence
  SiRNA target sequence
  misc_feature (19)..(19): n is a, c, g, or t
ttcaaatgaatttgatganga

SEQ ID NO: 55217 - DNA, 21 bp, Artificial sequence
  SiRNA target sequence
  misc_feature (18)..(18): n is a, c, g, or t
tcaaatgaatttgatgangag

SEQ ID NO: 55218 - DNA, 21 bp, Artificial sequence
  SiRNA target sequence
  misc_feature (17)..(17): n is a, c, g, or t
caaatgaatttgatgangagg

SEQ ID NO: 55219 - DNA, 21 bp, Artificial sequence
  SiRNA target sequence
  misc_feature (16)..(16): n is a, c, g, or t
aaatgaatttgatgangagga

SEQ ID NO: 55220 - DNA, 21 bp, Artificial sequence
  SiRNA target sequence
  misc_feature (15)..(15): n is a, c, g, or t
aatgaatttgatgangaggat

SEQ ID NO: 55221 - DNA, 21 bp, Artificial sequence
  SiRNA target sequence
  misc_feature (14)..(14): n is a, c, g, or t
atgaatttgatgangaggatt

SEQ ID NO: 55222 - DNA, 21 bp, Artificial sequence
  SiRNA target sequence
  misc_feature (13)..(13): n is a, c, g, or t
tgaatttgatgangaggattt

SEQ ID NO: 55223 - DNA, 21 bp, Artificial sequence
  SiRNA target sequence
  misc_feature (12)..(12): n is a, c, g, or t
gaatttgatgangaggattta

SEQ ID NO: 55224 - DNA, 21 bp, Artificial sequence
  SiRNA target sequence
  misc_feature (11)..(11): n is a, c, g, or t
aatttgatgangaggatttag

SEQ ID NO: 55225 - DNA, 21 bp, Artificial sequence
  SiRNA target sequence
  misc_feature (10)..(10): n is a, c, g, or t
atttgatgangaggatttaga

SEQ ID NO: 55226 - DNA, 21 bp, Artificial sequence
  SiRNA target sequence
  misc_feature (9)..(9): n is a, c, g, or t
tttgatgangaggatttagaa

SEQ ID NO: 55227 - DNA, 21 bp, Artificial sequence
  SiRNA target sequence
  misc_feature (8)..(8): n is a, c, g, or t
ttgatgangaggatttagaaa

SEQ ID NO: 55228 - DNA, 21 bp, Artificial sequence
  SiRNA target sequence
  misc_feature (7)..(7): n is a, c, g, or t
tgatgangaggatttagaaaa

SEQ ID NO: 55229 - DNA, 21 bp, Artificial sequence
  SiRNA target sequence
  misc_feature (6)..(6): n is a, c, g, or t
gatgangaggatttagaaaat

SEQ ID NO: 55230 - DNA, 21 bp, Artificial sequence
  SiRNA target sequence
  misc_feature (5)..(5): n is a, c, g, or t
atgangaggatttagaaaatg

SEQ ID NO: 55231 - DNA, 21 bp, Artificial sequence
  SiRNA target sequence
  misc_feature (4)..(4): n is a, c, g, or t
tgangaggatttagaaaatgt

SEQ ID NO: 55232 - DNA, 21 bp, Artificial sequence
  SiRNA target sequence
  misc_feature (3)..(3): n is a, c, g, or t
gangaggatttagaaaatgtt

SEQ ID NO: 55233 - DNA, 21 bp, Artificial sequence
  SiRNA target sequence
  misc_feature (2)..(2): n is a, c, g, or t
angaggatttagaaaatgtta

SEQ ID NO: 55234 - DNA, 21 bp, Artificial sequence
  SiRNA target sequence
  misc_feature (1)..(1): n is a, c, g, or t
ngaggatttagaaaatgttaa

SEQ ID NO: 55235 - DNA, 21 bp, Artificial sequence
  SiRNA target sequence
gaggatttagaaaatgttaaa

SEQ ID NO: 55236 - DNA, 21 bp, Artificial sequence
  SiRNA target sequence
aggatttagaaaatgttaaag

SEQ ID NO: 55237 - DNA, 21 bp, Artificial sequence
  SiRNA target sequence
ggatttagaaaatgttaaaga

SEQ ID NO: 55238 - DNA, 21 bp, Artificial sequence
  SiRNA target sequence
gatttagaaaatgttaaagat

SEQ ID NO: 55239 - DNA, 21 bp, Artificial sequence
  SiRNA target sequence
atttagaaaatgttaaagatt

SEQ ID NO: 55240 - DNA, 21 bp, Artificial sequence
  SiRNA target sequence
tttagaaaatgttaaagattt

SEQ ID NO: 55241 - DNA, 21 bp, Artificial sequence
  SiRNA target sequence
ttagaaaatgttaaagattta

SEQ ID NO: 55242 - DNA, 21 bp, Artificial sequence
  SiRNA target sequence
tagaaaatgttaaagatttaa

SEQ ID NO: 55243 - DNA, 21 bp, Artificial sequence
  SiRNA target sequence
agaaaatgttaaagatttaaa

SEQ ID NO: 55244 - DNA, 21 bp, Artificial sequence
  SiRNA target sequence
gaaaatgttaaagatttaaaa

SEQ ID NO: 55245 - DNA, 21 bp, Artificial sequence
  SiRNA target sequence
aaaatgttaaagatttaaaaa

SEQ ID NO: 55246 - DNA, 21 bp, Artificial sequence
  SiRNA target sequence
aaatgttaaagatttaaaaat

SEQ ID NO: 55247 - DNA, 21 bp, Artificial sequence
  SiRNA target sequence
aatgttaaagatttaaaaatt

SEQ ID NO: 55248 - DNA, 21 bp, Artificial sequence
  SiRNA target sequence
atgttaaagatttaaaaattt

SEQ ID NO: 55249 - DNA, 21 bp, Artificial sequence
  SiRNA target sequence
tgttaaagatttaaaaattta

SEQ ID NO: 55250 - DNA, 21 bp, Artificial sequence
  SiRNA target sequence
gttaaagatttaaaaatttat

SEQ ID NO: 55251 - DNA, 21 bp, Artificial sequence
  SiRNA target sequence
ttaaagatttaaaaatttatt

SEQ ID NO: 55252 - DNA, 21 bp, Artificial sequence
  SiRNA target sequence
taaagatttaaaaatttattt

SEQ ID NO: 55253 - DNA, 21 bp, Artificial sequence
  SiRNA target sequence
aaagatttaaaaatttattta

SEQ ID NO: 55254 - DNA, 21 bp, Artificial sequence
  SiRNA target sequence
aagatttaaaaatttatttaa

SEQ ID NO: 55255 - DNA, 21 bp, Artificial sequence
  SiRNA target sequence
agatttaaaaatttatttaag

SEQ ID NO: 55256 - DNA, 21 bp, Artificial sequence
  SiRNA target sequence
gatttaaaaatttatttaaga

SEQ ID NO: 55257 - DNA, 21 bp, Artificial sequence
  SiRNA target sequence
atttaaaaatttatttaagaa

SEQ ID NO: 55258 - DNA, 21 bp, Artificial sequence
  SiRNA target sequence
tttaaaaatttatttaagaaa

SEQ ID NO: 55259 - DNA, 21 bp, Artificial sequence
  SiRNA target sequence
ttaaaaatttatttaagaaac

SEQ ID NO: 55260 - DNA, 21 bp, Artificial sequence
  SiRNA target sequence
taaaaatttatttaagaaacg

SEQ ID NO: 55261 - DNA, 21 bp, Artificial sequence
  SiRNA target sequence
aaaaatttatttaagaaacgg

SEQ ID NO: 55262 - DNA, 21 bp, Artificial sequence
  SiRNA target sequence
aaaatttatttaagaaacgga

SEQ ID NO: 55263 - DNA, 21 bp, Artificial sequence
  SiRNA target sequence
aaatttatttaagaaacggag

SEQ ID NO: 55264 - DNA, 21 bp, Artificial sequence
  SiRNA target sequence
aatttatttaagaaacggaga

SEQ ID NO: 55265 - DNA, 21 bp, Artificial sequence
  SiRNA target sequence
atttatttaagaaacggagaa

SEQ ID NO: 55266 - DNA, 21 bp, Artificial sequence
  SiRNA target sequence
tttatttaagaaacggagaac

SEQ ID NO: 55267 - DNA, 21 bp, Artificial sequence
  SiRNA target sequence
ttatttaagaaacggagaact

SEQ ID NO: 55268 - DNA, 21 bp, Artificial sequence
  SiRNA target sequence
tatttaagaaacggagaactt

SEQ ID NO: 55269 - DNA, 21 bp, Artificial sequence
  SiRNA target sequence
atttaagaaacggagaacttt

SEQ ID NO: 55270 - DNA, 21 bp, Artificial sequence
  SiRNA target sequence
tttaagaaacggagaactttt

SEQ ID NO: 55271 - DNA, 21 bp, Artificial sequence
  SiRNA target sequence
ttaagaaacggagaactttta

SEQ ID NO: 55272 - DNA, 21 bp, Artificial sequence
  SiRNA target sequence
taagaaacggagaacttttat

SEQ ID NO: 55273 - DNA, 21 bp, Artificial sequence
  SiRNA target sequence
aagaaacggagaacttttatc

SEQ ID NO: 55274 - DNA, 21 bp, Artificial sequence
  SiRNA target sequence
agaaacggagaacttttatct

SEQ ID NO: 55275 - DNA, 21 bp, Artificial sequence
  SiRNA target sequence
gaaacggagaacttttatctg

SEQ ID NO: 55276 - DNA, 21 bp, Artificial sequence
  SiRNA target sequence
aaacggagaacttttatctgg

SEQ ID NO: 55277 - DNA, 21 bp, Artificial sequence
  SiRNA target sequence
aacggagaacttttatctgga

SEQ ID NO: 55278 - DNA, 21 bp, Artificial sequence
  SiRNA target sequence
acggagaacttttatctggaa

SEQ ID NO: 55279 - DNA, 21 bp, Artificial sequence
  SiRNA target sequence
cggagaacttttatctggaat

SEQ ID NO: 55280 - DNA, 21 bp, Artificial sequence
  SiRNA target sequence
ggagaacttttatctggaatt

SEQ ID NO: 55281 - DNA, 21 bp, Artificial sequence
  SiRNA target sequence
gagaacttttatctggaattt

SEQ ID NO: 55282 - DNA, 21 bp, Artificial sequence
  SiRNA target sequence
agaacttttatctggaatttt

SEQ ID NO: 55283 - DNA, 21 bp, Artificial sequence
  SiRNA target sequence
gaacttttatctggaatttta

SEQ ID NO: 55284 - DNA, 21 bp, Artificial sequence
  SiRNA target sequence
aacttttatctggaattttag

SEQ ID NO: 55285 - DNA, 21 bp, Artificial sequence
  SiRNA target sequence
acttttatctggaattttaga

SEQ ID NO: 55286 - DNA, 21 bp, Artificial sequence
  SiRNA target sequence
cttttatctggaattttagac

SEQ ID NO: 55287 - DNA, 21 bp, Artificial sequence
  SiRNA target sequence
ttttatctggaattttagaca

SEQ ID NO: 55288 - DNA, 21 bp, Artificial sequence
  SiRNA target sequence
tttatctggaattttagacaa

SEQ ID NO: 55289 - DNA, 21 bp, Artificial sequence
  SiRNA target sequence
ttatctggaattttagacaaa

SEQ ID NO: 55290 - DNA, 21 bp, Artificial sequence
  SiRNA target sequence
tatctggaattttagacaaaa

SEQ ID NO: 55291 - DNA, 21 bp, Artificial sequence
  SiRNA target sequence
atctggaattttagacaaaaa

SEQ ID NO: 55292 - DNA, 21 bp, Artificial sequence
  SiRNA target sequence
tctggaattttagacaaaaaa

SEQ ID NO: 55293 - DNA, 21 bp, Artificial sequence
  SiRNA target sequence
ctggaattttagacaaaaaaa

SEQ ID NO: 55294 - DNA, 21 bp, Artificial sequence
  SiRNA target sequence
tggaattttagacaaaaaaac

SEQ ID NO: 55295 - DNA, 21 bp, Artificial sequence
  SiRNA target sequence
ggaattttagacaaaaaaact

SEQ ID NO: 55296 - DNA, 21 bp, Artificial sequence
  SiRNA target sequence
gaattttagacaaaaaaactg

SEQ ID NO: 55297 - DNA, 21 bp, Artificial sequence
  SiRNA target sequence
aattttagacaaaaaaactgt

SEQ ID NO: 55298 - DNA, 21 bp, Artificial sequence
  SiRNA target sequence
attttagacaaaaaaactgtc

SEQ ID NO: 55299 - DNA, 21 bp, Artificial sequence
  SiRNA target sequence
ttttagacaaaaaaactgtcg

SEQ ID NO: 55300 - DNA, 21 bp, Artificial sequence
  SiRNA target sequence
tttagacaaaaaaactgtcgg

SEQ ID NO: 55301 - DNA, 21 bp, Artificial sequence
  SiRNA target sequence
ttagacaaaaaaactgtcggt

SEQ ID NO: 55302 - DNA, 21 bp, Artificial sequence
  SiRNA target sequence
tagacaaaaaaactgtcggtg

SEQ ID NO: 55303 - DNA, 21 bp, Artificial sequence
  SiRNA target sequence
agacaaaaaaactgtcggtgc

SEQ ID NO: 55304 - DNA, 21 bp, Artificial sequence
  SiRNA target sequence
gacaaaaaaactgtcggtgct

SEQ ID NO: 55305 - DNA, 21 bp, Artificial sequence
  SiRNA target sequence
acaaaaaaactgtcggtgcta

SEQ ID NO: 55306 - DNA, 21 bp, Artificial sequence
  SiRNA target sequence
caaaaaaactgtcggtgctac

SEQ ID NO: 55307 - DNA, 21 bp, Artificial sequence
  SiRNA target sequence
aaaaaaactgtcggtgctaca

SEQ ID NO: 55308 - DNA, 21 bp, Artificial sequence
  SiRNA target sequence
aaaaaactgtcggtgctacac

SEQ ID NO: 55309 - DNA, 21 bp, Artificial sequence
  SiRNA target sequence
aaaaactgtcggtgctacaca

SEQ ID NO: 55310 - DNA, 21 bp, Artificial sequence
  SiRNA target sequence
aaaactgtcggtgctacacaa

SEQ ID NO: 55311 - DNA, 21 bp, Artificial sequence
  SiRNA target sequence
aaactgtcggtgctacacaag

SEQ ID NO: 55312 - DNA, 21 bp, Artificial sequence
  SiRNA target sequence
aactgtcggtgctacacaagg

SEQ ID NO: 55313 - DNA, 21 bp, Artificial sequence
  SiRNA target sequence
actgtcggtgctacacaaggt

SEQ ID NO: 55314 - DNA, 21 bp, Artificial sequence
  SiRNA target sequence
ctgtcggtgctacacaaggtg

SEQ ID NO: 55315 - DNA, 21 bp, Artificial sequence
  SiRNA target sequence
tgtcggtgctacacaaggtgg

SEQ ID NO: 55316 - DNA, 21 bp, Artificial sequence
  SiRNA target sequence
gtcggtgctacacaaggtggt

SEQ ID NO: 55317 - DNA, 21 bp, Artificial sequence
  SiRNA target sequence
tcggtgctacacaaggtggtt

SEQ ID NO: 55318 - DNA, 21 bp, Artificial sequence
  SiRNA target sequence
cggtgctacacaaggtggttt

SEQ ID NO: 55319 - DNA, 21 bp, Artificial sequence
  SiRNA target sequence
ggtgctacacaaggtggtttt

SEQ ID NO: 55320 - DNA, 21 bp, Artificial sequence
  SiRNA target sequence
gtgctacacaaggtggtttta

SEQ ID NO: 55321 - DNA, 21 bp, Artificial sequence
  SiRNA target sequence
tgctacacaaggtggttttat

SEQ ID NO: 55322 - DNA, 21 bp, Artificial sequence
  SiRNA target sequence
gctacacaaggtggttttatt

SEQ ID NO: 55323 - DNA, 21 bp, Artificial sequence
  SiRNA target sequence
ctacacaaggtggttttattc

SEQ ID NO: 55324 - DNA, 21 bp, Artificial sequence
  SiRNA target sequence
tacacaaggtggttttattca

SEQ ID NO: 55325 - DNA, 21 bp, Artificial sequence
  SiRNA target sequence
acacaaggtggttttattcat

SEQ ID NO: 55326 - DNA, 21 bp, Artificial sequence
  SiRNA target sequence
cacaaggtggttttattcata

SEQ ID NO: 55327 - DNA, 21 bp, Artificial sequence
  SiRNA target sequence
acaaggtggttttattcatat

SEQ ID NO: 55328 - DNA, 21 bp, Artificial sequence
  SiRNA target sequence
caaggtggttttattcatata

SEQ ID NO: 55329 - DNA, 21 bp, Artificial sequence
  SiRNA target sequence
aaggtggttttattcatataa

SEQ ID NO: 55330 - DNA, 21 bp, Artificial sequence
  SiRNA target sequence
aggtggttttattcatataat

SEQ ID NO: 55331 - DNA, 21 bp, Artificial sequence
  SiRNA target sequence
ggtggttttattcatataatt

SEQ ID NO: 55332 - DNA, 21 bp, Artificial sequence
  SiRNA target sequence
gtggttttattcatataattg

SEQ ID NO: 55333 - DNA, 21 bp, Artificial sequence
  SiRNA target sequence
tggttttattcatataattgc

SEQ ID NO: 55334 - DNA, 21 bp, Artificial sequence
  SiRNA target sequence
ggttttattcatataattgca

SEQ ID NO: 55335 - DNA, 21 bp, Artificial sequence
  SiRNA target sequence
gttttattcatataattgcaa

SEQ ID NO: 55336 - DNA, 21 bp, Artificial sequence
  SiRNA target sequence
ttttattcatataattgcaaa

SEQ ID NO: 55337 - DNA, 21 bp, Artificial sequence
  SiRNA target sequence
tttattcatataattgcaaat

SEQ ID NO: 55338 - DNA, 21 bp, Artificial sequence
  SiRNA target sequence
ttattcatataattgcaaatg

SEQ ID NO: 55339 - DNA, 21 bp, Artificial sequence
  SiRNA target sequence
tattcatataattgcaaatga

SEQ ID NO: 55340 - DNA, 21 bp, Artificial sequence
  SiRNA target sequence
attcatataattgcaaatgat

SEQ ID NO: 55341 - DNA, 21 bp, Artificial sequence
  SiRNA target sequence
ttcatataattgcaaatgatt

SEQ ID NO: 55342 - DNA, 21 bp, Artificial sequence
  SiRNA target sequence
tcatataattgcaaatgattt

SEQ ID NO: 55343 - DNA, 21 bp, Artificial sequence
  SiRNA target sequence
catataattgcaaatgatttt

SEQ ID NO: 55344 - DNA, 21 bp, Artificial sequence
  SiRNA target sequence
atataattgcaaatgattttg

SEQ ID NO: 55345 - DNA, 21 bp, Artificial sequence
  SiRNA target sequence
tataattgcaaatgattttgg

SEQ ID NO: 55346 - DNA, 21 bp, Artificial sequence
  SiRNA target sequence
ataattgcaaatgattttgga

SEQ ID NO: 55347 - DNA, 21 bp, Artificial sequence
  SiRNA target sequence
taattgcaaatgattttggat

SEQ ID NO: 55348 - DNA, 21 bp, Artificial sequence
  SiRNA target sequence
aattgcaaatgattttggatc

SEQ ID NO: 55349 - DNA, 21 bp, Artificial sequence
  SiRNA target sequence
attgcaaatgattttggatct

SEQ ID NO: 55350 - DNA, 21 bp, Artificial sequence
  SiRNA target sequence
ttgcaaatgattttggatctg

SEQ ID NO: 55351 - DNA, 21 bp, Artificial sequence
  SiRNA target sequence
tgcaaatgattttggatctga

SEQ ID NO: 55352 - DNA, 21 bp, Artificial sequence
  SiRNA target sequence
gcaaatgattttggatctgaa

SEQ ID NO: 55353 - DNA, 21 bp, Artificial sequence
  SiRNA target sequence
caaatgattttggatctgaac

SEQ ID NO: 55354 - DNA, 21 bp, Artificial sequence
  SiRNA target sequence
aaatgattttggatctgaacg

SEQ ID NO: 55355 - DNA, 21 bp, Artificial sequence
  SiRNA target sequence
aatgattttggatctgaacgc

SEQ ID NO: 55356 - DNA, 21 bp, Artificial sequence
  SiRNA target sequence
atgattttggatctgaacgcg

SEQ ID NO: 55357 - DNA, 21 bp, Artificial sequence
  SiRNA target sequence
tgattttggatctgaacgcgt

SEQ ID NO: 55358 - DNA, 21 bp, Artificial sequence
  SiRNA target sequence
gattttggatctgaacgcgtc

SEQ ID NO: 55359 - DNA, 21 bp, Artificial sequence
  SiRNA target sequence
attttggatctgaacgcgtca

SEQ ID NO: 55360 - DNA, 21 bp, Artificial sequence
  SiRNA target sequence
ttttggatctgaacgcgtcac

SEQ ID NO: 55361 - DNA, 21 bp, Artificial sequence
  SiRNA target sequence
tttggatctgaacgcgtcact

SEQ ID NO: 55362 - DNA, 21 bp, Artificial sequence
  SiRNA target sequence
ttggatctgaacgcgtcactg

SEQ ID NO: 55363 - DNA, 21 bp, Artificial sequence
  SiRNA target sequence
tggatctgaacgcgtcactgc

SEQ ID NO: 55364 - DNA, 21 bp, Artificial sequence
  SiRNA target sequence
ggatctgaacgcgtcactgca

SEQ ID NO: 55365 - DNA, 21 bp, Artificial sequence
  SiRNA target sequence
gatctgaacgcgtcactgcat

SEQ ID NO: 55366 - DNA, 21 bp, Artificial sequence
  SiRNA target sequence
atctgaacgcgtcactgcatt

SEQ ID NO: 55367 - DNA, 21 bp, Artificial sequence
  SiRNA target sequence
tctgaacgcgtcactgcattt

SEQ ID NO: 55368 - DNA, 21 bp, Artificial sequence
  SiRNA target sequence
ctgaacgcgtcactgcatttt

SEQ ID NO: 55369 - DNA, 21 bp, Artificial sequence
  SiRNA target sequence
tgaacgcgtcactgcattttt

SEQ ID NO: 55370 - DNA, 21 bp, Artificial sequence
  SiRNA target sequence
gaacgcgtcactgcatttttt

SEQ ID NO: 55371 - DNA, 21 bp, Artificial sequence
  SiRNA target sequence
aacgcgtcactgcattttttg

SEQ ID NO: 55372 - DNA, 21 bp, Artificial sequence
  SiRNA target sequence
acgcgtcactgcattttttga

SEQ ID NO: 55373 - DNA, 21 bp, Artificial sequence
  SiRNA target sequence
cgcgtcactgcattttttgat

SEQ ID NO: 55374 - DNA, 21 bp, Artificial sequence
  SiRNA target sequence
gcgtcactgcattttttgatg

SEQ ID NO: 55375 - DNA, 21 bp, Artificial sequence
  SiRNA target sequence
cgtcactgcattttttgatga

SEQ ID NO: 55376 - DNA, 21 bp, Artificial sequence
  SiRNA target sequence
gtcactgcattttttgatgac

SEQ ID NO: 55377 - DNA, 21 bp, Artificial sequence
  SiRNA target sequence
tcactgcattttttgatgacg

SEQ ID NO: 55378 - DNA, 21 bp, Artificial sequence
  SiRNA target sequence
cactgcattttttgatgacgt

SEQ ID NO: 55379 - DNA, 21 bp, Artificial sequence
  SiRNA target sequence
actgcattttttgatgacgtg

SEQ ID NO: 55380 - DNA, 21 bp, Artificial sequence
  SiRNA target sequence
ctgcattttttgatgacgtgc

SEQ ID NO: 55381 - DNA, 21 bp, Artificial sequence
  SiRNA target sequence
tgcattttttgatgacgtgca

SEQ ID NO: 55382 - DNA, 21 bp, Artificial sequence
  SiRNA target sequence
gcattttttgatgacgtgcaa

SEQ ID NO: 55383 - DNA, 21 bp, Artificial sequence
  SiRNA target sequence
cattttttgatgacgtgcaaa

SEQ ID NO: 55384 - DNA, 21 bp, Artificial sequence
  SiRNA target sequence
attttttgatgacgtgcaaaa

SEQ ID NO: 55385 - DNA, 21 bp, Artificial sequence
  SiRNA target sequence
ttttttgatgacgtgcaaaaa

SEQ ID NO: 55386 - DNA, 21 bp, Artificial sequence
  SiRNA target sequence
tttttgatgacgtgcaaaaat

SEQ ID NO: 55387 - DNA, 21 bp, Artificial sequence
  SiRNA target sequence
ttttgatgacgtgcaaaaatt

SEQ ID NO: 55388 - DNA, 21 bp, Artificial sequence
  SiRNA target sequence
tttgatgacgtgcaaaaattg

SEQ ID NO: 55389 - DNA, 21 bp, Artificial sequence
  SiRNA target sequence
ttgatgacgtgcaaaaattga

SEQ ID NO: 55390 - DNA, 21 bp, Artificial sequence
  SiRNA target sequence
tgatgacgtgcaaaaattgat

SEQ ID NO: 55391 - DNA, 21 bp, Artificial sequence
  SiRNA target sequence
gatgacgtgcaaaaattgatc

SEQ ID NO: 55392 - DNA, 21 bp, Artificial sequence
  SiRNA target sequence
atgacgtgcaaaaattgatca

SEQ ID NO: 55393 - DNA, 21 bp, Artificial sequence
  SiRNA target sequence
tgacgtgcaaaaattgatcaa

SEQ ID NO: 55394 - DNA, 21 bp, Artificial sequence
  SiRNA target sequence
gacgtgcaaaaattgatcaat

SEQ ID NO: 55395 - DNA, 21 bp, Artificial sequence
  SiRNA target sequence
acgtgcaaaaattgatcaata

SEQ ID NO: 55396 - DNA, 21 bp, Artificial sequence
  SiRNA target sequence
cgtgcaaaaattgatcaataa

SEQ ID NO: 55397 - DNA, 21 bp, Artificial sequence
  SiRNA target sequence
gtgcaaaaattgatcaataaa

SEQ ID NO: 55398 - DNA, 21 bp, Artificial sequence
  SiRNA target sequence
tgcaaaaattgatcaataaat

SEQ ID NO: 55399 - DNA, 21 bp, Artificial sequence
  SiRNA target sequence
gcaaaaattgatcaataaatt

SEQ ID NO: 55400 - DNA, 21 bp, Artificial sequence
  SiRNA target sequence
caaaaattgatcaataaattt

SEQ ID NO: 55401 - DNA, 21 bp, Artificial sequence
  SiRNA target sequence
aaaaattgatcaataaattta

SEQ ID NO: 55402 - DNA, 21 bp, Artificial sequence
  SiRNA target sequence
aaaattgatcaataaatttat

SEQ ID NO: 55403 - DNA, 21 bp, Artificial sequence
  SiRNA target sequence
aaattgatcaataaatttatt

SEQ ID NO: 55404 - DNA, 21 bp, Artificial sequence
  SiRNA target sequence
aattgatcaataaatttatta

SEQ ID NO: 55405 - DNA, 21 bp, Artificial sequence
  SiRNA target sequence
attgatcaataaatttattac

SEQ ID NO: 55406 - DNA, 21 bp, Artificial sequence
  SiRNA target sequence
ttgatcaataaatttattacg

SEQ ID NO: 55407 - DNA, 21 bp, Artificial sequence
  SiRNA target sequence
  misc_feature (21)..(21): n is a, c, g, or t
tgatcaataaatttattacgn

SEQ ID NO: 55408 - DNA, 21 bp, Artificial sequence
  SiRNA target sequence
  misc_feature (20)..(20): n is a, c, g, or t
gatcaataaatttattacgna

SEQ ID NO: 55409 - DNA, 21 bp, Artificial sequence
  SiRNA target sequence
  misc_feature (19)..(19): n is a, c, g, or t
atcaataaatttattacgnat

SEQ ID NO: 55410 - DNA, 21 bp, Artificial sequence
  SiRNA target sequence
  misc_feature (18)..(18): n is a, c, g, or t
tcaataaatttattacgnata

SEQ ID NO: 55411 - DNA, 21 bp, Artificial sequence
  SiRNA target sequence
  misc_feature (17)..(17): n is a, c, g, or t
caataaatttattacgnatat

SEQ ID NO: 55412 - DNA, 21 bp, Artificial sequence
  SiRNA target sequence
  misc_feature (16)..(16): n is a, c, g, or t
aataaatttattacgnatata

SEQ ID NO: 55413 - DNA, 21 bp, Artificial sequence
  SiRNA target sequence
  misc_feature (15)..(15): n is a, c, g, or t
ataaatttattacgnatataa

SEQ ID NO: 55414 - DNA, 21 bp, Artificial sequence
  SiRNA target sequence
  misc_feature (14)..(14): n is a, c, g, or t
taaatttattacgnatataaa

SEQ ID NO: 55415 - DNA, 21 bp, Artificial sequence
  SiRNA target sequence
  misc_feature (13)..(13): n is a, c, g, or t
aaatttattacgnatataaat

SEQ ID NO: 55416 - DNA, 21 bp, Artificial sequence
  SiRNA target sequence
  misc_feature (12)..(12): n is a, c, g, or t
aatttattacgnatataaata

SEQ ID NO: 55417 - DNA, 21 bp, Artificial sequence
  SiRNA target sequence
  misc_feature (11)..(11): n is a, c, g, or t
atttattacgnatataaatat

SEQ ID NO: 55418 - DNA, 21 bp, Artificial sequence
  SiRNA target sequence
  misc_feature (10)..(10): n is a, c, g, or t
tttattacgnatataaatatt

SEQ ID NO: 55419 - DNA, 21 bp, Artificial sequence
  SiRNA target sequence
  misc_feature (9)..(9): n is a, c, g, or t
ttattacgnatataaatattt

SEQ ID NO: 55420 - DNA, 21 bp, Artificial sequence
  SiRNA target sequence
  misc_feature (8)..(8): n is a, c, g, or t
tattacgnatataaatatttt

SEQ ID NO: 55421 - DNA, 21 bp, Artificial sequence
  SiRNA target sequence
  misc_feature (7)..(7): n is a, c, g, or t
attacgnatataaatattttt

SEQ ID NO: 55422 - DNA, 21 bp, Artificial sequence
  SiRNA target sequence
  misc_feature (6)..(6): n is a, c, g, or t
ttacgnatataaatattttta

SEQ ID NO: 55423 - DNA, 21 bp, Artificial sequence
  SiRNA target sequence
  misc_feature (5)..(5): n is a, c, g, or t
tacgnatataaatatttttag

SEQ ID NO: 55424 - DNA, 21 bp, Artificial sequence
  SiRNA target sequence
  misc_feature (4)..(4): n is a, c, g, or t
acgnatataaatatttttagt

SEQ ID NO: 55425 - DNA, 21 bp, Artificial sequence
  SiRNA target sequence
  misc_feature (3)..(3): n is a, c, g, or t
cgnatataaatatttttagta

SEQ ID NO: 55426 - DNA, 21 bp, Artificial sequence
  SiRNA target sequence
  misc_feature (2)..(2): n is a, c, g, or t
gnatataaatatttttagtat

SEQ ID NO: 55427 - DNA, 21 bp, Artificial sequence
  SiRNA target sequence
  misc_feature (1)..(1): n is a, c, g, or t
natataaatatttttagtatg

SEQ ID NO: 55428 - DNA, 21 bp, Artificial sequence
  SiRNA target sequence
atataaatatttttagtatgg

SEQ ID NO: 55429 - DNA, 21 bp, Artificial sequence
  SiRNA target sequence
tataaatatttttagtatggg

SEQ ID NO: 55430 - DNA, 21 bp, Artificial sequence
  SiRNA target sequence
ataaatatttttagtatggga

SEQ ID NO: 55431 - DNA, 21 bp, Artificial sequence
  SiRNA target sequence
taaatatttttagtatgggaa

SEQ ID NO: 55432 - DNA, 21 bp, Artificial sequence
  SiRNA target sequence
aaatatttttagtatgggaat

SEQ ID NO: 55433 - DNA, 21 bp, Artificial sequence
  SiRNA target sequence
aatatttttagtatgggaatt

SEQ ID NO: 55434 - DNA, 21 bp, Artificial sequence
  SiRNA target sequence
atatttttagtatgggaattg

SEQ ID NO: 55435 - DNA, 21 bp, Artificial sequence
  SiRNA target sequence
tatttttagtatgggaattgg

SEQ ID NO: 55436 - DNA, 21 bp, Artificial sequence
  SiRNA target sequence
atttttagtatgggaattgga

SEQ ID NO: 55437 - DNA, 21 bp, Artificial sequence
  SiRNA target sequence
tttttagtatgggaattggag

SEQ ID NO: 55438 - DNA, 21 bp, Artificial sequence
  SiRNA target sequence
ttttagtatgggaattggaga

SEQ ID NO: 55439 - DNA, 21 bp, Artificial sequence
  SiRNA target sequence
tttagtatgggaattggagac

SEQ ID NO: 55440 - DNA, 21 bp, Artificial sequence
  SiRNA target sequence
ttagtatgggaattggagacg

SEQ ID NO: 55441 - DNA, 21 bp, Artificial sequence
  SiRNA target sequence
tagtatgggaattggagacgc

SEQ ID NO: 55442 - DNA, 21 bp, Artificial sequence
  SiRNA target sequence
agtatgggaattggagacgca

SEQ ID NO: 55443 - DNA, 21 bp, Artificial sequence
  SiRNA target sequence
gtatgggaattggagacgcag

SEQ ID NO: 55444 - DNA, 21 bp, Artificial sequence
  SiRNA target sequence
tatgggaattggagacgcagt

SEQ ID NO: 55445 - DNA, 21 bp, Artificial sequence
  SiRNA target sequence
atgggaattggagacgcagta

SEQ ID NO: 55446 - DNA, 21 bp, Artificial sequence
  SiRNA target sequence
tgggaattggagacgcagtag

SEQ ID NO: 55447 - DNA, 21 bp, Artificial sequence
  SiRNA target sequence
gggaattggagacgcagtagc

SEQ ID NO: 55448 - DNA, 21 bp, Artificial sequence
  SiRNA target sequence
ggaattggagacgcagtagct

SEQ ID NO: 55449 - DNA, 21 bp, Artificial sequence
  SiRNA target sequence
gaattggagacgcagtagctg

SEQ ID NO: 55450 - DNA, 21 bp, Artificial sequence
  SiRNA target sequence
aattggagacgcagtagctga

SEQ ID NO: 55451 - DNA, 21 bp, Artificial sequence
  SiRNA target sequence
attggagacgcagtagctgat

SEQ ID NO: 55452 - DNA, 21 bp, Artificial sequence
  SiRNA target sequence
ttggagacgcagtagctgatc

SEQ ID NO: 55453 - DNA, 21 bp, Artificial sequence
  SiRNA target sequence
tggagacgcagtagctgatca

SEQ ID NO: 55454 - DNA, 21 bp, Artificial sequence
  SiRNA target sequence
ggagacgcagtagctgatcaa

SEQ ID NO: 55455 - DNA, 21 bp, Artificial sequence
  SiRNA target sequence
gagacgcagtagctgatcaag

SEQ ID NO: 55456 - DNA, 21 bp, Artificial sequence
  SiRNA target sequence
agacgcagtagctgatcaaga

SEQ ID NO: 55457 - DNA, 21 bp, Artificial sequence
  SiRNA target sequence
gacgcagtagctgatcaagat

SEQ ID NO: 55458 - DNA, 21 bp, Artificial sequence
  SiRNA target sequence
acgcagtagctgatcaagata

SEQ ID NO: 55459 - DNA, 21 bp, Artificial sequence
  SiRNA target sequence
cgcagtagctgatcaagatac

SEQ ID NO: 55460 - DNA, 21 bp, Artificial sequence
  SiRNA target sequence
gcagtagctgatcaagatact

SEQ ID NO: 55461 - DNA, 21 bp, Artificial sequence
  SiRNA target sequence
cagtagctgatcaagatacta

SEQ ID NO: 55462 - DNA, 21 bp, Artificial sequence
  SiRNA target sequence
agtagctgatcaagatactat

SEQ ID NO: 55463 - DNA, 21 bp, Artificial sequence
  SiRNA target sequence
gtagctgatcaagatactatg

SEQ ID NO: 55464 - DNA, 21 bp, Artificial sequence
  SiRNA target sequence
tagctgatcaagatactatgt

SEQ ID NO: 55465 - DNA, 21 bp, Artificial sequence
  SiRNA target sequence
agctgatcaagatactatgtt

SEQ ID NO: 55466 - DNA, 21 bp, Artificial sequence
  SiRNA target sequence
gctgatcaagatactatgttt

SEQ ID NO: 55467 - DNA, 21 bp, Artificial sequence
  SiRNA target sequence
ctgatcaagatactatgtttt

SEQ ID NO: 55468 - DNA, 21 bp, Artificial sequence
  SiRNA target sequence
tgatcaagatactatgtttta

SEQ ID NO: 55469 - DNA, 21 bp, Artificial sequence
  SiRNA target sequence
gatcaagatactatgttttat

SEQ ID NO: 55470 - DNA, 21 bp, Artificial sequence
  SiRNA target sequence
atcaagatactatgttttatg

SEQ ID NO: 55471 - DNA, 21 bp, Artificial sequence
  SiRNA target sequence
tcaagatactatgttttatgt

SEQ ID NO: 55472 - DNA, 21 bp, Artificial sequence
  SiRNA target sequence
caagatactatgttttatgtc

SEQ ID NO: 55473 - DNA, 21 bp, Artificial sequence
  SiRNA target sequence
aagatactatgttttatgtca

SEQ ID NO: 55474 - DNA, 21 bp, Artificial sequence
  SiRNA target sequence
agatactatgttttatgtcaa

SEQ ID NO: 55475 - DNA, 21 bp, Artificial sequence
  SiRNA target sequence
gatactatgttttatgtcaag

SEQ ID NO: 55476 - DNA, 21 bp, Artificial sequence
  SiRNA target sequence
atactatgttttatgtcaagg

SEQ ID NO: 55477 - DNA, 21 bp, Artificial sequence
  SiRNA target sequence
tactatgttttatgtcaagga

SEQ ID NO: 55478 - DNA, 21 bp, Artificial sequence
  SiRNA target sequence
actatgttttatgtcaaggaa

SEQ ID NO: 55479 - DNA, 21 bp, Artificial sequence
  SiRNA target sequence
ctatgttttatgtcaaggaat

SEQ ID NO: 55480 - DNA, 21 bp, Artificial sequence
  SiRNA target sequence
tatgttttatgtcaaggaatc

SEQ ID NO: 55481 - DNA, 21 bp, Artificial sequence
  SiRNA target sequence
atgttttatgtcaaggaatct

SEQ ID NO: 55482 - DNA, 21 bp, Artificial sequence
  SiRNA target sequence
tgttttatgtcaaggaatcta

SEQ ID NO: 55483 - DNA, 21 bp, Artificial sequence
  SiRNA target sequence
gttttatgtcaaggaatctat

SEQ ID NO: 55484 - DNA, 21 bp, Artificial sequence
  SiRNA target sequence
ttttatgtcaaggaatctata

SEQ ID NO: 55485 - DNA, 21 bp, Artificial sequence
  SiRNA target sequence
tttatgtcaaggaatctatag

SEQ ID NO: 55486 - DNA, 21 bp, Artificial sequence
  SiRNA target sequence
ttatgtcaaggaatctataga

SEQ ID NO: 55487 - DNA, 21 bp, Artificial sequence
  SiRNA target sequence
tatgtcaaggaatctatagaa

SEQ ID NO: 55488 - DNA, 21 bp, Artificial sequence
  SiRNA target sequence
atgtcaaggaatctatagaaa

SEQ ID NO: 55489 - DNA, 21 bp, Artificial sequence
  SiRNA target sequence
tgtcaaggaatctatagaaag

SEQ ID NO: 55490 - DNA, 21 bp, Artificial sequence
  SiRNA target sequence
gtcaaggaatctatagaaagt

SEQ ID NO: 55491 - DNA, 21 bp, Artificial sequence
  SiRNA target sequence
tcaaggaatctatagaaagtg

SEQ ID NO: 55492 - DNA, 21 bp, Artificial sequence
  SiRNA target sequence
caaggaatctatagaaagtgc

SEQ ID NO: 55493 - DNA, 21 bp, Artificial sequence
  SiRNA target sequence
aaggaatctatagaaagtgct

SEQ ID NO: 55494 - DNA, 21 bp, Artificial sequence
  SiRNA target sequence
aggaatctatagaaagtgcta

SEQ ID NO: 55495 - DNA, 21 bp, Artificial sequence
  SiRNA target sequence
ggaatctatagaaagtgctaa

SEQ ID NO: 55496 - DNA, 21 bp, Artificial sequence
  SiRNA target sequence
gaatctatagaaagtgctaaa

SEQ ID NO: 55497 - DNA, 21 bp, Artificial sequence
  SiRNA target sequence
aatctatagaaagtgctaaag

SEQ ID NO: 55498 - DNA, 21 bp, Artificial sequence
  SiRNA target sequence
atctatagaaagtgctaaaga

SEQ ID NO: 55499 - DNA, 21 bp, Artificial sequence
  SiRNA target sequence
tctatagaaagtgctaaagag

SEQ ID NO: 55500 - DNA, 21 bp, Artificial sequence
  SiRNA target sequence
ctatagaaagtgctaaagaga

SEQ ID NO: 55501 - DNA, 21 bp, Artificial sequence
  SiRNA target sequence
tatagaaagtgctaaagagaa

SEQ ID NO: 55502 - DNA, 21 bp, Artificial sequence
  SiRNA target sequence
atagaaagtgctaaagagaaa

SEQ ID NO: 55503 - DNA, 21 bp, Artificial sequence
  SiRNA target sequence
tagaaagtgctaaagagaaag

SEQ ID NO: 55504 - DNA, 21 bp, Artificial sequence
  SiRNA target sequence
agaaagtgctaaagagaaagt

SEQ ID NO: 55505 - DNA, 21 bp, Artificial sequence
  SiRNA target sequence
gaaagtgctaaagagaaagta

SEQ ID NO: 55506 - DNA, 21 bp, Artificial sequence
  SiRNA target sequence
  misc_feature (21)..(21): n is a, c, g, or t
aaagtgctaaagagaaagtan

SEQ ID NO: 55507 - DNA, 21 bp, Artificial sequence
  SiRNA target sequence
  misc_feature (20)..(20): n is a, c, g, or t
aagtgctaaagagaaagtang

SEQ ID NO: 55508 - DNA, 21 bp, Artificial sequence
  SiRNA target sequence
  misc_feature (19)..(19): n is a, c, g, or t
agtgctaaagagaaagtangt

SEQ ID NO: 55509 - DNA, 21 bp, Artificial sequence
  SiRNA target sequence
  misc_feature (18)..(18): n is a, c, g, or t
gtgctaaagagaaagtangtg

SEQ ID NO: 55510 - DNA, 21 bp, Artificial sequence
  SiRNA target sequence
  misc_feature (17)..(17): n is a, c, g, or t
tgctaaagagaaagtangtga

SEQ ID NO: 55511 - DNA, 21 bp, Artificial sequence
  SiRNA target sequence
  misc_feature (16)..(16): n is a, c, g, or t
gctaaagagaaagtangtgat

SEQ ID NO: 55512 - DNA, 21 bp, Artificial sequence
  SiRNA target sequence
  misc_feature (15)..(15): n is a, c, g, or t
ctaaagagaaagtangtgata

SEQ ID NO: 55513 - DNA, 21 bp, Artificial sequence
  SiRNA target sequence
  misc_feature (14)..(14): n is a, c, g, or t
taaagagaaagtangtgatat

SEQ ID NO: 55514 - DNA, 21 bp, Artificial sequence
  SiRNA target sequence
  misc_feature (13)..(13): n is a, c, g, or t
aaagagaaagtangtgatatt

SEQ ID NO: 55515 - DNA, 21 bp, Artificial sequence
  SiRNA target sequence
  misc_feature (12)..(12): n is a, c, g, or t
aagagaaagtangtgatatta

SEQ ID NO: 55516 - DNA, 21 bp, Artificial sequence
  SiRNA target sequence
  misc_feature (11)..(11): n is a, c, g, or t
agagaaagtangtgatattat

SEQ ID NO: 55517 - DNA, 21 bp, Artificial sequence
  SiRNA target sequence
  misc_feature (10)..(10): n is a, c, g, or t
gagaaagtangtgatattata

SEQ ID NO: 55518 - DNA, 21 bp, Artificial sequence
  SiRNA target sequence
  misc_feature (9)..(9): n is a, c, g, or t
agaaagtangtgatattataa

SEQ ID NO: 55519 - DNA, 21 bp, Artificial sequence
  SiRNA target sequence
  misc_feature (8)..(8): n is a, c, g, or t
gaaagtangtgatattataaa

SEQ ID NO: 55520 - DNA, 21 bp, Artificial sequence
  SiRNA target sequence
  misc_feature (7)..(7): n is a, c, g, or t
aaagtangtgatattataaaa

SEQ ID NO: 55521 - DNA, 21 bp, Artificial sequence
  SiRNA target sequence
  misc_feature (6)..(6): n is a, c, g, or t
aagtangtgatattataaaaa

SEQ ID NO: 55522 - DNA, 21 bp, Artificial sequence
  SiRNA target sequence
  misc_feature (5)..(5): n is a, c, g, or t
agtangtgatattataaaaaa

SEQ ID NO: 55523 - DNA, 21 bp, Artificial sequence
  SiRNA target sequence
  misc_feature (4)..(4): n is a, c, g, or t
gtangtgatattataaaaaaa

SEQ ID NO: 55524 - DNA, 21 bp, Artificial sequence
  SiRNA target sequence
  misc_feature (3)..(3): n is a, c, g, or t
tangtgatattataaaaaaag

SEQ ID NO: 55525 - DNA, 21 bp, Artificial sequence
  SiRNA target sequence
  misc_feature (2)..(2): n is a, c, g, or t
angtgatattataaaaaaagc

SEQ ID NO: 55526 - DNA, 21 bp, Artificial sequence
  SiRNA target sequence
  misc_feature (1)..(1): n is a, c, g, or t
ngtgatattataaaaaaagca

SEQ ID NO: 55527 - DNA, 21 bp, Artificial sequence
  SiRNA target sequence
gtgatattataaaaaaagcac

SEQ ID NO: 55528 - DNA, 21 bp, Artificial sequence
  SiRNA target sequence
tgatattataaaaaaagcaca

SEQ ID NO: 55529 - DNA, 21 bp, Artificial sequence
  SiRNA target sequence
gatattataaaaaaagcacat

SEQ ID NO: 55530 - DNA, 21 bp, Artificial sequence
  SiRNA target sequence
atattataaaaaaagcacata

SEQ ID NO: 55531 - DNA, 21 bp, Artificial sequence
  SiRNA target sequence
tattataaaaaaagcacataa

SEQ ID NO: 55532 - DNA, 21 bp, Artificial sequence
  SiRNA target sequence
attataaaaaaagcacataaa

SEQ ID NO: 55533 - DNA, 21 bp, Artificial sequence
  SiRNA target sequence
ttataaaaaaagcacataaaa

SEQ ID NO: 55534 - DNA, 21 bp, Artificial sequence
  SiRNA target sequence
tataaaaaaagcacataaaaa

SEQ ID NO: 55535 - DNA, 21 bp, Artificial sequence
  SiRNA target sequence
ataaaaaaagcacataaaaat

SEQ ID NO: 55536 - DNA, 21 bp, Artificial sequence
  SiRNA target sequence
taaaaaaagcacataaaaatt

SEQ ID NO: 55537 - DNA, 21 bp, Artificial sequence
  SiRNA target sequence
aaaaaaagcacataaaaattc

SEQ ID NO: 55538 - DNA, 21 bp, Artificial sequence
  SiRNA target sequence
aaaaaagcacataaaaattca

SEQ ID NO: 55539 - DNA, 21 bp, Artificial sequence
  SiRNA target sequence
aaaaagcacataaaaattcac

SEQ ID NO: 55540 - DNA, 21 bp, Artificial sequence
  SiRNA target sequence
aaaagcacataaaaattcact

SEQ ID NO: 55541 - DNA, 21 bp, Artificial sequence
  SiRNA target sequence
aaagcacataaaaattcacta

SEQ ID NO: 55542 - DNA, 21 bp, Artificial sequence
  SiRNA target sequence
aagcacataaaaattcactag

SEQ ID NO: 55543 - DNA, 21 bp, Artificial sequence
  SiRNA target sequence
agcacataaaaattcactaga

SEQ ID NO: 55544 - DNA, 21 bp, Artificial sequence
  SiRNA target sequence
gcacataaaaattcactagaa

SEQ ID NO: 55545 - DNA, 21 bp, Artificial sequence
  SiRNA target sequence
cacataaaaattcactagaaa

SEQ ID NO: 55546 - DNA, 21 bp, Artificial sequence
  SiRNA target sequence
acataaaaattcactagaaag

SEQ ID NO: 55547 - DNA, 21 bp, Artificial sequence
  SiRNA target sequence
cataaaaattcactagaaaga

SEQ ID NO: 55548 - DNA, 21 bp, Artificial sequence
  SiRNA target sequence
ataaaaattcactagaaagat

SEQ ID NO: 55549 - DNA, 21 bp, Artificial sequence
  SiRNA target sequence
taaaaattcactagaaagatt

SEQ ID NO: 55550 - DNA, 21 bp, Artificial sequence
  SiRNA target sequence
aaaaattcactagaaagattg

SEQ ID NO: 55551 - DNA, 21 bp, Artificial sequence
  SiRNA target sequence
aaaattcactagaaagattgc

SEQ ID NO: 55552 - DNA, 21 bp, Artificial sequence
  SiRNA target sequence
aaattcactagaaagattgcc

SEQ ID NO: 55553 - DNA, 21 bp, Artificial sequence
  SiRNA target sequence
aattcactagaaagattgcca

SEQ ID NO: 55554 - DNA, 21 bp, Artificial sequence
  SiRNA target sequence
attcactagaaagattgccag

SEQ ID NO: 55555 - DNA, 21 bp, Artificial sequence
  SiRNA target sequence
ttcactagaaagattgccagg

SEQ ID NO: 55556 - DNA, 21 bp, Artificial sequence
  SiRNA target sequence
tcactagaaagattgccaggt

SEQ ID NO: 55557 - DNA, 21 bp, Artificial sequence
  SiRNA target sequence
cactagaaagattgccaggta

SEQ ID NO: 55558 - DNA, 21 bp, Artificial sequence
  SiRNA target sequence
actagaaagattgccaggtat

SEQ ID NO: 55559 - DNA, 21 bp, Artificial sequence
  SiRNA target sequence
ctagaaagattgccaggtatg

SEQ ID NO: 55560 - DNA, 21 bp, Artificial sequence
  SiRNA target sequence
tagaaagattgccaggtatgt

SEQ ID NO: 55561 - DNA, 21 bp, Artificial sequence
  SiRNA target sequence
agaaagattgccaggtatgtc

SEQ ID NO: 55562 - DNA, 21 bp, Artificial sequence
  SiRNA target sequence
  misc_feature (21)..(21): n is a, c, g, or t
gaaagattgccaggtatgtcn

SEQ ID NO: 55563 - DNA, 21 bp, Artificial sequence
  SiRNA target sequence
  misc_feature (20)..(20): n is a, c, g, or t
aaagattgccaggtatgtcna

SEQ ID NO: 55564 - DNA, 21 bp, Artificial sequence
  SiRNA target sequence
  misc_feature (19)..(19): n is a, c, g, or t
aagattgccaggtatgtcnat

SEQ ID NO: 55565 - DNA, 21 bp, Artificial sequence
  SiRNA target sequence
  misc_feature (18)..(18): n is a, c, g, or t
agattgccaggtatgtcnatg

SEQ ID NO: 55566 - DNA, 21 bp, Artificial sequence
  SiRNA target sequence
  misc_feature (17)..(17): n is a, c, g, or t
gattgccaggtatgtcnatga

SEQ ID NO: 55567 - DNA, 21 bp, Artificial sequence
  SiRNA target sequence
  misc_feature (16)..(16): n is a, c, g, or t
attgccaggtatgtcnatgaa

SEQ ID NO: 55568 - DNA, 21 bp, Artificial sequence
  SiRNA target sequence
  misc_feature (15)..(15): n is a, c, g, or t
ttgccaggtatgtcnatgaaa

SEQ ID NO: 55569 - DNA, 21 bp, Artificial sequence
  SiRNA target sequence
  misc_feature (14)..(14): n is a, c, g, or t
tgccaggtatgtcnatgaaag

SEQ ID NO: 55570 - DNA, 21 bp, Artificial sequence
  SiRNA target sequence
  misc_feature (13)..(13): n is a, c, g, or t
gccaggtatgtcnatgaaaga

SEQ ID NO: 55571 - DNA, 21 bp, Artificial sequence
  SiRNA target sequence
  misc_feature (12)..(12): n is a, c, g, or t
ccaggtatgtcnatgaaagaa

SEQ ID NO: 55572 - DNA, 21 bp, Artificial sequence
  SiRNA target sequence
  misc_feature (11)..(11): n is a, c, g, or t
caggtatgtcnatgaaagaaa

SEQ ID NO: 55573 - DNA, 21 bp, Artificial sequence
  SiRNA target sequence
  misc_feature (10)..(10): n is a, c, g, or t
aggtatgtcnatgaaagaaag

SEQ ID NO: 55574 - DNA, 21 bp, Artificial sequence
  SiRNA target sequence
  misc_feature (9)..(9): n is a, c, g, or t
ggtatgtcnatgaaagaaagt

SEQ ID NO: 55575 - DNA, 21 bp, Artificial sequence
  SiRNA target sequence
  misc_feature (8)..(8): n is a, c, g, or t
gtatgtcnatgaaagaaagtt

SEQ ID NO: 55576 - DNA, 21 bp, Artificial sequence
  SiRNA target sequence
  misc_feature (7)..(7): n is a, c, g, or t
tatgtcnatgaaagaaagttt

SEQ ID NO: 55577 - DNA, 21 bp, Artificial sequence
  SiRNA target sequence
  misc_feature (6)..(6): n is a, c, g, or t
atgtcnatgaaagaaagtttc

SEQ ID NO: 55578 - DNA, 21 bp, Artificial sequence
  SiRNA target sequence
  misc_feature (5)..(5): n is a, c, g, or t
tgtcnatgaaagaaagtttcg

SEQ ID NO: 55579 - DNA, 21 bp, Artificial sequence
  SiRNA target sequence
  misc_feature (4)..(4): n is a, c, g, or t
gtcnatgaaagaaagtttcga

SEQ ID NO: 55580 - DNA, 21 bp, Artificial sequence
  SiRNA target sequence
  misc_feature (3)..(3): n is a, c, g, or t
tcnatgaaagaaagtttcgaa

SEQ ID NO: 55581 - DNA, 21 bp, Artificial sequence
  SiRNA target sequence
  misc_feature (2)..(2): n is a, c, g, or t
cnatgaaagaaagtttcgaaa

SEQ ID NO: 55582 - DNA, 21 bp, Artificial sequence
  SiRNA target sequence
  misc_feature (1)..(1): n is a, c, g, or t
natgaaagaaagtttcgaaag

SEQ ID NO: 55583 - DNA, 21 bp, Artificial sequence
  SiRNA target sequence
atgaaagaaagtttcgaaagt

SEQ ID NO: 55584 - DNA, 21 bp, Artificial sequence
  SiRNA target sequence
tgaaagaaagtttcgaaagtc

SEQ ID NO: 55585 - DNA, 21 bp, Artificial sequence
  SiRNA target sequence
gaaagaaagtttcgaaagtca

SEQ ID NO: 55586 - DNA, 21 bp, Artificial sequence
  SiRNA target sequence
aaagaaagtttcgaaagtcaa

SEQ ID NO: 55587 - DNA, 21 bp, Artificial sequence
  SiRNA target sequence
aagaaagtttcgaaagtcaag

SEQ ID NO: 55588 - DNA, 21 bp, Artificial sequence
  SiRNA target sequence
agaaagtttcgaaagtcaagt

SEQ ID NO: 55589 - DNA, 21 bp, Artificial sequence
  SiRNA target sequence
gaaagtttcgaaagtcaagtt

SEQ ID NO: 55590 - DNA, 21 bp, Artificial sequence
  SiRNA target sequence
aaagtttcgaaagtcaagtta

SEQ ID NO: 55591 - DNA, 21 bp, Artificial sequence
  SiRNA target sequence
aagtttcgaaagtcaagttaa

SEQ ID NO: 55592 - DNA, 21 bp, Artificial sequence
  SiRNA target sequence
agtttcgaaagtcaagttaat

SEQ ID NO: 55593 - DNA, 21 bp, Artificial sequence
  SiRNA target sequence
gtttcgaaagtcaagttaatc

SEQ ID NO: 55594 - DNA, 21 bp, Artificial sequence
  SiRNA target sequence
tttcgaaagtcaagttaatca

SEQ ID NO: 55595 - DNA, 21 bp, Artificial sequence
  SiRNA target sequence
ttcgaaagtcaagttaatcat

SEQ ID NO: 55596 - DNA, 21 bp, Artificial sequence
  SiRNA target sequence
tcgaaagtcaagttaatcata

SEQ ID NO: 55597 - DNA, 21 bp, Artificial sequence
  SiRNA target sequence
cgaaagtcaagttaatcatat

SEQ ID NO: 55598 - DNA, 21 bp, Artificial sequence
  SiRNA target sequence
gaaagtcaagttaatcatatt

SEQ ID NO: 55599 - DNA, 21 bp, Artificial sequence
  SiRNA target sequence
aaagtcaagttaatcatattt

SEQ ID NO: 55600 - DNA, 21 bp, Artificial sequence
  SiRNA target sequence
aagtcaagttaatcatatttt

SEQ ID NO: 55601 - DNA, 21 bp, Artificial sequence
  SiRNA target sequence
agtcaagttaatcatatttta

SEQ ID NO: 55602 - DNA, 21 bp, Artificial sequence
  SiRNA target sequence
gtcaagttaatcatattttaa

SEQ ID NO: 55603 - DNA, 21 bp, Artificial sequence
  SiRNA target sequence
tcaagttaatcatattttaaa

SEQ ID NO: 55604 - DNA, 21 bp, Artificial sequence
  SiRNA target sequence
caagttaatcatattttaaat

SEQ ID NO: 55605 - DNA, 21 bp, Artificial sequence
  SiRNA target sequence
aagttaatcatattttaaata

SEQ ID NO: 55606 - DNA, 21 bp, Artificial sequence
  SiRNA target sequence
agttaatcatattttaaataa

SEQ ID NO: 55607 - DNA, 21 bp, Artificial sequence
  SiRNA target sequence
gttaatcatattttaaataaa

SEQ ID NO: 55608 - DNA, 21 bp, Artificial sequence
  SiRNA target sequence
ttaatcatattttaaataaag

SEQ ID NO: 55609 - DNA, 21 bp, Artificial sequence
  SiRNA target sequence
taatcatattttaaataaagc

SEQ ID NO: 55610 - DNA, 21 bp, Artificial sequence
  SiRNA target sequence
aatcatattttaaataaagca

SEQ ID NO: 55611 - DNA, 21 bp, Artificial sequence
  SiRNA target sequence
atcatattttaaataaagcaa

SEQ ID NO: 55612 - DNA, 21 bp, Artificial sequence
  SiRNA target sequence
tcatattttaaataaagcaag

SEQ ID NO: 55613 - DNA, 21 bp, Artificial sequence
  SiRNA target sequence
catattttaaataaagcaaga

SEQ ID NO: 55614 - DNA, 21 bp, Artificial sequence
  SiRNA target sequence
atattttaaataaagcaagag

SEQ ID NO: 55615 - DNA, 21 bp, Artificial sequence
  SiRNA target sequence
tattttaaataaagcaagaga

SEQ ID NO: 55616 - DNA, 21 bp, Artificial sequence
  SiRNA target sequence
attttaaataaagcaagagac

SEQ ID NO: 55617 - DNA, 21 bp, Artificial sequence
  SiRNA target sequence
ttttaaataaagcaagagacg

SEQ ID NO: 55618 - DNA, 21 bp, Artificial sequence
  SiRNA target sequence
tttaaataaagcaagagacgt

SEQ ID NO: 55619 - DNA, 21 bp, Artificial sequence
  SiRNA target sequence
ttaaataaagcaagagacgtt

SEQ ID NO: 55620 - DNA, 21 bp, Artificial sequence
  SiRNA target sequence
taaataaagcaagagacgttt

SEQ ID NO: 55621 - DNA, 21 bp, Artificial sequence
  SiRNA target sequence
aaataaagcaagagacgtttc

SEQ ID NO: 55622 - DNA, 21 bp, Artificial sequence
  SiRNA target sequence
aataaagcaagagacgtttct

SEQ ID NO: 55623 - DNA, 21 bp, Artificial sequence
  SiRNA target sequence
ataaagcaagagacgtttctg

SEQ ID NO: 55624 - DNA, 21 bp, Artificial sequence
  SiRNA target sequence
taaagcaagagacgtttctgg

SEQ ID NO: 55625 - DNA, 21 bp, Artificial sequence
  SiRNA target sequence
aaagcaagagacgtttctggt

SEQ ID NO: 55626 - DNA, 21 bp, Artificial sequence
  SiRNA target sequence
aagcaagagacgtttctggta

SEQ ID NO: 55627 - DNA, 21 bp, Artificial sequence
  SiRNA target sequence
agcaagagacgtttctggtac

SEQ ID NO: 55628 - DNA, 21 bp, Artificial sequence
  SiRNA target sequence
gcaagagacgtttctggtacc

SEQ ID NO: 55629 - DNA, 21 bp, Artificial sequence
  SiRNA target sequence
caagagacgtttctggtacct

SEQ ID NO: 55630 - DNA, 21 bp, Artificial sequence
  SiRNA target sequence
aagagacgtttctggtacctc

SEQ ID NO: 55631 - DNA, 21 bp, Artificial sequence
  SiRNA target sequence
agagacgtttctggtacctca

SEQ ID NO: 55632 - DNA, 21 bp, Artificial sequence
  SiRNA target sequence
gagacgtttctggtacctcaa

SEQ ID NO: 55633 - DNA, 21 bp, Artificial sequence
  SiRNA target sequence
agacgtttctggtacctcaac

SEQ ID NO: 55634 - DNA, 21 bp, Artificial sequence
  SiRNA target sequence
gacgtttctggtacctcaact

SEQ ID NO: 55635 - DNA, 21 bp, Artificial sequence
  SiRNA target sequence
acgtttctggtacctcaactc

SEQ ID NO: 55636 - DNA, 21 bp, Artificial sequence
  SiRNA target sequence
cgtttctggtacctcaactca

SEQ ID NO: 55637 - DNA, 21 bp, Artificial sequence
  SiRNA target sequence
gtttctggtacctcaactcaa

SEQ ID NO: 55638 - DNA, 21 bp, Artificial sequence
  SiRNA target sequence
tttctggtacctcaactcaaa

SEQ ID NO: 55639 - DNA, 21 bp, Artificial sequence
  SiRNA target sequence
ttctggtacctcaactcaaaa

SEQ ID NO: 55640 - DNA, 21 bp, Artificial sequence
  SiRNA target sequence
tctggtacctcaactcaaaaa

SEQ ID NO: 55641 - DNA, 21 bp, Artificial sequence
  SiRNA target sequence
ctggtacctcaactcaaaaaa

SEQ ID NO: 55642 - DNA, 21 bp, Artificial sequence
  SiRNA target sequence
tggtacctcaactcaaaaaag

SEQ ID NO: 55643 - DNA, 21 bp, Artificial sequence
  SiRNA target sequence
ggtacctcaactcaaaaaagt

SEQ ID NO: 55644 - DNA, 21 bp, Artificial sequence
  SiRNA target sequence
gtacctcaactcaaaaaagtt

SEQ ID NO: 55645 - DNA, 21 bp, Artificial sequence
  SiRNA target sequence
tacctcaactcaaaaaagttt

SEQ ID NO: 55646 - DNA, 21 bp, Artificial sequence
  SiRNA target sequence
acctcaactcaaaaaagttta

SEQ ID NO: 55647 - DNA, 21 bp, Artificial sequence
  SiRNA target sequence
cctcaactcaaaaaagtttaa

SEQ ID NO: 55648 - DNA, 21 bp, Artificial sequence
  SiRNA target sequence
ctcaactcaaaaaagtttaaa

SEQ ID NO: 55649 - DNA, 21 bp, Artificial sequence
  SiRNA target sequence
tcaactcaaaaaagtttaaat

SEQ ID NO: 55650 - DNA, 21 bp, Artificial sequence
  SiRNA target sequence
caactcaaaaaagtttaaatt

SEQ ID NO: 55651 - DNA, 21 bp, Artificial sequence
  SiRNA target sequence
aactcaaaaaagtttaaattt

SEQ ID NO: 55652 - DNA, 21 bp, Artificial sequence
  SiRNA target sequence
actcaaaaaagtttaaattta

SEQ ID NO: 55653 - DNA, 21 bp, Artificial sequence
  SiRNA target sequence
ctcaaaaaagtttaaatttat

SEQ ID NO: 55654 - DNA, 21 bp, Artificial sequence
  SiRNA target sequence
tcaaaaaagtttaaatttatc

SEQ ID NO: 55655 - DNA, 21 bp, Artificial sequence
  SiRNA target sequence
caaaaaagtttaaatttatct

SEQ ID NO: 55656 - DNA, 21 bp, Artificial sequence
  SiRNA target sequence
aaaaaagtttaaatttatcta

SEQ ID NO: 55657 - DNA, 21 bp, Artificial sequence
  SiRNA target sequence
aaaaagtttaaatttatctaa

SEQ ID NO: 55658 - DNA, 21 bp, Artificial sequence
  SiRNA target sequence
aaaagtttaaatttatctaat

SEQ ID NO: 55659 - DNA, 21 bp, Artificial sequence
  SiRNA target sequence
aaagtttaaatttatctaata

SEQ ID NO: 55660 - DNA, 21 bp, Artificial sequence
  SiRNA target sequence
aagtttaaatttatctaataa

SEQ ID NO: 55661 - DNA, 21 bp, Artificial sequence
  SiRNA target sequence
agtttaaatttatctaataat

SEQ ID NO: 55662 - DNA, 21 bp, Artificial sequence
  SiRNA target sequence
gtttaaatttatctaataatc

SEQ ID NO: 55663 - DNA, 21 bp, Artificial sequence
  SiRNA target sequence
tttaaatttatctaataatct

SEQ ID NO: 55664 - DNA, 21 bp, Artificial sequence
  SiRNA target sequence
ttaaatttatctaataatcta

SEQ ID NO: 55665 - DNA, 21 bp, Artificial sequence
  SiRNA target sequence
taaatttatctaataatctaa

SEQ ID NO: 55666 - DNA, 21 bp, Artificial sequence
  SiRNA target sequence
aaatttatctaataatctaaa

SEQ ID NO: 55667 - DNA, 21 bp, Artificial sequence
  SiRNA target sequence
aatttatctaataatctaaaa

SEQ ID NO: 55668 - DNA, 21 bp, Artificial sequence
  SiRNA target sequence
atttatctaataatctaaaaa

SEQ ID NO: 55669 - DNA, 21 bp, Artificial sequence
  SiRNA target sequence
tttatctaataatctaaaaac

SEQ ID NO: 55670 - DNA, 21 bp, Artificial sequence
  SiRNA target sequence
ttatctaataatctaaaaact

SEQ ID NO: 55671 - DNA, 21 bp, Artificial sequence
  SiRNA target sequence
tatctaataatctaaaaacta

SEQ ID NO: 55672 - DNA, 21 bp, Artificial sequence
  SiRNA target sequence
atctaataatctaaaaactat

SEQ ID NO: 55673 - DNA, 21 bp, Artificial sequence
  SiRNA target sequence
tctaataatctaaaaactatg

SEQ ID NO: 55674 - DNA, 21 bp, Artificial sequence
  SiRNA target sequence
ctaataatctaaaaactatgg

SEQ ID NO: 55675 - DNA, 21 bp, Artificial sequence
  SiRNA target sequence
taataatctaaaaactatggt

SEQ ID NO: 55676 - DNA, 21 bp, Artificial sequence
  SiRNA target sequence
aataatctaaaaactatggtt

SEQ ID NO: 55677 - DNA, 21 bp, Artificial sequence
  SiRNA target sequence
ataatctaaaaactatggttt

SEQ ID NO: 55678 - DNA, 21 bp, Artificial sequence
  SiRNA target sequence
taatctaaaaactatggtttt

SEQ ID NO: 55679 - DNA, 21 bp, Artificial sequence
  SiRNA target sequence
aatctaaaaactatggttttg

SEQ ID NO: 55680 - DNA, 21 bp, Artificial sequence
  SiRNA target sequence
atctaaaaactatggttttgt

SEQ ID NO: 55681 - DNA, 21 bp, Artificial sequence
  SiRNA target sequence
tctaaaaactatggttttgtc

SEQ ID NO: 55682 - DNA, 21 bp, Artificial sequence
  SiRNA target sequence
ctaaaaactatggttttgtct

SEQ ID NO: 55683 - DNA, 21 bp, Artificial sequence
  SiRNA target sequence
taaaaactatggttttgtctg

SEQ ID NO: 55684 - DNA, 21 bp, Artificial sequence
  SiRNA target sequence
aaaaactatggttttgtctgg

SEQ ID NO: 55685 - DNA, 21 bp, Artificial sequence
  SiRNA target sequence
aaaactatggttttgtctgga

SEQ ID NO: 55686 - DNA, 21 bp, Artificial sequence
  SiRNA target sequence
aaactatggttttgtctggat

SEQ ID NO: 55687 - DNA, 21 bp, Artificial sequence
  SiRNA target sequence
aactatggttttgtctggatc

SEQ ID NO: 55688 - DNA, 21 bp, Artificial sequence
  SiRNA target sequence
actatggttttgtctggatca

SEQ ID NO: 55689 - DNA, 21 bp, Artificial sequence
  SiRNA target sequence
ctatggttttgtctggatcaa

SEQ ID NO: 55690 - DNA, 21 bp, Artificial sequence
  SiRNA target sequence
tatggttttgtctggatcaaa

SEQ ID NO: 55691 - DNA, 21 bp, Artificial sequence
  SiRNA target sequence
atggttttgtctggatcaaaa

SEQ ID NO: 55692 - DNA, 21 bp, Artificial sequence
  SiRNA target sequence
tggttttgtctggatcaaaag

SEQ ID NO: 55693 - DNA, 21 bp, Artificial sequence
  SiRNA target sequence
ggttttgtctggatcaaaagg

SEQ ID NO: 55694 - DNA, 21 bp, Artificial sequence
  SiRNA target sequence
gttttgtctggatcaaaaggt

SEQ ID NO: 55695 - DNA, 21 bp, Artificial sequence
  SiRNA target sequence
ttttgtctggatcaaaaggtt

SEQ ID NO: 55696 - DNA, 21 bp, Artificial sequence
  SiRNA target sequence
tttgtctggatcaaaaggttc

SEQ ID NO: 55697 - DNA, 21 bp, Artificial sequence
  SiRNA target sequence
ttgtctggatcaaaaggttca

SEQ ID NO: 55698 - DNA, 21 bp, Artificial sequence
  SiRNA target sequence
tgtctggatcaaaaggttcat

SEQ ID NO: 55699 - DNA, 21 bp, Artificial sequence
  SiRNA target sequence
gtctggatcaaaaggttcatt

SEQ ID NO: 55700 - DNA, 21 bp, Artificial sequence
  SiRNA target sequence
tctggatcaaaaggttcattt

SEQ ID NO: 55701 - DNA, 21 bp, Artificial sequence
  SiRNA target sequence
ctggatcaaaaggttcattta

SEQ ID NO: 55702 - DNA, 21 bp, Artificial sequence
  SiRNA target sequence
tggatcaaaaggttcatttat

SEQ ID NO: 55703 - DNA, 21 bp, Artificial sequence
  SiRNA target sequence
ggatcaaaaggttcatttatc

SEQ ID NO: 55704 - DNA, 21 bp, Artificial sequence
  SiRNA target sequence
gatcaaaaggttcatttatca

SEQ ID NO: 55705 - DNA, 21 bp, Artificial sequence
  SiRNA target sequence
atcaaaaggttcatttatcaa

SEQ ID NO: 55706 - DNA, 21 bp, Artificial sequence
  SiRNA target sequence
tcaaaaggttcatttatcaat

SEQ ID NO: 55707 - DNA, 21 bp, Artificial sequence
  SiRNA target sequence
caaaaggttcatttatcaata

SEQ ID NO: 55708 - DNA, 21 bp, Artificial sequence
  SiRNA target sequence
aaaaggttcatttatcaatat

SEQ ID NO: 55709 - DNA, 21 bp, Artificial sequence
  SiRNA target sequence
aaaggttcatttatcaatatt

SEQ ID NO: 55710 - DNA, 21 bp, Artificial sequence
  SiRNA target sequence
aaggttcatttatcaatattt

SEQ ID NO: 55711 - DNA, 21 bp, Artificial sequence
  SiRNA target sequence
aggttcatttatcaatatttc

SEQ ID NO: 55712 - DNA, 21 bp, Artificial sequence
  SiRNA target sequence
ggttcatttatcaatatttca

SEQ ID NO: 55713 - DNA, 21 bp, Artificial sequence
  SiRNA target sequence
gttcatttatcaatatttcac

SEQ ID NO: 55714 - DNA, 21 bp, Artificial sequence
  SiRNA target sequence
ttcatttatcaatatttcaca

SEQ ID NO: 55715 - DNA, 21 bp, Artificial sequence
  SiRNA target sequence
tcatttatcaatatttcacag

SEQ ID NO: 55716 - DNA, 21 bp, Artificial sequence
  SiRNA target sequence
catttatcaatatttcacagg

SEQ ID NO: 55717 - DNA, 21 bp, Artificial sequence
  SiRNA target sequence
atttatcaatatttcacaggt

SEQ ID NO: 55718 - DNA, 21 bp, Artificial sequence
  SiRNA target sequence
tttatcaatatttcacaggta

SEQ ID NO: 55719 - DNA, 21 bp, Artificial sequence
  SiRNA target sequence
ttatcaatatttcacaggtaa

SEQ ID NO: 55720 - DNA, 21 bp, Artificial sequence
  SiRNA target sequence
tatcaatatttcacaggtaat

SEQ ID NO: 55721 - DNA, 21 bp, Artificial sequence
  SiRNA target sequence
atcaatatttcacaggtaatg

SEQ ID NO: 55722 - DNA, 21 bp, Artificial sequence
  SiRNA target sequence
tcaatatttcacaggtaatgg

SEQ ID NO: 55723 - DNA, 21 bp, Artificial sequence
  SiRNA target sequence
caatatttcacaggtaatggc

SEQ ID NO: 55724 - DNA, 21 bp, Artificial sequence
  SiRNA target sequence
aatatttcacaggtaatggct

SEQ ID NO: 55725 - DNA, 21 bp, Artificial sequence
  SiRNA target sequence
atatttcacaggtaatggctt

SEQ ID NO: 55726 - DNA, 21 bp, Artificial sequence
  SiRNA target sequence
tatttcacaggtaatggcttg

SEQ ID NO: 55727 - DNA, 21 bp, Artificial sequence
  SiRNA target sequence
atttcacaggtaatggcttgt

SEQ ID NO: 55728 - DNA, 21 bp, Artificial sequence
  SiRNA target sequence
tttcacaggtaatggcttgtg

SEQ ID NO: 55729 - DNA, 21 bp, Artificial sequence
  SiRNA target sequence
ttcacaggtaatggcttgtgt

SEQ ID NO: 55730 - DNA, 21 bp, Artificial sequence
  SiRNA target sequence
tcacaggtaatggcttgtgta

SEQ ID NO: 55731 - DNA, 21 bp, Artificial sequence
  SiRNA target sequence
cacaggtaatggcttgtgtag

SEQ ID NO: 55732 - DNA, 21 bp, Artificial sequence
  SiRNA target sequence
acaggtaatggcttgtgtagg

SEQ ID NO: 55733 - DNA, 21 bp, Artificial sequence
  SiRNA target sequence
caggtaatggcttgtgtaggt

SEQ ID NO: 55734 - DNA, 21 bp, Artificial sequence
  SiRNA target sequence
aggtaatggcttgtgtaggtc

SEQ ID NO: 55735 - DNA, 21 bp, Artificial sequence
  SiRNA target sequence
ggtaatggcttgtgtaggtca

SEQ ID NO: 55736 - DNA, 21 bp, Artificial sequence
  SiRNA target sequence
gtaatggcttgtgtaggtcag

SEQ ID NO: 55737 - DNA, 21 bp, Artificial sequence
  SiRNA target sequence
taatggcttgtgtaggtcagc

SEQ ID NO: 55738 - DNA, 21 bp, Artificial sequence
  SiRNA target sequence
aatggcttgtgtaggtcagca

SEQ ID NO: 55739 - DNA, 21 bp, Artificial sequence
  SiRNA target sequence
atggcttgtgtaggtcagcaa

SEQ ID NO: 55740 - DNA, 21 bp, Artificial sequence
  SiRNA target sequence
tggcttgtgtaggtcagcaaa

SEQ ID NO: 55741 - DNA, 21 bp, Artificial sequence
  SiRNA target sequence
ggcttgtgtaggtcagcaaaa

SEQ ID NO: 55742 - DNA, 21 bp, Artificial sequence
  SiRNA target sequence
gcttgtgtaggtcagcaaaat

SEQ ID NO: 55743 - DNA, 21 bp, Artificial sequence
  SiRNA target sequence
cttgtgtaggtcagcaaaatg

SEQ ID NO: 55744 - DNA, 21 bp, Artificial sequence
  SiRNA target sequence
ttgtgtaggtcagcaaaatgt

SEQ ID NO: 55745 - DNA, 21 bp, Artificial sequence
  SiRNA target sequence
tgtgtaggtcagcaaaatgtt

SEQ ID NO: 55746 - DNA, 21 bp, Artificial sequence
  SiRNA target sequence
gtgtaggtcagcaaaatgttg

SEQ ID NO: 55747 - DNA, 21 bp, Artificial sequence
  SiRNA target sequence
tgtaggtcagcaaaatgttga

SEQ ID NO: 55748 - DNA, 21 bp, Artificial sequence
  SiRNA target sequence
gtaggtcagcaaaatgttgaa

SEQ ID NO: 55749 - DNA, 21 bp, Artificial sequence
  SiRNA target sequence
taggtcagcaaaatgttgaag

SEQ ID NO: 55750 - DNA, 21 bp, Artificial sequence
  SiRNA target sequence
aggtcagcaaaatgttgaagg

SEQ ID NO: 55751 - DNA, 21 bp, Artificial sequence
  SiRNA target sequence
ggtcagcaaaatgttgaagga

SEQ ID NO: 55752 - DNA, 21 bp, Artificial sequence
  SiRNA target sequence
gtcagcaaaatgttgaaggaa

SEQ ID NO: 55753 - DNA, 21 bp, Artificial sequence
  SiRNA target sequence
tcagcaaaatgttgaaggaaa

SEQ ID NO: 55754 - DNA, 21 bp, Artificial sequence
  SiRNA target sequence
cagcaaaatgttgaaggaaaa

SEQ ID NO: 55755 - DNA, 21 bp, Artificial sequence
  SiRNA target sequence
agcaaaatgttgaaggaaaac

SEQ ID NO: 55756 - DNA, 21 bp, Artificial sequence
  SiRNA target sequence
gcaaaatgttgaaggaaaacg

SEQ ID NO: 55757 - DNA, 21 bp, Artificial sequence
  SiRNA target sequence
caaaatgttgaaggaaaacga

SEQ ID NO: 55758 - DNA, 21 bp, Artificial sequence
  SiRNA target sequence
aaaatgttgaaggaaaacgaa

SEQ ID NO: 55759 - DNA, 21 bp, Artificial sequence
  SiRNA target sequence
aaatgttgaaggaaaacgaat

SEQ ID NO: 55760 - DNA, 21 bp, Artificial sequence
  SiRNA target sequence
aatgttgaaggaaaacgaatt

SEQ ID NO: 55761 - DNA, 21 bp, Artificial sequence
  SiRNA target sequence
atgttgaaggaaaacgaattc

SEQ ID NO: 55762 - DNA, 21 bp, Artificial sequence
  SiRNA target sequence
tgttgaaggaaaacgaattcc

SEQ ID NO: 55763 - DNA, 21 bp, Artificial sequence
  SiRNA target sequence
gttgaaggaaaacgaattcct

SEQ ID NO: 55764 - DNA, 21 bp, Artificial sequence
  SiRNA target sequence
ttgaaggaaaacgaattcctt

SEQ ID NO: 55765 - DNA, 21 bp, Artificial sequence
  SiRNA target sequence
tgaaggaaaacgaattccttt

SEQ ID NO: 55766 - DNA, 21 bp, Artificial sequence
  SiRNA target sequence
gaaggaaaacgaattcctttt

SEQ ID NO: 55767 - DNA, 21 bp, Artificial sequence
  SiRNA target sequence
aaggaaaacgaattccttttg

SEQ ID NO: 55768 - DNA, 21 bp, Artificial sequence
  SiRNA target sequence
aggaaaacgaattccttttgg

SEQ ID NO: 55769 - DNA, 21 bp, Artificial sequence
  SiRNA target sequence
ggaaaacgaattccttttgga

SEQ ID NO: 55770 - DNA, 21 bp, Artificial sequence
  SiRNA target sequence
gaaaacgaattccttttggat

SEQ ID NO: 55771 - DNA, 21 bp, Artificial sequence
  SiRNA target sequence
aaaacgaattccttttggatt

SEQ ID NO: 55772 - DNA, 21 bp, Artificial sequence
  SiRNA target sequence
aaacgaattccttttggattc

SEQ ID NO: 55773 - DNA, 21 bp, Artificial sequence
  SiRNA target sequence
aacgaattccttttggattca

SEQ ID NO: 55774 - DNA, 21 bp, Artificial sequence
  SiRNA target sequence
acgaattccttttggattcaa

SEQ ID NO: 55775 - DNA, 21 bp, Artificial sequence
  SiRNA target sequence
cgaattccttttggattcaaa

SEQ ID NO: 55776 - DNA, 21 bp, Artificial sequence
  SiRNA target sequence
gaattccttttggattcaaat

SEQ ID NO: 55777 - DNA, 21 bp, Artificial sequence
  SiRNA target sequence
aattccttttggattcaaata

SEQ ID NO: 55778 - DNA, 21 bp, Artificial sequence
  SiRNA target sequence
attccttttggattcaaatat

SEQ ID NO: 55779 - DNA, 21 bp, Artificial sequence
  SiRNA target sequence
ttccttttggattcaaatatc

SEQ ID NO: 55780 - DNA, 21 bp, Artificial sequence
  SiRNA target sequence
tccttttggattcaaatatcg

SEQ ID NO: 55781 - DNA, 21 bp, Artificial sequence
  SiRNA target sequence
ccttttggattcaaatatcga

SEQ ID NO: 55782 - DNA, 21 bp, Artificial sequence
  SiRNA target sequence
cttttggattcaaatatcgaa

SEQ ID NO: 55783 - DNA, 21 bp, Artificial sequence
  SiRNA target sequence
ttttggattcaaatatcgaac

SEQ ID NO: 55784 - DNA, 21 bp, Artificial sequence
  SiRNA target sequence
tttggattcaaatatcgaact

SEQ ID NO: 55785 - DNA, 21 bp, Artificial sequence
  SiRNA target sequence
ttggattcaaatatcgaactc

SEQ ID NO: 55786 - DNA, 21 bp, Artificial sequence
  SiRNA target sequence
tggattcaaatatcgaactct

SEQ ID NO: 55787 - DNA, 21 bp, Artificial sequence
  SiRNA target sequence
ggattcaaatatcgaactcta

SEQ ID NO: 55788 - DNA, 21 bp, Artificial sequence
  SiRNA target sequence
gattcaaatatcgaactctac

SEQ ID NO: 55789 - DNA, 21 bp, Artificial sequence
  SiRNA target sequence
attcaaatatcgaactctacc

SEQ ID NO: 55790 - DNA, 21 bp, Artificial sequence
  SiRNA target sequence
ttcaaatatcgaactctacca

SEQ ID NO: 55791 - DNA, 21 bp, Artificial sequence
  SiRNA target sequence
tcaaatatcgaactctaccac

SEQ ID NO: 55792 - DNA, 21 bp, Artificial sequence
  SiRNA target sequence
caaatatcgaactctaccaca

SEQ ID NO: 55793 - DNA, 21 bp, Artificial sequence
  SiRNA target sequence
aaatatcgaactctaccacat

SEQ ID NO: 55794 - DNA, 21 bp, Artificial sequence
  SiRNA target sequence
aatatcgaactctaccacatt

SEQ ID NO: 55795 - DNA, 21 bp, Artificial sequence
  SiRNA target sequence
atatcgaactctaccacattt

SEQ ID NO: 55796 - DNA, 21 bp, Artificial sequence
  SiRNA target sequence
tatcgaactctaccacatttt

SEQ ID NO: 55797 - DNA, 21 bp, Artificial sequence
  SiRNA target sequence
atcgaactctaccacattttt

SEQ ID NO: 55798 - DNA, 21 bp, Artificial sequence
  SiRNA target sequence
tcgaactctaccacatttttt

SEQ ID NO: 55799 - DNA, 21 bp, Artificial sequence
  SiRNA target sequence
cgaactctaccacattttttg

SEQ ID NO: 55800 - DNA, 21 bp, Artificial sequence
  SiRNA target sequence
gaactctaccacattttttga

SEQ ID NO: 55801 - DNA, 21 bp, Artificial sequence
  SiRNA target sequence
aactctaccacattttttgaa

SEQ ID NO: 55802 - DNA, 21 bp, Artificial sequence
  SiRNA target sequence
actctaccacattttttgaaa

SEQ ID NO: 55803 - DNA, 21 bp, Artificial sequence
  SiRNA target sequence
ctctaccacattttttgaaag

SEQ ID NO: 55804 - DNA, 21 bp, Artificial sequence
  SiRNA target sequence
tctaccacattttttgaaaga

SEQ ID NO: 55805 - DNA, 21 bp, Artificial sequence
  SiRNA target sequence
ctaccacattttttgaaagaa

SEQ ID NO: 55806 - DNA, 21 bp, Artificial sequence
  SiRNA target sequence
taccacattttttgaaagaag

SEQ ID NO: 55807 - DNA, 21 bp, Artificial sequence
  SiRNA target sequence
accacattttttgaaagaaga

SEQ ID NO: 55808 - DNA, 21 bp, Artificial sequence
  SiRNA target sequence
ccacattttttgaaagaagat

SEQ ID NO: 55809 - DNA, 21 bp, Artificial sequence
  SiRNA target sequence
cacattttttgaaagaagatt

SEQ ID NO: 55810 - DNA, 21 bp, Artificial sequence
  SiRNA target sequence
acattttttgaaagaagatta

SEQ ID NO: 55811 - DNA, 21 bp, Artificial sequence
  SiRNA target sequence
cattttttgaaagaagattat

SEQ ID NO: 55812 - DNA, 21 bp, Artificial sequence
  SiRNA target sequence
attttttgaaagaagattatt

SEQ ID NO: 55813 - DNA, 21 bp, Artificial sequence
  SiRNA target sequence
ttttttgaaagaagattattc

SEQ ID NO: 55814 - DNA, 21 bp, Artificial sequence
  SiRNA target sequence
tttttgaaagaagattattct

SEQ ID NO: 55815 - DNA, 21 bp, Artificial sequence
  SiRNA target sequence
ttttgaaagaagattattctg

SEQ ID NO: 55816 - DNA, 21 bp, Artificial sequence
  SiRNA target sequence
tttgaaagaagattattctgg

SEQ ID NO: 55817 - DNA, 21 bp, Artificial sequence
  SiRNA target sequence
ttgaaagaagattattctgga

SEQ ID NO: 55818 - DNA, 21 bp, Artificial sequence
  SiRNA target sequence
tgaaagaagattattctggaa

SEQ ID NO: 55819 - DNA, 21 bp, Artificial sequence
  SiRNA target sequence
gaaagaagattattctggaaa

SEQ ID NO: 55820 - DNA, 21 bp, Artificial sequence
  SiRNA target sequence
aaagaagattattctggaaaa

SEQ ID NO: 55821 - DNA, 21 bp, Artificial sequence
  SiRNA target sequence
aagaagattattctggaaaaa

SEQ ID NO: 55822 - DNA, 21 bp, Artificial sequence
  SiRNA target sequence
agaagattattctggaaaaag

SEQ ID NO: 55823 - DNA, 21 bp, Artificial sequence
  SiRNA target sequence
gaagattattctggaaaaagt

SEQ ID NO: 55824 - DNA, 21 bp, Artificial sequence
  SiRNA target sequence
aagattattctggaaaaagtc

SEQ ID NO: 55825 - DNA, 21 bp, Artificial sequence
  SiRNA target sequence
agattattctggaaaaagtcg

SEQ ID NO: 55826 - DNA, 21 bp, Artificial sequence
  SiRNA target sequence
gattattctggaaaaagtcgt

SEQ ID NO: 55827 - DNA, 21 bp, Artificial sequence
  SiRNA target sequence
attattctggaaaaagtcgtg

SEQ ID NO: 55828 - DNA, 21 bp, Artificial sequence
  SiRNA target sequence
ttattctggaaaaagtcgtgg

SEQ ID NO: 55829 - DNA, 21 bp, Artificial sequence
  SiRNA target sequence
tattctggaaaaagtcgtggt

SEQ ID NO: 55830 - DNA, 21 bp, Artificial sequence
  SiRNA target sequence
attctggaaaaagtcgtggtt

SEQ ID NO: 55831 - DNA, 21 bp, Artificial sequence
  SiRNA target sequence
ttctggaaaaagtcgtggttt

SEQ ID NO: 55832 - DNA, 21 bp, Artificial sequence
  SiRNA target sequence
tctggaaaaagtcgtggtttt

SEQ ID NO: 55833 - DNA, 21 bp, Artificial sequence
  SiRNA target sequence
ctggaaaaagtcgtggttttg

SEQ ID NO: 55834 - DNA, 21 bp, Artificial sequence
  SiRNA target sequence
tggaaaaagtcgtggttttgt

SEQ ID NO: 55835 - DNA, 21 bp, Artificial sequence
  SiRNA target sequence
ggaaaaagtcgtggttttgta

SEQ ID NO: 55836 - DNA, 21 bp, Artificial sequence
  SiRNA target sequence
gaaaaagtcgtggttttgtag

SEQ ID NO: 55837 - DNA, 21 bp, Artificial sequence
  SiRNA target sequence
aaaaagtcgtggttttgtaga

SEQ ID NO: 55838 - DNA, 21 bp, Artificial sequence
  SiRNA target sequence
aaaagtcgtggttttgtagaa

SEQ ID NO: 55839 - DNA, 21 bp, Artificial sequence
  SiRNA target sequence
aaagtcgtggttttgtagaaa

SEQ ID NO: 55840 - DNA, 21 bp, Artificial sequence
  SiRNA target sequence
aagtcgtggttttgtagaaaa

SEQ ID NO: 55841 - DNA, 21 bp, Artificial sequence
  SiRNA target sequence
agtcgtggttttgtagaaaac

SEQ ID NO: 55842 - DNA, 21 bp, Artificial sequence
  SiRNA target sequence
gtcgtggttttgtagaaaaca

SEQ ID NO: 55843 - DNA, 21 bp, Artificial sequence
  SiRNA target sequence
tcgtggttttgtagaaaacag

SEQ ID NO: 55844 - DNA, 21 bp, Artificial sequence
  SiRNA target sequence
cgtggttttgtagaaaacagt

SEQ ID NO: 55845 - DNA, 21 bp, Artificial sequence
  SiRNA target sequence
gtggttttgtagaaaacagtt

SEQ ID NO: 55846 - DNA, 21 bp, Artificial sequence
  SiRNA target sequence
tggttttgtagaaaacagtta

SEQ ID NO: 55847 - DNA, 21 bp, Artificial sequence
  SiRNA target sequence
ggttttgtagaaaacagttat

SEQ ID NO: 55848 - DNA, 21 bp, Artificial sequence
  SiRNA target sequence
gttttgtagaaaacagttatg

SEQ ID NO: 55849 - DNA, 21 bp, Artificial sequence
  SiRNA target sequence
ttttgtagaaaacagttatgt

SEQ ID NO: 55850 - DNA, 21 bp, Artificial sequence
  SiRNA target sequence
tttgtagaaaacagttatgtt

SEQ ID NO: 55851 - DNA, 21 bp, Artificial sequence
  SiRNA target sequence
ttgtagaaaacagttatgtta

SEQ ID NO: 55852 - DNA, 21 bp, Artificial sequence
  SiRNA target sequence
tgtagaaaacagttatgttaa

SEQ ID NO: 55853 - DNA, 21 bp, Artificial sequence
  SiRNA target sequence
gtagaaaacagttatgttaaa

SEQ ID NO: 55854 - DNA, 21 bp, Artificial sequence
  SiRNA target sequence
tagaaaacagttatgttaaag

SEQ ID NO: 55855 - DNA, 21 bp, Artificial sequence
  SiRNA target sequence
agaaaacagttatgttaaagg

SEQ ID NO: 55856 - DNA, 21 bp, Artificial sequence
  SiRNA target sequence
gaaaacagttatgttaaaggt

SEQ ID NO: 55857 - DNA, 21 bp, Artificial sequence
  SiRNA target sequence
aaaacagttatgttaaaggtt

SEQ ID NO: 55858 - DNA, 21 bp, Artificial sequence
  SiRNA target sequence
aaacagttatgttaaaggttt

SEQ ID NO: 55859 - DNA, 21 bp, Artificial sequence
  SiRNA target sequence
aacagttatgttaaaggttta

SEQ ID NO: 55860 - DNA, 21 bp, Artificial sequence
  SiRNA target sequence
acagttatgttaaaggtttat

SEQ ID NO: 55861 - DNA, 21 bp, Artificial sequence
  SiRNA target sequence
cagttatgttaaaggtttatc

SEQ ID NO: 55862 - DNA, 21 bp, Artificial sequence
  SiRNA target sequence
agttatgttaaaggtttatca

SEQ ID NO: 55863 - DNA, 21 bp, Artificial sequence
  SiRNA target sequence
gttatgttaaaggtttatcac

SEQ ID NO: 55864 - DNA, 21 bp, Artificial sequence
  SiRNA target sequence
ttatgttaaaggtttatcacc

SEQ ID NO: 55865 - DNA, 21 bp, Artificial sequence
  SiRNA target sequence
tatgttaaaggtttatcacct

SEQ ID NO: 55866 - DNA, 21 bp, Artificial sequence
  SiRNA target sequence
atgttaaaggtttatcacctg

SEQ ID NO: 55867 - DNA, 21 bp, Artificial sequence
  SiRNA target sequence
tgttaaaggtttatcacctga

SEQ ID NO: 55868 - DNA, 21 bp, Artificial sequence
  SiRNA target sequence
gttaaaggtttatcacctgaa

SEQ ID NO: 55869 - DNA, 21 bp, Artificial sequence
  SiRNA target sequence
ttaaaggtttatcacctgaag

SEQ ID NO: 55870 - DNA, 21 bp, Artificial sequence
  SiRNA target sequence
taaaggtttatcacctgaaga

SEQ ID NO: 55871 - DNA, 21 bp, Artificial sequence
  SiRNA target sequence
aaaggtttatcacctgaagaa

SEQ ID NO: 55872 - DNA, 21 bp, Artificial sequence
  SiRNA target sequence
aaggtttatcacctgaagaat

SEQ ID NO: 55873 - DNA, 21 bp, Artificial sequence
  SiRNA target sequence
aggtttatcacctgaagaatt

SEQ ID NO: 55874 - DNA, 21 bp, Artificial sequence
  SiRNA target sequence
ggtttatcacctgaagaattt

SEQ ID NO: 55875 - DNA, 21 bp, Artificial sequence
  SiRNA target sequence
gtttatcacctgaagaatttt

SEQ ID NO: 55876 - DNA, 21 bp, Artificial sequence
  SiRNA target sequence
tttatcacctgaagaatttta

SEQ ID NO: 55877 - DNA, 21 bp, Artificial sequence
  SiRNA target sequence
ttatcacctgaagaattttat

SEQ ID NO: 55878 - DNA, 21 bp, Artificial sequence
  SiRNA target sequence
tatcacctgaagaattttatt

SEQ ID NO: 55879 - DNA, 21 bp, Artificial sequence
  SiRNA target sequence
atcacctgaagaattttattt

SEQ ID NO: 55880 - DNA, 21 bp, Artificial sequence
  SiRNA target sequence
tcacctgaagaattttatttc

SEQ ID NO: 55881 - DNA, 21 bp, Artificial sequence
  SiRNA target sequence
cacctgaagaattttatttcc

SEQ ID NO: 55882 - DNA, 21 bp, Artificial sequence
  SiRNA target sequence
acctgaagaattttatttcca

SEQ ID NO: 55883 - DNA, 21 bp, Artificial sequence
  SiRNA target sequence
cctgaagaattttatttccat

SEQ ID NO: 55884 - DNA, 21 bp, Artificial sequence
  SiRNA target sequence
ctgaagaattttatttccatg

SEQ ID NO: 55885 - DNA, 21 bp, Artificial sequence
  SiRNA target sequence
tgaagaattttatttccatgc

SEQ ID NO: 55886 - DNA, 21 bp, Artificial sequence
  SiRNA target sequence
gaagaattttatttccatgcc

SEQ ID NO: 55887 - DNA, 21 bp, Artificial sequence
  SiRNA target sequence
aagaattttatttccatgcca

SEQ ID NO: 55888 - DNA, 21 bp, Artificial sequence
  SiRNA target sequence
agaattttatttccatgccat

SEQ ID NO: 55889 - DNA, 21 bp, Artificial sequence
  SiRNA target sequence
gaattttatttccatgccatg

SEQ ID NO: 55890 - DNA, 21 bp, Artificial sequence
  SiRNA target sequence
aattttatttccatgccatgg

SEQ ID NO: 55891 - DNA, 21 bp, Artificial sequence
  SiRNA target sequence
attttatttccatgccatggg

SEQ ID NO: 55892 - DNA, 21 bp, Artificial sequence
  SiRNA target sequence
ttttatttccatgccatgggt

SEQ ID NO: 55893 - DNA, 21 bp, Artificial sequence
  SiRNA target sequence
tttatttccatgccatgggtg

SEQ ID NO: 55894 - DNA, 21 bp, Artificial sequence
  SiRNA target sequence
ttatttccatgccatgggtgg

SEQ ID NO: 55895 - DNA, 21 bp, Artificial sequence
  SiRNA target sequence
tatttccatgccatgggtggt

SEQ ID NO: 55896 - DNA, 21 bp, Artificial sequence
  SiRNA target sequence
atttccatgccatgggtggtc

SEQ ID NO: 55897 - DNA, 21 bp, Artificial sequence
  SiRNA target sequence
tttccatgccatgggtggtcg

SEQ ID NO: 55898 - DNA, 21 bp, Artificial sequence
  SiRNA target sequence
ttccatgccatgggtggtcgt

SEQ ID NO: 55899 - DNA, 21 bp, Artificial sequence
  SiRNA target sequence
tccatgccatgggtggtcgtg

SEQ ID NO: 55900 - DNA, 21 bp, Artificial sequence
  SiRNA target sequence
ccatgccatgggtggtcgtga

SEQ ID NO: 55901 - DNA, 21 bp, Artificial sequence
  SiRNA target sequence
catgccatgggtggtcgtgaa

SEQ ID NO: 55902 - DNA, 21 bp, Artificial sequence
  SiRNA target sequence
atgccatgggtggtcgtgaag

SEQ ID NO: 55903 - DNA, 21 bp, Artificial sequence
  SiRNA target sequence
tgccatgggtggtcgtgaagg

SEQ ID NO: 55904 - DNA, 21 bp, Artificial sequence
  SiRNA target sequence
gccatgggtggtcgtgaagga

SEQ ID NO: 55905 - DNA, 21 bp, Artificial sequence
  SiRNA target sequence
ccatgggtggtcgtgaaggat

SEQ ID NO: 55906 - DNA, 21 bp, Artificial sequence
  SiRNA target sequence
catgggtggtcgtgaaggatt

SEQ ID NO: 55907 - DNA, 21 bp, Artificial sequence
  SiRNA target sequence
atgggtggtcgtgaaggatta

SEQ ID NO: 55908 - DNA, 21 bp, Artificial sequence
  SiRNA target sequence
tgggtggtcgtgaaggattaa

SEQ ID NO: 55909 - DNA, 21 bp, Artificial sequence
  SiRNA target sequence
gggtggtcgtgaaggattaat

SEQ ID NO: 55910 - DNA, 21 bp, Artificial sequence
  SiRNA target sequence
ggtggtcgtgaaggattaatt

SEQ ID NO: 55911 - DNA, 21 bp, Artificial sequence
  SiRNA target sequence
gtggtcgtgaaggattaattg

SEQ ID NO: 55912 - DNA, 21 bp, Artificial sequence
  SiRNA target sequence
tggtcgtgaaggattaattga

SEQ ID NO: 55913 - DNA, 21 bp, Artificial sequence
  SiRNA target sequence
ggtcgtgaaggattaattgat

SEQ ID NO: 55914 - DNA, 21 bp, Artificial sequence
  SiRNA target sequence
gtcgtgaaggattaattgata

SEQ ID NO: 55915 - DNA, 21 bp, Artificial sequence
  SiRNA target sequence
tcgtgaaggattaattgatac

SEQ ID NO: 55916 - DNA, 21 bp, Artificial sequence
  SiRNA target sequence
cgtgaaggattaattgataca

SEQ ID NO: 55917 - DNA, 21 bp, Artificial sequence
  SiRNA target sequence
gtgaaggattaattgatacag

SEQ ID NO: 55918 - DNA, 21 bp, Artificial sequence
  SiRNA target sequence
tgaaggattaattgatacagc

SEQ ID NO: 55919 - DNA, 21 bp, Artificial sequence
  SiRNA target sequence
gaaggattaattgatacagct

SEQ ID NO: 55920 - DNA, 21 bp, Artificial sequence
  SiRNA target sequence
aaggattaattgatacagcta

SEQ ID NO: 55921 - DNA, 21 bp, Artificial sequence
  SiRNA target sequence
aggattaattgatacagctat

SEQ ID NO: 55922 - DNA, 21 bp, Artificial sequence
  SiRNA target sequence
ggattaattgatacagctatt

SEQ ID NO: 55923 - DNA, 21 bp, Artificial sequence
  SiRNA target sequence
gattaattgatacagctatta

SEQ ID NO: 55924 - DNA, 21 bp, Artificial sequence
  SiRNA target sequence
attaattgatacagctattaa

SEQ ID NO: 55925 - DNA, 21 bp, Artificial sequence
  SiRNA target sequence
ttaattgatacagctattaaa

SEQ ID NO: 55926 - DNA, 21 bp, Artificial sequence
  SiRNA target sequence
taattgatacagctattaaaa

SEQ ID NO: 55927 - DNA, 21 bp, Artificial sequence
  SiRNA target sequence
aattgatacagctattaaaac

SEQ ID NO: 55928 - DNA, 21 bp, Artificial sequence
  SiRNA target sequence
attgatacagctattaaaact

SEQ ID NO: 55929 - DNA, 21 bp, Artificial sequence
  SiRNA target sequence
ttgatacagctattaaaactg

SEQ ID NO: 55930 - DNA, 21 bp, Artificial sequence
  SiRNA target sequence
tgatacagctattaaaactgc

SEQ ID NO: 55931 - DNA, 21 bp, Artificial sequence
  SiRNA target sequence
gatacagctattaaaactgca

SEQ ID NO: 55932 - DNA, 21 bp, Artificial sequence
  SiRNA target sequence
atacagctattaaaactgcag

SEQ ID NO: 55933 - DNA, 21 bp, Artificial sequence
  SiRNA target sequence
tacagctattaaaactgcaga

SEQ ID NO: 55934 - DNA, 21 bp, Artificial sequence
  SiRNA target sequence
acagctattaaaactgcagaa

SEQ ID NO: 55935 - DNA, 21 bp, Artificial sequence
  SiRNA target sequence
cagctattaaaactgcagaaa

SEQ ID NO: 55936 - DNA, 21 bp, Artificial sequence
  SiRNA target sequence
agctattaaaactgcagaaac

SEQ ID NO: 55937 - DNA, 21 bp, Artificial sequence
  SiRNA target sequence
tgccgacgatgtgatatgaga

SEQ ID NO: 55938 - DNA, 21 bp, Artificial sequence
  SiRNA target sequence
gccgacgatgtgatatgagat

SEQ ID NO: 55939 - DNA, 21 bp, Artificial sequence
  SiRNA target sequence
ccgacgatgtgatatgagatg

SEQ ID NO: 55940 - DNA, 21 bp, Artificial sequence
  SiRNA target sequence
cgacgatgtgatatgagatgt

SEQ ID NO: 55941 - DNA, 21 bp, Artificial sequence
  SiRNA target sequence
gacgatgtgatatgagatgtt

SEQ ID NO: 55942 - DNA, 21 bp, Artificial sequence
  SiRNA target sequence
acgatgtgatatgagatgttg

SEQ ID NO: 55943 - DNA, 21 bp, Artificial sequence
  SiRNA target sequence
cgatgtgatatgagatgttgt

SEQ ID NO: 55944 - DNA, 21 bp, Artificial sequence
  SiRNA target sequence
gatgtgatatgagatgttgta

SEQ ID NO: 55945 - DNA, 21 bp, Artificial sequence
  SiRNA target sequence
atgtgatatgagatgttgtat

SEQ ID NO: 55946 - DNA, 21 bp, Artificial sequence
  SiRNA target sequence
tgtgatatgagatgttgtatt

SEQ ID NO: 55947 - DNA, 21 bp, Artificial sequence
  SiRNA target sequence
gtgatatgagatgttgtatta

SEQ ID NO: 55948 - DNA, 21 bp, Artificial sequence
  SiRNA target sequence
tgatatgagatgttgtattac

SEQ ID NO: 55949 - DNA, 21 bp, Artificial sequence
  SiRNA target sequence
gatatgagatgttgtattaca

SEQ ID NO: 55950 - DNA, 21 bp, Artificial sequence
  SiRNA target sequence
atatgagatgttgtattacat

SEQ ID NO: 55951 - DNA, 21 bp, Artificial sequence
  SiRNA target sequence
tatgagatgttgtattacatt

SEQ ID NO: 55952 - DNA, 21 bp, Artificial sequence
  SiRNA target sequence
atgagatgttgtattacatta

SEQ ID NO: 55953 - DNA, 21 bp, Artificial sequence
  SiRNA target sequence
tgagatgttgtattacattat

SEQ ID NO: 55954 - DNA, 21 bp, Artificial sequence
  SiRNA target sequence
gagatgttgtattacattata

SEQ ID NO: 55955 - DNA, 21 bp, Artificial sequence
  SiRNA target sequence
agatgttgtattacattatag

SEQ ID NO: 55956 - DNA, 21 bp, Artificial sequence
  SiRNA target sequence
gatgttgtattacattataga

SEQ ID NO: 55957 - DNA, 21 bp, Artificial sequence
  SiRNA target sequence
atgttgtattacattatagaa

SEQ ID NO: 55958 - DNA, 21 bp, Artificial sequence
  SiRNA target sequence
tgttgtattacattatagaaa

SEQ ID NO: 55959 - DNA, 21 bp, Artificial sequence
  SiRNA target sequence
gttgtattacattatagaaat

SEQ ID NO: 55960 - DNA, 21 bp, Artificial sequence
  SiRNA target sequence
ttgtattacattatagaaatt

SEQ ID NO: 55961 - DNA, 21 bp, Artificial sequence
  SiRNA target sequence
tgtattacattatagaaatta

SEQ ID NO: 55962 - DNA, 21 bp, Artificial sequence
  SiRNA target sequence
gtattacattatagaaattag

SEQ ID NO: 55963 - DNA, 21 bp, Artificial sequence
  SiRNA target sequence
tattacattatagaaattaga

SEQ ID NO: 55964 - DNA, 21 bp, Artificial sequence
  SiRNA target sequence
attacattatagaaattagag

SEQ ID NO: 55965 - DNA, 21 bp, Artificial sequence
  SiRNA target sequence
ttacattatagaaattagagt

SEQ ID NO: 55966 - DNA, 21 bp, Artificial sequence
  SiRNA target sequence
tacattatagaaattagagtt

SEQ ID NO: 55967 - DNA, 21 bp, Artificial sequence
  SiRNA target sequence
acattatagaaattagagttt

SEQ ID NO: 55968 - DNA, 21 bp, Artificial sequence
  SiRNA target sequence
cattatagaaattagagtttt

SEQ ID NO: 55969 - DNA, 21 bp, Artificial sequence
  SiRNA target sequence
attatagaaattagagttttt

SEQ ID NO: 55970 - DNA, 21 bp, Artificial sequence
  SiRNA target sequence
ttatagaaattagagtttttt

SEQ ID NO: 55971 - DNA, 21 bp, Artificial sequence
  SiRNA target sequence
tatagaaattagagttttttg

SEQ ID NO: 55972 - DNA, 21 bp, Artificial sequence
  SiRNA target sequence
atagaaattagagttttttgg

SEQ ID NO: 55973 - DNA, 21 bp, Artificial sequence
  SiRNA target sequence
tagaaattagagttttttggc

SEQ ID NO: 55974 - DNA, 21 bp, Artificial sequence
  SiRNA target sequence
agaaattagagttttttggct

SEQ ID NO: 55975 - DNA, 21 bp, Artificial sequence
  SiRNA target sequence
gaaattagagttttttggctc

SEQ ID NO: 55976 - DNA, 21 bp, Artificial sequence
  SiRNA target sequence
aaattagagttttttggctct

SEQ ID NO: 55977 - DNA, 21 bp, Artificial sequence
  SiRNA target sequence
aattagagttttttggctctg

SEQ ID NO: 55978 - DNA, 21 bp, Artificial sequence
  SiRNA target sequence
attagagttttttggctctgg

SEQ ID NO: 55979 - DNA, 21 bp, Artificial sequence
  SiRNA target sequence
ttagagttttttggctctggg

SEQ ID NO: 55980 - DNA, 21 bp, Artificial sequence
  SiRNA target sequence
tagagttttttggctctgggg

SEQ ID NO: 55981 - DNA, 21 bp, Artificial sequence
  SiRNA target sequence
agagttttttggctctgggga

SEQ ID NO: 55982 - DNA, 21 bp, Artificial sequence
  SiRNA target sequence
gagttttttggctctggggat

SEQ ID NO: 55983 - DNA, 21 bp, Artificial sequence
  SiRNA target sequence
agttttttggctctggggata

SEQ ID NO: 55984 - DNA, 21 bp, Artificial sequence
  SiRNA target sequence
gttttttggctctggggatag

SEQ ID NO: 55985 - DNA, 21 bp, Artificial sequence
  SiRNA target sequence
ttttttggctctggggatagt

SEQ ID NO: 55986 - DNA, 21 bp, Artificial sequence
  SiRNA target sequence
tttttggctctggggatagta

SEQ ID NO: 55987 - DNA, 21 bp, Artificial sequence
  SiRNA target sequence
ttttggctctggggatagtat

SEQ ID NO: 55988 - DNA, 21 bp, Artificial sequence
  SiRNA target sequence
tttggctctggggatagtatg

SEQ ID NO: 55989 - DNA, 21 bp, Artificial sequence
  SiRNA target sequence
ttggctctggggatagtatga

SEQ ID NO: 55990 - DNA, 21 bp, Artificial sequence
  SiRNA target sequence
tggctctggggatagtatgat

SEQ ID NO: 55991 - DNA, 21 bp, Artificial sequence
  SiRNA target sequence
ggctctggggatagtatgatc

SEQ ID NO: 55992 - DNA, 21 bp, Artificial sequence
  SiRNA target sequence
gctctggggatagtatgatcg

SEQ ID NO: 55993 - DNA, 21 bp, Artificial sequence
  SiRNA target sequence
ctctggggatagtatgatcgc

SEQ ID NO: 55994 - DNA, 21 bp, Artificial sequence
  SiRNA target sequence
tctggggatagtatgatcgca

SEQ ID NO: 55995 - DNA, 21 bp, Artificial sequence
  SiRNA target sequence
ctggggatagtatgatcgcaa

SEQ ID NO: 55996 - DNA, 21 bp, Artificial sequence
  SiRNA target sequence
tggggatagtatgatcgcaag

SEQ ID NO: 55997 - DNA, 21 bp, Artificial sequence
  SiRNA target sequence
ggggatagtatgatcgcaaga

SEQ ID NO: 55998 - DNA, 21 bp, Artificial sequence
  SiRNA target sequence
gggatagtatgatcgcaagat

SEQ ID NO: 55999 - DNA, 21 bp, Artificial sequence
  SiRNA target sequence
ggatagtatgatcgcaagatt

SEQ ID NO: 56000 - DNA, 21 bp, Artificial sequence
  SiRNA target sequence
gatagtatgatcgcaagattg

SEQ ID NO: 56001 - DNA, 21 bp, Artificial sequence
  SiRNA target sequence
atagtatgatcgcaagattga

SEQ ID NO: 56002 - DNA, 21 bp, Artificial sequence
  SiRNA target sequence
tagtatgatcgcaagattgaa

SEQ ID NO: 56003 - DNA, 21 bp, Artificial sequence
  SiRNA target sequence
agtatgatcgcaagattgaaa

SEQ ID NO: 56004 - DNA, 21 bp, Artificial sequence
  SiRNA target sequence
gtatgatcgcaagattgaaaa

SEQ ID NO: 56005 - DNA, 21 bp, Artificial sequence
  SiRNA target sequence
tatgatcgcaagattgaaaat

SEQ ID NO: 56006 - DNA, 21 bp, Artificial sequence
  SiRNA target sequence
atgatcgcaagattgaaaatt

SEQ ID NO: 56007 - DNA, 21 bp, Artificial sequence
  SiRNA target sequence
tgatcgcaagattgaaaatta

SEQ ID NO: 56008 - DNA, 21 bp, Artificial sequence
  SiRNA target sequence
gatcgcaagattgaaaattaa

SEQ ID NO: 56009 - DNA, 21 bp, Artificial sequence
  SiRNA target sequence
atcgcaagattgaaaattaaa

SEQ ID NO: 56010 - DNA, 21 bp, Artificial sequence
  SiRNA target sequence
tcgcaagattgaaaattaaag

SEQ ID NO: 56011 - DNA, 21 bp, Artificial sequence
  SiRNA target sequence
cgcaagattgaaaattaaaga

SEQ ID NO: 56012 - DNA, 21 bp, Artificial sequence
  SiRNA target sequence
gcaagattgaaaattaaagaa

SEQ ID NO: 56013 - DNA, 21 bp, Artificial sequence
  SiRNA target sequence
caagattgaaaattaaagaaa

SEQ ID NO: 56014 - DNA, 21 bp, Artificial sequence
  SiRNA target sequence
aagattgaaaattaaagaaat

SEQ ID NO: 56015 - DNA, 21 bp, Artificial sequence
  SiRNA target sequence
agattgaaaattaaagaaatt

SEQ ID NO: 56016 - DNA, 21 bp, Artificial sequence
  SiRNA target sequence
gattgaaaattaaagaaattg

SEQ ID NO: 56017 - DNA, 21 bp, Artificial sequence
  SiRNA target sequence
attgaaaattaaagaaattga

SEQ ID NO: 56018 - DNA, 21 bp, Artificial sequence
  SiRNA target sequence
ttgaaaattaaagaaattgac

SEQ ID NO: 56019 - DNA, 21 bp, Artificial sequence
  SiRNA target sequence
tgaaaattaaagaaattgacg

SEQ ID NO: 56020 - DNA, 21 bp, Artificial sequence
  SiRNA target sequence
gaaaattaaagaaattgacgg

SEQ ID NO: 56021 - DNA, 21 bp, Artificial sequence
  SiRNA target sequence
aaaattaaagaaattgacgga

SEQ ID NO: 56022 - DNA, 21 bp, Artificial sequence
  SiRNA target sequence
aaattaaagaaattgacggaa

SEQ ID NO: 56023 - DNA, 21 bp, Artificial sequence
  SiRNA target sequence
aattaaagaaattgacggaag

SEQ ID NO: 56024 - DNA, 21 bp, Artificial sequence
  SiRNA target sequence
attaaagaaattgacggaaga

SEQ ID NO: 56025 - DNA, 21 bp, Artificial sequence
  SiRNA target sequence
ttaaagaaattgacggaagaa

SEQ ID NO: 56026 - DNA, 21 bp, Artificial sequence
  SiRNA target sequence
taaagaaattgacggaagaat

SEQ ID NO: 56027 - DNA, 21 bp, Artificial sequence
  SiRNA target sequence
aaagaaattgacggaagaata

SEQ ID NO: 56028 - DNA, 21 bp, Artificial sequence
  SiRNA target sequence
aagaaattgacggaagaatac

SEQ ID NO: 56029 - DNA, 21 bp, Artificial sequence
  SiRNA target sequence
agaaattgacggaagaatacc

SEQ ID NO: 56030 - DNA, 21 bp, Artificial sequence
  SiRNA target sequence
gaaattgacggaagaatacca

SEQ ID NO: 56031 - DNA, 21 bp, Artificial sequence
  SiRNA target sequence
aaattgacggaagaataccac

SEQ ID NO: 56032 - DNA, 21 bp, Artificial sequence
  SiRNA target sequence
aattgacggaagaataccaca

SEQ ID NO: 56033 - DNA, 21 bp, Artificial sequence
  SiRNA target sequence
attgacggaagaataccacaa

SEQ ID NO: 56034 - DNA, 21 bp, Artificial sequence
  SiRNA target sequence
ttgacggaagaataccacaag

SEQ ID NO: 56035 - DNA, 21 bp, Artificial sequence
  SiRNA target sequence
tgacggaagaataccacaagg

SEQ ID NO: 56036 - DNA, 21 bp, Artificial sequence
  SiRNA target sequence
gacggaagaataccacaagga

SEQ ID NO: 56037 - DNA, 21 bp, Artificial sequence
  SiRNA target sequence
acggaagaataccacaaggag

SEQ ID NO: 56038 - DNA, 21 bp, Artificial sequence
  SiRNA target sequence
cggaagaataccacaaggagt

SEQ ID NO: 56039 - DNA, 21 bp, Artificial sequence
  SiRNA target sequence
ggaagaataccacaaggagtg

SEQ ID NO: 56040 - DNA, 21 bp, Artificial sequence
  SiRNA target sequence
gaagaataccacaaggagtgg

SEQ ID NO: 56041 - DNA, 21 bp, Artificial sequence
  SiRNA target sequence
aagaataccacaaggagtgga

SEQ ID NO: 56042 - DNA, 21 bp, Artificial sequence
  SiRNA target sequence
agaataccacaaggagtggat

SEQ ID NO: 56043 - DNA, 21 bp, Artificial sequence
  SiRNA target sequence
gaataccacaaggagtggatt

SEQ ID NO: 56044 - DNA, 21 bp, Artificial sequence
  SiRNA target sequence
aataccacaaggagtggattg

SEQ ID NO: 56045 - DNA, 21 bp, Artificial sequence
  SiRNA target sequence
ataccacaaggagtggattgt

SEQ ID NO: 56046 - DNA, 21 bp, Artificial sequence
  SiRNA target sequence
taccacaaggagtggattgtg

SEQ ID NO: 56047 - DNA, 21 bp, Artificial sequence
  SiRNA target sequence
accacaaggagtggattgtgc

SEQ ID NO: 56048 - DNA, 21 bp, Artificial sequence
  SiRNA target sequence
ccacaaggagtggattgtgcg

SEQ ID NO: 56049 - DNA, 21 bp, Artificial sequence
  SiRNA target sequence
cacaaggagtggattgtgcgg

SEQ ID NO: 56050 - DNA, 21 bp, Artificial sequence
  SiRNA target sequence
acaaggagtggattgtgcggc

SEQ ID NO: 56051 - DNA, 21 bp, Artificial sequence
  SiRNA target sequence
caaggagtggattgtgcggct

SEQ ID NO: 56052 - DNA, 21 bp, Artificial sequence
  SiRNA target sequence
aaggagtggattgtgcggctt

SEQ ID NO: 56053 - DNA, 21 bp, Artificial sequence
  SiRNA target sequence
aggagtggattgtgcggctta

SEQ ID NO: 56054 - DNA, 21 bp, Artificial sequence
  SiRNA target sequence
ggagtggattgtgcggcttaa

SEQ ID NO: 56055 - DNA, 21 bp, Artificial sequence
  SiRNA target sequence
gagtggattgtgcggcttaat

SEQ ID NO: 56056 - DNA, 21 bp, Artificial sequence
  SiRNA target sequence
agtggattgtgcggcttaatt

SEQ ID NO: 56057 - DNA, 21 bp, Artificial sequence
  SiRNA target sequence
gtggattgtgcggcttaattt

SEQ ID NO: 56058 - DNA, 21 bp, Artificial sequence
  SiRNA target sequence
tggattgtgcggcttaatttg

SEQ ID NO: 56059 - DNA, 21 bp, Artificial sequence
  SiRNA target sequence
ggattgtgcggcttaatttga

SEQ ID NO: 56060 - DNA, 21 bp, Artificial sequence
  SiRNA target sequence
gattgtgcggcttaatttgac

SEQ ID NO: 56061 - DNA, 21 bp, Artificial sequence
  SiRNA target sequence
attgtgcggcttaatttgact

SEQ ID NO: 56062 - DNA, 21 bp, Artificial sequence
  SiRNA target sequence
ttgtgcggcttaatttgactc

SEQ ID NO: 56063 - DNA, 21 bp, Artificial sequence
  SiRNA target sequence
tgtgcggcttaatttgactca

SEQ ID NO: 56064 - DNA, 21 bp, Artificial sequence
  SiRNA target sequence
gtgcggcttaatttgactcaa

SEQ ID NO: 56065 - DNA, 21 bp, Artificial sequence
  SiRNA target sequence
tgcggcttaatttgactcaac

SEQ ID NO: 56066 - DNA, 21 bp, Artificial sequence
  SiRNA target sequence
gcggcttaatttgactcaacg

SEQ ID NO: 56067 - DNA, 21 bp, Artificial sequence
  SiRNA target sequence
cggcttaatttgactcaacgc

SEQ ID NO: 56068 - DNA, 21 bp, Artificial sequence
  SiRNA target sequence
ggcttaatttgactcaacgcg

SEQ ID NO: 56069 - DNA, 21 bp, Artificial sequence
  SiRNA target sequence
gcttaatttgactcaacgcga

SEQ ID NO: 56070 - DNA, 21 bp, Artificial sequence
  SiRNA target sequence
cttaatttgactcaacgcgag

SEQ ID NO: 56071 - DNA, 21 bp, Artificial sequence
  SiRNA target sequence
ttaatttgactcaacgcgagg

SEQ ID NO: 56072 - DNA, 21 bp, Artificial sequence
  SiRNA target sequence
taatttgactcaacgcgaggt

SEQ ID NO: 56073 - DNA, 21 bp, Artificial sequence
  SiRNA target sequence
aatttgactcaacgcgaggta

SEQ ID NO: 56074 - DNA, 21 bp, Artificial sequence
  SiRNA target sequence
atttgactcaacgcgaggtaa

SEQ ID NO: 56075 - DNA, 21 bp, Artificial sequence
  SiRNA target sequence
tttgactcaacgcgaggtaac

SEQ ID NO: 56076 - DNA, 21 bp, Artificial sequence
  SiRNA target sequence
ttgactcaacgcgaggtaact

SEQ ID NO: 56077 - DNA, 21 bp, Artificial sequence
  SiRNA target sequence
tgactcaacgcgaggtaactt

SEQ ID NO: 56078 - DNA, 21 bp, Artificial sequence
  SiRNA target sequence
gactcaacgcgaggtaactta

SEQ ID NO: 56079 - DNA, 21 bp, Artificial sequence
  SiRNA target sequence
actcaacgcgaggtaacttac

SEQ ID NO: 56080 - DNA, 21 bp, Artificial sequence
  SiRNA target sequence
ctcaacgcgaggtaacttacc

SEQ ID NO: 56081 - DNA, 21 bp, Artificial sequence
  SiRNA target sequence
tcaacgcgaggtaacttacca

SEQ ID NO: 56082 - DNA, 21 bp, Artificial sequence
  SiRNA target sequence
caacgcgaggtaacttaccaa

SEQ ID NO: 56083 - DNA, 21 bp, Artificial sequence
  SiRNA target sequence
aacgcgaggtaacttaccaat

SEQ ID NO: 56084 - DNA, 21 bp, Artificial sequence
  SiRNA target sequence
acgcgaggtaacttaccaata

SEQ ID NO: 56085 - DNA, 21 bp, Artificial sequence
  SiRNA target sequence
cgcgaggtaacttaccaatat

SEQ ID NO: 56086 - DNA, 21 bp, Artificial sequence
  SiRNA target sequence
gcgaggtaacttaccaatatt

SEQ ID NO: 56087 - DNA, 21 bp, Artificial sequence
  SiRNA target sequence
cgaggtaacttaccaatattt

SEQ ID NO: 56088 - DNA, 21 bp, Artificial sequence
  SiRNA target sequence
gaggtaacttaccaatatttt

SEQ ID NO: 56089 - DNA, 21 bp, Artificial sequence
  SiRNA target sequence
aggtaacttaccaatatttta

SEQ ID NO: 56090 - DNA, 21 bp, Artificial sequence
  SiRNA target sequence
ggtaacttaccaatattttat

SEQ ID NO: 56091 - DNA, 21 bp, Artificial sequence
  SiRNA target sequence
gtaacttaccaatattttatt

SEQ ID NO: 56092 - DNA, 21 bp, Artificial sequence
  SiRNA target sequence
taacttaccaatattttattg

SEQ ID NO: 56093 - DNA, 21 bp, Artificial sequence
  SiRNA target sequence
aacttaccaatattttattgt

SEQ ID NO: 56094 - DNA, 21 bp, Artificial sequence
  SiRNA target sequence
acttaccaatattttattgtt

SEQ ID NO: 56095 - DNA, 21 bp, Artificial sequence
  SiRNA target sequence
cttaccaatattttattgttc

SEQ ID NO: 56096 - DNA, 21 bp, Artificial sequence
  SiRNA target sequence
ttaccaatattttattgttct

SEQ ID NO: 56097 - DNA, 21 bp, Artificial sequence
  SiRNA target sequence
taccaatattttattgttctg

SEQ ID NO: 56098 - DNA, 21 bp, Artificial sequence
  SiRNA target sequence
accaatattttattgttctgc

SEQ ID NO: 56099 - DNA, 21 bp, Artificial sequence
  SiRNA target sequence
ccaatattttattgttctgcg

SEQ ID NO: 56100 - DNA, 21 bp, Artificial sequence
  SiRNA target sequence
caatattttattgttctgcga

SEQ ID NO: 56101 - DNA, 21 bp, Artificial sequence
  SiRNA target sequence
aatattttattgttctgcgag

SEQ ID NO: 56102 - DNA, 21 bp, Artificial sequence
  SiRNA target sequence
atattttattgttctgcgagg

SEQ ID NO: 56103 - DNA, 21 bp, Artificial sequence
  SiRNA target sequence
tattttattgttctgcgagga

SEQ ID NO: 56104 - DNA, 21 bp, Artificial sequence
  SiRNA target sequence
attttattgttctgcgaggat

SEQ ID NO: 56105 - DNA, 21 bp, Artificial sequence
  SiRNA target sequence
ttttattgttctgcgaggata

SEQ ID NO: 56106 - DNA, 21 bp, Artificial sequence
  SiRNA target sequence
tttattgttctgcgaggatat

SEQ ID NO: 56107 - DNA, 21 bp, Artificial sequence
  SiRNA target sequence
ttattgttctgcgaggatatg

SEQ ID NO: 56108 - DNA, 21 bp, Artificial sequence
  SiRNA target sequence
tattgttctgcgaggatatga

SEQ ID NO: 56109 - DNA, 21 bp, Artificial sequence
  SiRNA target sequence
attgttctgcgaggatatgat

SEQ ID NO: 56110 - DNA, 21 bp, Artificial sequence
  SiRNA target sequence
ttgttctgcgaggatatgatc

SEQ ID NO: 56111 - DNA, 21 bp, Artificial sequence
  SiRNA target sequence
tgttctgcgaggatatgatct

SEQ ID NO: 56112 - DNA, 21 bp, Artificial sequence
  SiRNA target sequence
gttctgcgaggatatgatctg

SEQ ID NO: 56113 - DNA, 21 bp, Artificial sequence
  SiRNA target sequence
ttctgcgaggatatgatctga

SEQ ID NO: 56114 - DNA, 21 bp, Artificial sequence
  SiRNA target sequence
tctgcgaggatatgatctgag

SEQ ID NO: 56115 - DNA, 21 bp, Artificial sequence
  SiRNA target sequence
ctgcgaggatatgatctgagg

SEQ ID NO: 56116 - DNA, 21 bp, Artificial sequence
  SiRNA target sequence
tgcgaggatatgatctgagga

SEQ ID NO: 56117 - DNA, 21 bp, Artificial sequence
  SiRNA target sequence
gcgaggatatgatctgaggat

SEQ ID NO: 56118 - DNA, 21 bp, Artificial sequence
  SiRNA target sequence
cgaggatatgatctgaggatg

SEQ ID NO: 56119 - DNA, 21 bp, Artificial sequence
  SiRNA target sequence
gaggatatgatctgaggatga

SEQ ID NO: 56120 - DNA, 21 bp, Artificial sequence
  SiRNA target sequence
aggatatgatctgaggatgat

SEQ ID NO: 56121 - DNA, 21 bp, Artificial sequence
  SiRNA target sequence
ggatatgatctgaggatgata

SEQ ID NO: 56122 - DNA, 21 bp, Artificial sequence
  SiRNA target sequence
gatatgatctgaggatgataa

SEQ ID NO: 56123 - DNA, 21 bp, Artificial sequence
  SiRNA target sequence
atatgatctgaggatgataat

SEQ ID NO: 56124 - DNA, 21 bp, Artificial sequence
  SiRNA target sequence
tatgatctgaggatgataata

SEQ ID NO: 56125 - DNA, 21 bp, Artificial sequence
  SiRNA target sequence
atgatctgaggatgataatag

SEQ ID NO: 56126 - DNA, 21 bp, Artificial sequence
  SiRNA target sequence
tgatctgaggatgataatagt

SEQ ID NO: 56127 - DNA, 21 bp, Artificial sequence
  SiRNA target sequence
gatctgaggatgataatagtg

SEQ ID NO: 56128 - DNA, 21 bp, Artificial sequence
  SiRNA target sequence
atctgaggatgataatagtgg

SEQ ID NO: 56129 - DNA, 21 bp, Artificial sequence
  SiRNA target sequence
tctgaggatgataatagtggt

SEQ ID NO: 56130 - DNA, 21 bp, Artificial sequence
  SiRNA target sequence
ctgaggatgataatagtggtg

SEQ ID NO: 56131 - DNA, 21 bp, Artificial sequence
  SiRNA target sequence
tgaggatgataatagtggtgc

SEQ ID NO: 56132 - DNA, 21 bp, Artificial sequence
  SiRNA target sequence
gaggatgataatagtggtgca

SEQ ID NO: 56133 - DNA, 21 bp, Artificial sequence
  SiRNA target sequence
aggatgataatagtggtgcat

SEQ ID NO: 56134 - DNA, 21 bp, Artificial sequence
  SiRNA target sequence
ggatgataatagtggtgcatg

SEQ ID NO: 56135 - DNA, 21 bp, Artificial sequence
  SiRNA target sequence
gatgataatagtggtgcatgg

SEQ ID NO: 56136 - DNA, 21 bp, Artificial sequence
  SiRNA target sequence
atgataatagtggtgcatggc

SEQ ID NO: 56137 - DNA, 21 bp, Artificial sequence
  SiRNA target sequence
tgataatagtggtgcatggcc

SEQ ID NO: 56138 - DNA, 21 bp, Artificial sequence
  SiRNA target sequence
gataatagtggtgcatggccg

SEQ ID NO: 56139 - DNA, 21 bp, Artificial sequence
  SiRNA target sequence
ataatagtggtgcatggccgt

SEQ ID NO: 56140 - DNA, 21 bp, Artificial sequence
  SiRNA target sequence
taatagtggtgcatggccgtt

SEQ ID NO: 56141 - DNA, 21 bp, Artificial sequence
  SiRNA target sequence
aatagtggtgcatggccgttt

SEQ ID NO: 56142 - DNA, 21 bp, Artificial sequence
  SiRNA target sequence
atagtggtgcatggccgtttt

SEQ ID NO: 56143 - DNA, 21 bp, Artificial sequence
  SiRNA target sequence
tagtggtgcatggccgttttc

SEQ ID NO: 56144 - DNA, 21 bp, Artificial sequence
  SiRNA target sequence
agtggtgcatggccgttttca

SEQ ID NO: 56145 - DNA, 21 bp, Artificial sequence
  SiRNA target sequence
gtggtgcatggccgttttcaa

SEQ ID NO: 56146 - DNA, 21 bp, Artificial sequence
  SiRNA target sequence
tggtgcatggccgttttcaat

SEQ ID NO: 56147 - DNA, 21 bp, Artificial sequence
  SiRNA target sequence
ggtgcatggccgttttcaatg

SEQ ID NO: 56148 - DNA, 21 bp, Artificial sequence
  SiRNA target sequence
gtgcatggccgttttcaatgg

SEQ ID NO: 56149 - DNA, 21 bp, Artificial sequence
  SiRNA target sequence
tgcatggccgttttcaatgga

SEQ ID NO: 56150 - DNA, 21 bp, Artificial sequence
  SiRNA target sequence
gcatggccgttttcaatggat

SEQ ID NO: 56151 - DNA, 21 bp, Artificial sequence
  SiRNA target sequence
catggccgttttcaatggatg

SEQ ID NO: 56152 - DNA, 21 bp, Artificial sequence
  SiRNA target sequence
atggccgttttcaatggatgc

SEQ ID NO: 56153 - DNA, 21 bp, Artificial sequence
  SiRNA target sequence
tggccgttttcaatggatgct

SEQ ID NO: 56154 - DNA, 21 bp, Artificial sequence
  SiRNA target sequence
ggccgttttcaatggatgctg

SEQ ID NO: 56155 - DNA, 21 bp, Artificial sequence
  SiRNA target sequence
gccgttttcaatggatgctgt

SEQ ID NO: 56156 - DNA, 21 bp, Artificial sequence
  SiRNA target sequence
ccgttttcaatggatgctgtg

SEQ ID NO: 56157 - DNA, 21 bp, Artificial sequence
  SiRNA target sequence
cgttttcaatggatgctgtga

SEQ ID NO: 56158 - DNA, 21 bp, Artificial sequence
  SiRNA target sequence
tgccgacgatgtgatatgaga

SEQ ID NO: 56159 - DNA, 21 bp, Artificial sequence
  SiRNA target sequence
gccgacgatgtgatatgagat

SEQ ID NO: 56160 - DNA, 21 bp, Artificial sequence
  SiRNA target sequence
ccgacgatgtgatatgagatg

SEQ ID NO: 56161 - DNA, 21 bp, Artificial sequence
  SiRNA target sequence
cgacgatgtgatatgagatgt

SEQ ID NO: 56162 - DNA, 21 bp, Artificial sequence
  SiRNA target sequence
gacgatgtgatatgagatgtt

SEQ ID NO: 56163 - DNA, 21 bp, Artificial sequence
  SiRNA target sequence
acgatgtgatatgagatgttg

SEQ ID NO: 56164 - DNA, 21 bp, Artificial sequence
  SiRNA target sequence
cgatgtgatatgagatgttgt

SEQ ID NO: 56165 - DNA, 21 bp, Artificial sequence
  SiRNA target sequence
gatgtgatatgagatgttgta

SEQ ID NO: 56166 - DNA, 21 bp, Artificial sequence
  SiRNA target sequence
atgtgatatgagatgttgtat

SEQ ID NO: 56167 - DNA, 21 bp, Artificial sequence
  SiRNA target sequence
tgtgatatgagatgttgtatt

SEQ ID NO: 56168 - DNA, 21 bp, Artificial sequence
  SiRNA target sequence
gtgatatgagatgttgtatta

SEQ ID NO: 56169 - DNA, 21 bp, Artificial sequence
  SiRNA target sequence
tgatatgagatgttgtattac

SEQ ID NO: 56170 - DNA, 21 bp, Artificial sequence
  SiRNA target sequence
gatatgagatgttgtattaca

SEQ ID NO: 56171 - DNA, 21 bp, Artificial sequence
  SiRNA target sequence
atatgagatgttgtattacat

SEQ ID NO: 56172 - DNA, 21 bp, Artificial sequence
  SiRNA target sequence
tatgagatgttgtattacatt

SEQ ID NO: 56173 - DNA, 21 bp, Artificial sequence
  SiRNA target sequence
atgagatgttgtattacatta

SEQ ID NO: 56174 - DNA, 21 bp, Artificial sequence
  SiRNA target sequence
tgagatgttgtattacattat

SEQ ID NO: 56175 - DNA, 21 bp, Artificial sequence
  SiRNA target sequence
gagatgttgtattacattata

SEQ ID NO: 56176 - DNA, 21 bp, Artificial sequence
  SiRNA target sequence
agatgttgtattacattatag

SEQ ID NO: 56177 - DNA, 21 bp, Artificial sequence
  SiRNA target sequence
gatgttgtattacattataga

SEQ ID NO: 56178 - DNA, 21 bp, Artificial sequence
  SiRNA target sequence
atgttgtattacattatagaa

SEQ ID NO: 56179 - DNA, 21 bp, Artificial sequence
  SiRNA target sequence
tgttgtattacattatagaaa

SEQ ID NO: 56180 - DNA, 21 bp, Artificial sequence
  SiRNA target sequence
gttgtattacattatagaaat

SEQ ID NO: 56181 - DNA, 21 bp, Artificial sequence
  SiRNA target sequence
ttgtattacattatagaaatt

SEQ ID NO: 56182 - DNA, 21 bp, Artificial sequence
  SiRNA target sequence
tgtattacattatagaaatta

SEQ ID NO: 56183 - DNA, 21 bp, Artificial sequence
  SiRNA target sequence
gtattacattatagaaattag

SEQ ID NO: 56184 - DNA, 21 bp, Artificial sequence
  SiRNA target sequence
tattacattatagaaattaga

SEQ ID NO: 56185 - DNA, 21 bp, Artificial sequence
  SiRNA target sequence
attacattatagaaattagag

SEQ ID NO: 56186 - DNA, 21 bp, Artificial sequence
  SiRNA target sequence
ttacattatagaaattagagt

SEQ ID NO: 56187 - DNA, 21 bp, Artificial sequence
  SiRNA target sequence
tacattatagaaattagagtt

SEQ ID NO: 56188 - DNA, 21 bp, Artificial sequence
  SiRNA target sequence
acattatagaaattagagttt

SEQ ID NO: 56189 - DNA, 21 bp, Artificial sequence
  SiRNA target sequence
cattatagaaattagagtttt

SEQ ID NO: 56190 - DNA, 21 bp, Artificial sequence
  SiRNA target sequence
attatagaaattagagttttt

SEQ ID NO: 56191 - DNA, 21 bp, Artificial sequence
  SiRNA target sequence
ttatagaaattagagtttttt

SEQ ID NO: 56192 - DNA, 21 bp, Artificial sequence
  SiRNA target sequence
tatagaaattagagttttttg

SEQ ID NO: 56193 - DNA, 21 bp, Artificial sequence
  SiRNA target sequence
atagaaattagagttttttgg

SEQ ID NO: 56194 - DNA, 21 bp, Artificial sequence
  SiRNA target sequence
tagaaattagagttttttggc

SEQ ID NO: 56195 - DNA, 21 bp, Artificial sequence
  SiRNA target sequence
agaaattagagttttttggct

SEQ ID NO: 56196 - DNA, 21 bp, Artificial sequence
  SiRNA target sequence
gaaattagagttttttggctc

SEQ ID NO: 56197 - DNA, 21 bp, Artificial sequence
  SiRNA target sequence
aaattagagttttttggctct

SEQ ID NO: 56198 - DNA, 21 bp, Artificial sequence
  SiRNA target sequence
aattagagttttttggctctg

SEQ ID NO: 56199 - DNA, 21 bp, Artificial sequence
  SiRNA target sequence
attagagttttttggctctgg

SEQ ID NO: 56200 - DNA, 21 bp, Artificial sequence
  SiRNA target sequence
ttagagttttttggctctggg

SEQ ID NO: 56201 - DNA, 21 bp, Artificial sequence
  SiRNA target sequence
tagagttttttggctctgggg

SEQ ID NO: 56202 - DNA, 21 bp, Artificial sequence
  SiRNA target sequence
agagttttttggctctgggga

SEQ ID NO: 56203 - DNA, 21 bp, Artificial sequence
  SiRNA target sequence
gagttttttggctctggggat

SEQ ID NO: 56204 - DNA, 21 bp, Artificial sequence
  SiRNA target sequence
agttttttggctctggggata

SEQ ID NO: 56205 - DNA, 21 bp, Artificial sequence
  SiRNA target sequence
gttttttggctctggggatag

SEQ ID NO: 56206 - DNA, 21 bp, Artificial sequence
  SiRNA target sequence
ttttttggctctggggatagt

SEQ ID NO: 56207 - DNA, 21 bp, Artificial sequence
  SiRNA target sequence
tttttggctctggggatagta

SEQ ID NO: 56208 - DNA, 21 bp, Artificial sequence
  SiRNA target sequence
ttttggctctggggatagtat

SEQ ID NO: 56209 - DNA, 21 bp, Artificial sequence
  SiRNA target sequence
tttggctctggggatagtatg

SEQ ID NO: 56210 - DNA, 21 bp, Artificial sequence
  SiRNA target sequence
ttggctctggggatagtatga

SEQ ID NO: 56211 - DNA, 21 bp, Artificial sequence
  SiRNA target sequence
tggctctggggatagtatgat

SEQ ID NO: 56212 - DNA, 21 bp, Artificial sequence
  SiRNA target sequence
ggctctggggatagtatgatc

SEQ ID NO: 56213 - DNA, 21 bp, Artificial sequence
  SiRNA target sequence
gctctggggatagtatgatcg

SEQ ID NO: 56214 - DNA, 21 bp, Artificial sequence
  SiRNA target sequence
ctctggggatagtatgatcgc

SEQ ID NO: 56215 - DNA, 21 bp, Artificial sequence
  SiRNA target sequence
tctggggatagtatgatcgca

SEQ ID NO: 56216 - DNA, 21 bp, Artificial sequence
  SiRNA target sequence
ctggggatagtatgatcgcaa

SEQ ID NO: 56217 - DNA, 21 bp, Artificial sequence
  SiRNA target sequence
tggggatagtatgatcgcaag

SEQ ID NO: 56218 - DNA, 21 bp, Artificial sequence
  SiRNA target sequence
ggggatagtatgatcgcaaga

SEQ ID NO: 56219 - DNA, 21 bp, Artificial sequence
  SiRNA target sequence
gggatagtatgatcgcaagat

SEQ ID NO: 56220 - DNA, 21 bp, Artificial sequence
  SiRNA target sequence
ggatagtatgatcgcaagatt

SEQ ID NO: 56221 - DNA, 21 bp, Artificial sequence
  SiRNA target sequence
gatagtatgatcgcaagattg

SEQ ID NO: 56222 - DNA, 21 bp, Artificial sequence
  SiRNA target sequence
atagtatgatcgcaagattga

SEQ ID NO: 56223 - DNA, 21 bp, Artificial sequence
  SiRNA target sequence
tagtatgatcgcaagattgaa

SEQ ID NO: 56224 - DNA, 21 bp, Artificial sequence
  SiRNA target sequence
agtatgatcgcaagattgaaa

SEQ ID NO: 56225 - DNA, 21 bp, Artificial sequence
  SiRNA target sequence
gtatgatcgcaagattgaaaa

SEQ ID NO: 56226 - DNA, 21 bp, Artificial sequence
  SiRNA target sequence
tatgatcgcaagattgaaaat

SEQ ID NO: 56227 - DNA, 21 bp, Artificial sequence
  SiRNA target sequence
atgatcgcaagattgaaaatt

SEQ ID NO: 56228 - DNA, 21 bp, Artificial sequence
  SiRNA target sequence
tgatcgcaagattgaaaatta

SEQ ID NO: 56229 - DNA, 21 bp, Artificial sequence
  SiRNA target sequence
gatcgcaagattgaaaattaa

SEQ ID NO: 56230 - DNA, 21 bp, Artificial sequence
  SiRNA target sequence
atcgcaagattgaaaattaaa

SEQ ID NO: 56231 - DNA, 21 bp, Artificial sequence
  SiRNA target sequence
tcgcaagattgaaaattaaag

SEQ ID NO: 56232 - DNA, 21 bp, Artificial sequence
  SiRNA target sequence
cgcaagattgaaaattaaaga

SEQ ID NO: 56233 - DNA, 21 bp, Artificial sequence
  SiRNA target sequence
gcaagattgaaaattaaagaa

SEQ ID NO: 56234 - DNA, 21 bp, Artificial sequence
  SiRNA target sequence
caagattgaaaattaaagaaa

SEQ ID NO: 56235 - DNA, 21 bp, Artificial sequence
  SiRNA target sequence
aagattgaaaattaaagaaat

SEQ ID NO: 56236 - DNA, 21 bp, Artificial sequence
  SiRNA target sequence
agattgaaaattaaagaaatt

SEQ ID NO: 56237 - DNA, 21 bp, Artificial sequence
  SiRNA target sequence
gattgaaaattaaagaaattg

SEQ ID NO: 56238 - DNA, 21 bp, Artificial sequence
  SiRNA target sequence
attgaaaattaaagaaattga

SEQ ID NO: 56239 - DNA, 21 bp, Artificial sequence
  SiRNA target sequence
ttgaaaattaaagaaattgac

SEQ ID NO: 56240 - DNA, 21 bp, Artificial sequence
  SiRNA target sequence
tgaaaattaaagaaattgacg

SEQ ID NO: 56241 - DNA, 21 bp, Artificial sequence
  SiRNA target sequence
gaaaattaaagaaattgacgg

SEQ ID NO: 56242 - DNA, 21 bp, Artificial sequence
  SiRNA target sequence
aaaattaaagaaattgacgga

SEQ ID NO: 56243 - DNA, 21 bp, Artificial sequence
  SiRNA target sequence
aaattaaagaaattgacggaa

SEQ ID NO: 56244 - DNA, 21 bp, Artificial sequence
  SiRNA target sequence
aattaaagaaattgacggaag

SEQ ID NO: 56245 - DNA, 21 bp, Artificial sequence
  SiRNA target sequence
attaaagaaattgacggaaga

SEQ ID NO: 56246 - DNA, 21 bp, Artificial sequence
  SiRNA target sequence
ttaaagaaattgacggaagaa

SEQ ID NO: 56247 - DNA, 21 bp, Artificial sequence
  SiRNA target sequence
taaagaaattgacggaagaat

SEQ ID NO: 56248 - DNA, 21 bp, Artificial sequence
  SiRNA target sequence
aaagaaattgacggaagaata

SEQ ID NO: 56249 - DNA, 21 bp, Artificial sequence
  SiRNA target sequence
aagaaattgacggaagaatac

SEQ ID NO: 56250 - DNA, 21 bp, Artificial sequence
  SiRNA target sequence
agaaattgacggaagaatacc

SEQ ID NO: 56251 - DNA, 21 bp, Artificial sequence
  SiRNA target sequence
gaaattgacggaagaatacca

SEQ ID NO: 56252 - DNA, 21 bp, Artificial sequence
  SiRNA target sequence
aaattgacggaagaataccac

SEQ ID NO: 56253 - DNA, 21 bp, Artificial sequence
  SiRNA target sequence
aattgacggaagaataccaca

SEQ ID NO: 56254 - DNA, 21 bp, Artificial sequence
  SiRNA target sequence
attgacggaagaataccacaa

SEQ ID NO: 56255 - DNA, 21 bp, Artificial sequence
  SiRNA target sequence
ttgacggaagaataccacaag

SEQ ID NO: 56256 - DNA, 21 bp, Artificial sequence
  SiRNA target sequence
tgacggaagaataccacaagg

SEQ ID NO: 56257 - DNA, 21 bp, Artificial sequence
  SiRNA target sequence
gacggaagaataccacaagga

SEQ ID NO: 56258 - DNA, 21 bp, Artificial sequence
  SiRNA target sequence
acggaagaataccacaaggag

SEQ ID NO: 56259 - DNA, 21 bp, Artificial sequence
  SiRNA target sequence
cggaagaataccacaaggagt

SEQ ID NO: 56260 - DNA, 21 bp, Artificial sequence
  SiRNA target sequence
ggaagaataccacaaggagtg

SEQ ID NO: 56261 - DNA, 21 bp, Artificial sequence
  SiRNA target sequence
gaagaataccacaaggagtgg

SEQ ID NO: 56262 - DNA, 21 bp, Artificial sequence
  SiRNA target sequence
aagaataccacaaggagtgga

SEQ ID NO: 56263 - DNA, 21 bp, Artificial sequence
  SiRNA target sequence
agaataccacaaggagtggat

SEQ ID NO: 56264 - DNA, 21 bp, Artificial sequence
  SiRNA target sequence
gaataccacaaggagtggatt

SEQ ID NO: 56265 - DNA, 21 bp, Artificial sequence
  SiRNA target sequence
aataccacaaggagtggattg

SEQ ID NO: 56266 - DNA, 21 bp, Artificial sequence
  SiRNA target sequence
ataccacaaggagtggattgt

SEQ ID NO: 56267 - DNA, 21 bp, Artificial sequence
  SiRNA target sequence
taccacaaggagtggattgtg

SEQ ID NO: 56268 - DNA, 21 bp, Artificial sequence
  SiRNA target sequence
accacaaggagtggattgtgc

SEQ ID NO: 56269 - DNA, 21 bp, Artificial sequence
  SiRNA target sequence
ccacaaggagtggattgtgcg

SEQ ID NO: 56270 - DNA, 21 bp, Artificial sequence
  SiRNA target sequence
cacaaggagtggattgtgcgg

SEQ ID NO: 56271 - DNA, 21 bp, Artificial sequence
  SiRNA target sequence
acaaggagtggattgtgcggc

SEQ ID NO: 56272 - DNA, 21 bp, Artificial sequence
  SiRNA target sequence
caaggagtggattgtgcggct

SEQ ID NO: 56273 - DNA, 21 bp, Artificial sequence
  SiRNA target sequence
aaggagtggattgtgcggctt

SEQ ID NO: 56274 - DNA, 21 bp, Artificial sequence
  SiRNA target sequence
aggagtggattgtgcggctta

SEQ ID NO: 56275 - DNA, 21 bp, Artificial sequence
  SiRNA target sequence
ggagtggattgtgcggcttaa

SEQ ID NO: 56276 - DNA, 21 bp, Artificial sequence
  SiRNA target sequence
gagtggattgtgcggcttaat

SEQ ID NO: 56277 - DNA, 21 bp, Artificial sequence
  SiRNA target sequence
agtggattgtgcggcttaatt

SEQ ID NO: 56278 - DNA, 21 bp, Artificial sequence
  SiRNA target sequence
gtggattgtgcggcttaattt

SEQ ID NO: 56279 - DNA, 21 bp, Artificial sequence
  SiRNA target sequence
tggattgtgcggcttaatttg

SEQ ID NO: 56280 - DNA, 21 bp, Artificial sequence
  SiRNA target sequence
ggattgtgcggcttaatttga

SEQ ID NO: 56281 - DNA, 21 bp, Artificial sequence
  SiRNA target sequence
gattgtgcggcttaatttgac

SEQ ID NO: 56282 - DNA, 21 bp, Artificial sequence
  SiRNA target sequence
attgtgcggcttaatttgact

SEQ ID NO: 56283 - DNA, 21 bp, Artificial sequence
  SiRNA target sequence
ttgtgcggcttaatttgactc

SEQ ID NO: 56284 - DNA, 21 bp, Artificial sequence
  SiRNA target sequence
tgtgcggcttaatttgactca

SEQ ID NO: 56285 - DNA, 21 bp, Artificial sequence
  SiRNA target sequence
gtgcggcttaatttgactcaa

SEQ ID NO: 56286 - DNA, 21 bp, Artificial sequence
  SiRNA target sequence
tgcggcttaatttgactcaac

SEQ ID NO: 56287 - DNA, 21 bp, Artificial sequence
  SiRNA target sequence
gcggcttaatttgactcaacg

SEQ ID NO: 56288 - DNA, 21 bp, Artificial sequence
  SiRNA target sequence
cggcttaatttgactcaacgc

SEQ ID NO: 56289 - DNA, 21 bp, Artificial sequence
  SiRNA target sequence
ggcttaatttgactcaacgcg

SEQ ID NO: 56290 - DNA, 21 bp, Artificial sequence
  SiRNA target sequence
gcttaatttgactcaacgcga

SEQ ID NO: 56291 - DNA, 21 bp, Artificial sequence
  SiRNA target sequence
cttaatttgactcaacgcgag

SEQ ID NO: 56292 - DNA, 21 bp, Artificial sequence
  SiRNA target sequence
ttaatttgactcaacgcgagg

SEQ ID NO: 56293 - DNA, 21 bp, Artificial sequence
  SiRNA target sequence
taatttgactcaacgcgaggt

SEQ ID NO: 56294 - DNA, 21 bp, Artificial sequence
  SiRNA target sequence
aatttgactcaacgcgaggta

SEQ ID NO: 56295 - DNA, 21 bp, Artificial sequence
  SiRNA target sequence
atttgactcaacgcgaggtaa

SEQ ID NO: 56296 - DNA, 21 bp, Artificial sequence
  SiRNA target sequence
tttgactcaacgcgaggtaac

SEQ ID NO: 56297 - DNA, 21 bp, Artificial sequence
  SiRNA target sequence
ttgactcaacgcgaggtaact

SEQ ID NO: 56298 - DNA, 21 bp, Artificial sequence
  SiRNA target sequence
tgactcaacgcgaggtaactt

SEQ ID NO: 56299 - DNA, 21 bp, Artificial sequence
  SiRNA target sequence
gactcaacgcgaggtaactta

SEQ ID NO: 56300 - DNA, 21 bp, Artificial sequence
  SiRNA target sequence
actcaacgcgaggtaacttac

SEQ ID NO: 56301 - DNA, 21 bp, Artificial sequence
  SiRNA target sequence
ctcaacgcgaggtaacttacc

SEQ ID NO: 56302 - DNA, 21 bp, Artificial sequence
  SiRNA target sequence
tcaacgcgaggtaacttacca

SEQ ID NO: 56303 - DNA, 21 bp, Artificial sequence
  SiRNA target sequence
caacgcgaggtaacttaccaa

SEQ ID NO: 56304 - DNA, 21 bp, Artificial sequence
  SiRNA target sequence
aacgcgaggtaacttaccaat

SEQ ID NO: 56305 - DNA, 21 bp, Artificial sequence
  SiRNA target sequence
acgcgaggtaacttaccaata

SEQ ID NO: 56306 - DNA, 21 bp, Artificial sequence
  SiRNA target sequence
cgcgaggtaacttaccaatat

SEQ ID NO: 56307 - DNA, 21 bp, Artificial sequence
  SiRNA target sequence
gcgaggtaacttaccaatatt

SEQ ID NO: 56308 - DNA, 21 bp, Artificial sequence
  SiRNA target sequence
cgaggtaacttaccaatattt

SEQ ID NO: 56309 - DNA, 21 bp, Artificial sequence
  SiRNA target sequence
gaggtaacttaccaatatttt

SEQ ID NO: 56310 - DNA, 21 bp, Artificial sequence
  SiRNA target sequence
aggtaacttaccaatatttta

SEQ ID NO: 56311 - DNA, 21 bp, Artificial sequence
  SiRNA target sequence
ggtaacttaccaatattttat

SEQ ID NO: 56312 - DNA, 21 bp, Artificial sequence
  SiRNA target sequence
gtaacttaccaatattttatt

SEQ ID NO: 56313 - DNA, 21 bp, Artificial sequence
  SiRNA target sequence
taacttaccaatattttattg

SEQ ID NO: 56314 - DNA, 21 bp, Artificial sequence
  SiRNA target sequence
aacttaccaatattttattgt

SEQ ID NO: 56315 - DNA, 21 bp, Artificial sequence
  SiRNA target sequence
acttaccaatattttattgtt

SEQ ID NO: 56316 - DNA, 21 bp, Artificial sequence
  SiRNA target sequence
cttaccaatattttattgttc

SEQ ID NO: 56317 - DNA, 21 bp, Artificial sequence
  SiRNA target sequence
ttaccaatattttattgttct

SEQ ID NO: 56318 - DNA, 21 bp, Artificial sequence
  SiRNA target sequence
taccaatattttattgttctg

SEQ ID NO: 56319 - DNA, 21 bp, Artificial sequence
  SiRNA target sequence
accaatattttattgttctgc

SEQ ID NO: 56320 - DNA, 21 bp, Artificial sequence
  SiRNA target sequence
ccaatattttattgttctgcg

SEQ ID NO: 56321 - DNA, 21 bp, Artificial sequence
  SiRNA target sequence
caatattttattgttctgcga

SEQ ID NO: 56322 - DNA, 21 bp, Artificial sequence
  SiRNA target sequence
aatattttattgttctgcgag

SEQ ID NO: 56323 - DNA, 21 bp, Artificial sequence
  SiRNA target sequence
atattttattgttctgcgagg

SEQ ID NO: 56324 - DNA, 21 bp, Artificial sequence
  SiRNA target sequence
tattttattgttctgcgagga

SEQ ID NO: 56325 - DNA, 21 bp, Artificial sequence
  SiRNA target sequence
attttattgttctgcgaggat

SEQ ID NO: 56326 - DNA, 21 bp, Artificial sequence
  SiRNA target sequence
ttttattgttctgcgaggata

SEQ ID NO: 56327 - DNA, 21 bp, Artificial sequence
  SiRNA target sequence
tttattgttctgcgaggatat

SEQ ID NO: 56328 - DNA, 21 bp, Artificial sequence
  SiRNA target sequence
ttattgttctgcgaggatatg

SEQ ID NO: 56329 - DNA, 21 bp, Artificial sequence
  SiRNA target sequence
tattgttctgcgaggatatga

SEQ ID NO: 56330 - DNA, 21 bp, Artificial sequence
  SiRNA target sequence
attgttctgcgaggatatgat

SEQ ID NO: 56331 - DNA, 21 bp, Artificial sequence
  SiRNA target sequence
ttgttctgcgaggatatgatc

SEQ ID NO: 56332 - DNA, 21 bp, Artificial sequence
  SiRNA target sequence
tgttctgcgaggatatgatct

SEQ ID NO: 56333 - DNA, 21 bp, Artificial sequence
  SiRNA target sequence
gttctgcgaggatatgatctg

SEQ ID NO: 56334 - DNA, 21 bp, Artificial sequence
  SiRNA target sequence
ttctgcgaggatatgatctga

SEQ ID NO: 56335 - DNA, 21 bp, Artificial sequence
  SiRNA target sequence
tctgcgaggatatgatctgag

SEQ ID NO: 56336 - DNA, 21 bp, Artificial sequence
  SiRNA target sequence
ctgcgaggatatgatctgagg

SEQ ID NO: 56337 - DNA, 21 bp, Artificial sequence
  SiRNA target sequence
tgcgaggatatgatctgagga

SEQ ID NO: 56338 - DNA, 21 bp, Artificial sequence
  SiRNA target sequence
gcgaggatatgatctgaggat

SEQ ID NO: 56339 - DNA, 21 bp, Artificial sequence
  SiRNA target sequence
cgaggatatgatctgaggatg

SEQ ID NO: 56340 - DNA, 21 bp, Artificial sequence
  SiRNA target sequence
gaggatatgatctgaggatga

SEQ ID NO: 56341 - DNA, 21 bp, Artificial sequence
  SiRNA target sequence
aggatatgatctgaggatgat

SEQ ID NO: 56342 - DNA, 21 bp, Artificial sequence
  SiRNA target sequence
ggatatgatctgaggatgata

SEQ ID NO: 56343 - DNA, 21 bp, Artificial sequence
  SiRNA target sequence
gatatgatctgaggatgataa

SEQ ID NO: 56344 - DNA, 21 bp, Artificial sequence
  SiRNA target sequence
atatgatctgaggatgataat

SEQ ID NO: 56345 - DNA, 21 bp, Artificial sequence
  SiRNA target sequence
tatgatctgaggatgataata

SEQ ID NO: 56346 - DNA, 21 bp, Artificial sequence
  SiRNA target sequence
atgatctgaggatgataatag

SEQ ID NO: 56347 - DNA, 21 bp, Artificial sequence
  SiRNA target sequence
tgatctgaggatgataatagt

SEQ ID NO: 56348 - DNA, 21 bp, Artificial sequence
  SiRNA target sequence
gatctgaggatgataatagtg

SEQ ID NO: 56349 - DNA, 21 bp, Artificial sequence
  SiRNA target sequence
atctgaggatgataatagtgg

SEQ ID NO: 56350 - DNA, 21 bp, Artificial sequence
  SiRNA target sequence
tctgaggatgataatagtggt

SEQ ID NO: 56351 - DNA, 21 bp, Artificial sequence
  SiRNA target sequence
ctgaggatgataatagtggtg

SEQ ID NO: 56352 - DNA, 21 bp, Artificial sequence
  SiRNA target sequence
tgaggatgataatagtggtgc

SEQ ID NO: 56353 - DNA, 21 bp, Artificial sequence
  SiRNA target sequence
gaggatgataatagtggtgca

SEQ ID NO: 56354 - DNA, 21 bp, Artificial sequence
  SiRNA target sequence
aggatgataatagtggtgcat

SEQ ID NO: 56355 - DNA, 21 bp, Artificial sequence
  SiRNA target sequence
ggatgataatagtggtgcatg

SEQ ID NO: 56356 - DNA, 21 bp, Artificial sequence
  SiRNA target sequence
gatgataatagtggtgcatgg

SEQ ID NO: 56357 - DNA, 21 bp, Artificial sequence
  SiRNA target sequence
atgataatagtggtgcatggc

SEQ ID NO: 56358 - DNA, 21 bp, Artificial sequence
  SiRNA target sequence
tgataatagtggtgcatggcc

SEQ ID NO: 56359 - DNA, 21 bp, Artificial sequence
  SiRNA target sequence
gataatagtggtgcatggccg

SEQ ID NO: 56360 - DNA, 21 bp, Artificial sequence
  SiRNA target sequence
ataatagtggtgcatggccgt

SEQ ID NO: 56361 - DNA, 21 bp, Artificial sequence
  SiRNA target sequence
taatagtggtgcatggccgtt

SEQ ID NO: 56362 - DNA, 21 bp, Artificial sequence
  SiRNA target sequence
aatagtggtgcatggccgttt

SEQ ID NO: 56363 - DNA, 21 bp, Artificial sequence
  SiRNA target sequence
atagtggtgcatggccgtttt

SEQ ID NO: 56364 - DNA, 21 bp, Artificial sequence
  SiRNA target sequence
tagtggtgcatggccgttttc

SEQ ID NO: 56365 - DNA, 21 bp, Artificial sequence
  SiRNA target sequence
agtggtgcatggccgttttca

SEQ ID NO: 56366 - DNA, 21 bp, Artificial sequence
  SiRNA target sequence
gtggtgcatggccgttttcaa

SEQ ID NO: 56367 - DNA, 21 bp, Artificial sequence
  SiRNA target sequence
tggtgcatggccgttttcaat

SEQ ID NO: 56368 - DNA, 21 bp, Artificial sequence
  SiRNA target sequence
ggtgcatggccgttttcaatg

SEQ ID NO: 56369 - DNA, 21 bp, Artificial sequence
  SiRNA target sequence
gtgcatggccgttttcaatgg

SEQ ID NO: 56370 - DNA, 21 bp, Artificial sequence
  SiRNA target sequence
tgcatggccgttttcaatgga

SEQ ID NO: 56371 - DNA, 21 bp, Artificial sequence
  SiRNA target sequence
gcatggccgttttcaatggat

SEQ ID NO: 56372 - DNA, 21 bp, Artificial sequence
  SiRNA target sequence
catggccgttttcaatggatg

SEQ ID NO: 56373 - DNA, 21 bp, Artificial sequence
  SiRNA target sequence
atggccgttttcaatggatgc

SEQ ID NO: 56374 - DNA, 21 bp, Artificial sequence
  SiRNA target sequence
tggccgttttcaatggatgct

SEQ ID NO: 56375 - DNA, 21 bp, Artificial sequence
  SiRNA target sequence
ggccgttttcaatggatgctg

SEQ ID NO: 56376 - DNA, 21 bp, Artificial sequence
  SiRNA target sequence
gccgttttcaatggatgctgt

SEQ ID NO: 56377 - DNA, 21 bp, Artificial sequence
  SiRNA target sequence
ccgttttcaatggatgctgtg

SEQ ID NO: 56378 - DNA, 21 bp, Artificial sequence
  SiRNA target sequence
cgttttcaatggatgctgtga

SEQ ID NO: 56379 - DNA, 21 bp, Artificial sequence
  SiRNA target sequence
ttgccgacgatgtgatatgag

SEQ ID NO: 56380 - DNA, 21 bp, Artificial sequence
  SiRNA target sequence
tgccgacgatgtgatatgaga

SEQ ID NO: 56381 - DNA, 21 bp, Artificial sequence
  SiRNA target sequence
gccgacgatgtgatatgagat

SEQ ID NO: 56382 - DNA, 21 bp, Artificial sequence
  SiRNA target sequence
ccgacgatgtgatatgagatg

SEQ ID NO: 56383 - DNA, 21 bp, Artificial sequence
  SiRNA target sequence
cgacgatgtgatatgagatgt

SEQ ID NO: 56384 - DNA, 21 bp, Artificial sequence
  SiRNA target sequence
gacgatgtgatatgagatgtt

SEQ ID NO: 56385 - DNA, 21 bp, Artificial sequence
  SiRNA target sequence
acgatgtgatatgagatgttg

SEQ ID NO: 56386 - DNA, 21 bp, Artificial sequence
  SiRNA target sequence
cgatgtgatatgagatgttgt

SEQ ID NO: 56387 - DNA, 21 bp, Artificial sequence
  SiRNA target sequence
gatgtgatatgagatgttgta

SEQ ID NO: 56388 - DNA, 21 bp, Artificial sequence
  SiRNA target sequence
atgtgatatgagatgttgtat

SEQ ID NO: 56389 - DNA, 21 bp, Artificial sequence
  SiRNA target sequence
tgtgatatgagatgttgtatt

SEQ ID NO: 56390 - DNA, 21 bp, Artificial sequence
  SiRNA target sequence
gtgatatgagatgttgtatta

SEQ ID NO: 56391 - DNA, 21 bp, Artificial sequence
  SiRNA target sequence
tgatatgagatgttgtattac

SEQ ID NO: 56392 - DNA, 21 bp, Artificial sequence
  SiRNA target sequence
gatatgagatgttgtattaca

SEQ ID NO: 56393 - DNA, 21 bp, Artificial sequence
  SiRNA target sequence
atatgagatgttgtattacat

SEQ ID NO: 56394 - DNA, 21 bp, Artificial sequence
  SiRNA target sequence
tatgagatgttgtattacatt

SEQ ID NO: 56395 - DNA, 21 bp, Artificial sequence
  SiRNA target sequence
atgagatgttgtattacatta

SEQ ID NO: 56396 - DNA, 21 bp, Artificial sequence
  SiRNA target sequence
tgagatgttgtattacattat

SEQ ID NO: 56397 - DNA, 21 bp, Artificial sequence
  SiRNA target sequence
gagatgttgtattacattata

SEQ ID NO: 56398 - DNA, 21 bp, Artificial sequence
  SiRNA target sequence
agatgttgtattacattatag

SEQ ID NO: 56399 - DNA, 21 bp, Artificial sequence
  SiRNA target sequence
gatgttgtattacattataga

SEQ ID NO: 56400 - DNA, 21 bp, Artificial sequence
  SiRNA target sequence
atgttgtattacattatagaa

SEQ ID NO: 56401 - DNA, 21 bp, Artificial sequence
  SiRNA target sequence
tgttgtattacattatagaaa

SEQ ID NO: 56402 - DNA, 21 bp, Artificial sequence
  SiRNA target sequence
gttgtattacattatagaaat

SEQ ID NO: 56403 - DNA, 21 bp, Artificial sequence
  SiRNA target sequence
ttgtattacattatagaaatt

SEQ ID NO: 56404 - DNA, 21 bp, Artificial sequence
  SiRNA target sequence
tgtattacattatagaaatta

SEQ ID NO: 56405 - DNA, 21 bp, Artificial sequence
  SiRNA target sequence
gtattacattatagaaattag

SEQ ID NO: 56406 - DNA, 21 bp, Artificial sequence
  SiRNA target sequence
tattacattatagaaattaga

SEQ ID NO: 56407 - DNA, 21 bp, Artificial sequence
  SiRNA target sequence
attacattatagaaattagag

SEQ ID NO: 56408 - DNA, 21 bp, Artificial sequence
  SiRNA target sequence
ttacattatagaaattagagt

SEQ ID NO: 56409 - DNA, 21 bp, Artificial sequence
  SiRNA target sequence
tacattatagaaattagagtt

SEQ ID NO: 56410 - DNA, 21 bp, Artificial sequence
  SiRNA target sequence
acattatagaaattagagttt

SEQ ID NO: 56411 - DNA, 21 bp, Artificial sequence
  SiRNA target sequence
cattatagaaattagagtttt

SEQ ID NO: 56412 - DNA, 21 bp, Artificial sequence
  SiRNA target sequence
attatagaaattagagttttt

SEQ ID NO: 56413 - DNA, 21 bp, Artificial sequence
  SiRNA target sequence
ttatagaaattagagtttttt

SEQ ID NO: 56414 - DNA, 21 bp, Artificial sequence
  SiRNA target sequence
tatagaaattagagttttttg

SEQ ID NO: 56415 - DNA, 21 bp, Artificial sequence
  SiRNA target sequence
atagaaattagagttttttgg

SEQ ID NO: 56416 - DNA, 21 bp, Artificial sequence
  SiRNA target sequence
tagaaattagagttttttggc

SEQ ID NO: 56417 - DNA, 21 bp, Artificial sequence
  SiRNA target sequence
agaaattagagttttttggct

SEQ ID NO: 56418 - DNA, 21 bp, Artificial sequence
  SiRNA target sequence
gaaattagagttttttggctc

SEQ ID NO: 56419 - DNA, 21 bp, Artificial sequence
  SiRNA target sequence
aaattagagttttttggctct

SEQ ID NO: 56420 - DNA, 21 bp, Artificial sequence
  SiRNA target sequence
aattagagttttttggctctg

SEQ ID NO: 56421 - DNA, 21 bp, Artificial sequence
  SiRNA target sequence
attagagttttttggctctgg

SEQ ID NO: 56422 - DNA, 21 bp, Artificial sequence
  SiRNA target sequence
ttagagttttttggctctggg

SEQ ID NO: 56423 - DNA, 21 bp, Artificial sequence
  SiRNA target sequence
tagagttttttggctctgggg

SEQ ID NO: 56424 - DNA, 21 bp, Artificial sequence
  SiRNA target sequence
agagttttttggctctgggga

SEQ ID NO: 56425 - DNA, 21 bp, Artificial sequence
  SiRNA target sequence
gagttttttggctctggggat

SEQ ID NO: 56426 - DNA, 21 bp, Artificial sequence
  SiRNA target sequence
agttttttggctctggggata

SEQ ID NO: 56427 - DNA, 21 bp, Artificial sequence
  SiRNA target sequence
gttttttggctctggggatag

SEQ ID NO: 56428 - DNA, 21 bp, Artificial sequence
  SiRNA target sequence
ttttttggctctggggatagt

SEQ ID NO: 56429 - DNA, 21 bp, Artificial sequence
  SiRNA target sequence
tttttggctctggggatagta

SEQ ID NO: 56430 - DNA, 21 bp, Artificial sequence
  SiRNA target sequence
ttttggctctggggatagtat

SEQ ID NO: 56431 - DNA, 21 bp, Artificial sequence
  SiRNA target sequence
tttggctctggggatagtatg

SEQ ID NO: 56432 - DNA, 21 bp, Artificial sequence
  SiRNA target sequence
ttggctctggggatagtatga

SEQ ID NO: 56433 - DNA, 21 bp, Artificial sequence
  SiRNA target sequence
tggctctggggatagtatgat

SEQ ID NO: 56434 - DNA, 21 bp, Artificial sequence
  SiRNA target sequence
ggctctggggatagtatgatc

SEQ ID NO: 56435 - DNA, 21 bp, Artificial sequence
  SiRNA target sequence
gctctggggatagtatgatcg

SEQ ID NO: 56436 - DNA, 21 bp, Artificial sequence
  SiRNA target sequence
ctctggggatagtatgatcgc

SEQ ID NO: 56437 - DNA, 21 bp, Artificial sequence
  SiRNA target sequence
tctggggatagtatgatcgca

SEQ ID NO: 56438 - DNA, 21 bp, Artificial sequence
  SiRNA target sequence
ctggggatagtatgatcgcaa

SEQ ID NO: 56439 - DNA, 21 bp, Artificial sequence
  SiRNA target sequence
tggggatagtatgatcgcaag

SEQ ID NO: 56440 - DNA, 21 bp, Artificial sequence
  SiRNA target sequence
ggggatagtatgatcgcaaga

SEQ ID NO: 56441 - DNA, 21 bp, Artificial sequence
  SiRNA target sequence
gggatagtatgatcgcaagat

SEQ ID NO: 56442 - DNA, 21 bp, Artificial sequence
  SiRNA target sequence
ggatagtatgatcgcaagatt

SEQ ID NO: 56443 - DNA, 21 bp, Artificial sequence
  SiRNA target sequence
gatagtatgatcgcaagattg

SEQ ID NO: 56444 - DNA, 21 bp, Artificial sequence
  SiRNA target sequence
atagtatgatcgcaagattga

SEQ ID NO: 56445 - DNA, 21 bp, Artificial sequence
  SiRNA target sequence
tagtatgatcgcaagattgaa

SEQ ID NO: 56446 - DNA, 21 bp, Artificial sequence
  SiRNA target sequence
agtatgatcgcaagattgaaa

SEQ ID NO: 56447 - DNA, 21 bp, Artificial sequence
  SiRNA target sequence
gtatgatcgcaagattgaaaa

SEQ ID NO: 56448 - DNA, 21 bp, Artificial sequence
  SiRNA target sequence
tatgatcgcaagattgaaaat

SEQ ID NO: 56449 - DNA, 21 bp, Artificial sequence
  SiRNA target sequence
atgatcgcaagattgaaaatt

SEQ ID NO: 56450 - DNA, 21 bp, Artificial sequence
  SiRNA target sequence
tgatcgcaagattgaaaatta

SEQ ID NO: 56451 - DNA, 21 bp, Artificial sequence
  SiRNA target sequence
gatcgcaagattgaaaattaa

SEQ ID NO: 56452 - DNA, 21 bp, Artificial sequence
  SiRNA target sequence
atcgcaagattgaaaattaaa

SEQ ID NO: 56453 - DNA, 21 bp, Artificial sequence
  SiRNA target sequence
tcgcaagattgaaaattaaag

SEQ ID NO: 56454 - DNA, 21 bp, Artificial sequence
  SiRNA target sequence
cgcaagattgaaaattaaaga

SEQ ID NO: 56455 - DNA, 21 bp, Artificial sequence
  SiRNA target sequence
gcaagattgaaaattaaagaa

SEQ ID NO: 56456 - DNA, 21 bp, Artificial sequence
  SiRNA target sequence
caagattgaaaattaaagaaa

SEQ ID NO: 56457 - DNA, 21 bp, Artificial sequence
  SiRNA target sequence
aagattgaaaattaaagaaat

SEQ ID NO: 56458 - DNA, 21 bp, Artificial sequence
  SiRNA target sequence
agattgaaaattaaagaaatt

SEQ ID NO: 56459 - DNA, 21 bp, Artificial sequence
  SiRNA target sequence
gattgaaaattaaagaaattg

SEQ ID NO: 56460 - DNA, 21 bp, Artificial sequence
  SiRNA target sequence
attgaaaattaaagaaattga

SEQ ID NO: 56461 - DNA, 21 bp, Artificial sequence
  SiRNA target sequence
ttgaaaattaaagaaattgac

SEQ ID NO: 56462 - DNA, 21 bp, Artificial sequence
  SiRNA target sequence
tgaaaattaaagaaattgacg

SEQ ID NO: 56463 - DNA, 21 bp, Artificial sequence
  SiRNA target sequence
gaaaattaaagaaattgacgg

SEQ ID NO: 56464 - DNA, 21 bp, Artificial sequence
  SiRNA target sequence
aaaattaaagaaattgacgga

SEQ ID NO: 56465 - DNA, 21 bp, Artificial sequence
  SiRNA target sequence
aaattaaagaaattgacggaa

SEQ ID NO: 56466 - DNA, 21 bp, Artificial sequence
  SiRNA target sequence
aattaaagaaattgacggaag

SEQ ID NO: 56467 - DNA, 21 bp, Artificial sequence
  SiRNA target sequence
attaaagaaattgacggaaga

SEQ ID NO: 56468 - DNA, 21 bp, Artificial sequence
  SiRNA target sequence
ttaaagaaattgacggaagaa

SEQ ID NO: 56469 - DNA, 21 bp, Artificial sequence
  SiRNA target sequence
taaagaaattgacggaagaat

SEQ ID NO: 56470 - DNA, 21 bp, Artificial sequence
  SiRNA target sequence
aaagaaattgacggaagaata

SEQ ID NO: 56471 - DNA, 21 bp, Artificial sequence
  SiRNA target sequence
aagaaattgacggaagaatac

SEQ ID NO: 56472 - DNA, 21 bp, Artificial sequence
  SiRNA target sequence
agaaattgacggaagaatacc

SEQ ID NO: 56473 - DNA, 21 bp, Artificial sequence
  SiRNA target sequence
gaaattgacggaagaatacca

SEQ ID NO: 56474 - DNA, 21 bp, Artificial sequence
  SiRNA target sequence
aaattgacggaagaataccac

SEQ ID NO: 56475 - DNA, 21 bp, Artificial sequence
  SiRNA target sequence
aattgacggaagaataccaca

SEQ ID NO: 56476 - DNA, 21 bp, Artificial sequence
  SiRNA target sequence
attgacggaagaataccacaa

SEQ ID NO: 56477 - DNA, 21 bp, Artificial sequence
  SiRNA target sequence
ttgacggaagaataccacaag

SEQ ID NO: 56478 - DNA, 21 bp, Artificial sequence
  SiRNA target sequence
tgacggaagaataccacaagg

SEQ ID NO: 56479 - DNA, 21 bp, Artificial sequence
  SiRNA target sequence
gacggaagaataccacaagga

SEQ ID NO: 56480 - DNA, 21 bp, Artificial sequence
  SiRNA target sequence
acggaagaataccacaaggag

SEQ ID NO: 56481 - DNA, 21 bp, Artificial sequence
  SiRNA target sequence
cggaagaataccacaaggagt

SEQ ID NO: 56482 - DNA, 21 bp, Artificial sequence
  SiRNA target sequence
ggaagaataccacaaggagtg

SEQ ID NO: 56483 - DNA, 21 bp, Artificial sequence
  SiRNA target sequence
gaagaataccacaaggagtgg

SEQ ID NO: 56484 - DNA, 21 bp, Artificial sequence
  SiRNA target sequence
aagaataccacaaggagtgga

SEQ ID NO: 56485 - DNA, 21 bp, Artificial sequence
  SiRNA target sequence
agaataccacaaggagtggat

SEQ ID NO: 56486 - DNA, 21 bp, Artificial sequence
  SiRNA target sequence
gaataccacaaggagtggatt

SEQ ID NO: 56487 - DNA, 21 bp, Artificial sequence
  SiRNA target sequence
aataccacaaggagtggattg

SEQ ID NO: 56488 - DNA, 21 bp, Artificial sequence
  SiRNA target sequence
ataccacaaggagtggattgt

SEQ ID NO: 56489 - DNA, 21 bp, Artificial sequence
  SiRNA target sequence
taccacaaggagtggattgtg

SEQ ID NO: 56490 - DNA, 21 bp, Artificial sequence
  SiRNA target sequence
accacaaggagtggattgtgc

SEQ ID NO: 56491 - DNA, 21 bp, Artificial sequence
  SiRNA target sequence
ccacaaggagtggattgtgcg

SEQ ID NO: 56492 - DNA, 21 bp, Artificial sequence
  SiRNA target sequence
cacaaggagtggattgtgcgg

SEQ ID NO: 56493 - DNA, 21 bp, Artificial sequence
  SiRNA target sequence
acaaggagtggattgtgcggc

SEQ ID NO: 56494 - DNA, 21 bp, Artificial sequence
  SiRNA target sequence
caaggagtggattgtgcggct

SEQ ID NO: 56495 - DNA, 21 bp, Artificial sequence
  SiRNA target sequence
aaggagtggattgtgcggctt

SEQ ID NO: 56496 - DNA, 21 bp, Artificial sequence
  SiRNA target sequence
aggagtggattgtgcggctta

SEQ ID NO: 56497 - DNA, 21 bp, Artificial sequence
  SiRNA target sequence
ggagtggattgtgcggcttaa

SEQ ID NO: 56498 - DNA, 21 bp, Artificial sequence
  SiRNA target sequence
gagtggattgtgcggcttaat

SEQ ID NO: 56499 - DNA, 21 bp, Artificial sequence
  SiRNA target sequence
agtggattgtgcggcttaatt

SEQ ID NO: 56500 - DNA, 21 bp, Artificial sequence
  SiRNA target sequence
gtggattgtgcggcttaattt

SEQ ID NO: 56501 - DNA, 21 bp, Artificial sequence
  SiRNA target sequence
tggattgtgcggcttaatttg

SEQ ID NO: 56502 - DNA, 21 bp, Artificial sequence
  SiRNA target sequence
ggattgtgcggcttaatttga

SEQ ID NO: 56503 - DNA, 21 bp, Artificial sequence
  SiRNA target sequence
gattgtgcggcttaatttgac

SEQ ID NO: 56504 - DNA, 21 bp, Artificial sequence
  SiRNA target sequence
attgtgcggcttaatttgact

SEQ ID NO: 56505 - DNA, 21 bp, Artificial sequence
  SiRNA target sequence
ttgtgcggcttaatttgactc

SEQ ID NO: 56506 - DNA, 21 bp, Artificial sequence
  SiRNA target sequence
tgtgcggcttaatttgactca

SEQ ID NO: 56507 - DNA, 21 bp, Artificial sequence
  SiRNA target sequence
gtgcggcttaatttgactcaa

SEQ ID NO: 56508 - DNA, 21 bp, Artificial sequence
  SiRNA target sequence
tgcggcttaatttgactcaac

SEQ ID NO: 56509 - DNA, 21 bp, Artificial sequence
  SiRNA target sequence
gcggcttaatttgactcaacg

SEQ ID NO: 56510 - DNA, 21 bp, Artificial sequence
  SiRNA target sequence
cggcttaatttgactcaacgc

SEQ ID NO: 56511 - DNA, 21 bp, Artificial sequence
  SiRNA target sequence
ggcttaatttgactcaacgcg

SEQ ID NO: 56512 - DNA, 21 bp, Artificial sequence
  SiRNA target sequence
gcttaatttgactcaacgcga

SEQ ID NO: 56513 - DNA, 21 bp, Artificial sequence
  SiRNA target sequence
cttaatttgactcaacgcgag

SEQ ID NO: 56514 - DNA, 21 bp, Artificial sequence
  SiRNA target sequence
ttaatttgactcaacgcgagg

SEQ ID NO: 56515 - DNA, 21 bp, Artificial sequence
  SiRNA target sequence
taatttgactcaacgcgaggt

SEQ ID NO: 56516 - DNA, 21 bp, Artificial sequence
  SiRNA target sequence
aatttgactcaacgcgaggta

SEQ ID NO: 56517 - DNA, 21 bp, Artificial sequence
  SiRNA target sequence
atttgactcaacgcgaggtaa

SEQ ID NO: 56518 - DNA, 21 bp, Artificial sequence
  SiRNA target sequence
tttgactcaacgcgaggtaac

SEQ ID NO: 56519 - DNA, 21 bp, Artificial sequence
  SiRNA target sequence
ttgactcaacgcgaggtaact

SEQ ID NO: 56520 - DNA, 21 bp, Artificial sequence
  SiRNA target sequence
tgactcaacgcgaggtaactt

SEQ ID NO: 56521 - DNA, 21 bp, Artificial sequence
  SiRNA target sequence
gactcaacgcgaggtaactta

SEQ ID NO: 56522 - DNA, 21 bp, Artificial sequence
  SiRNA target sequence
actcaacgcgaggtaacttac

SEQ ID NO: 56523 - DNA, 21 bp, Artificial sequence
  SiRNA target sequence
ctcaacgcgaggtaacttacc

SEQ ID NO: 56524 - DNA, 21 bp, Artificial sequence
  SiRNA target sequence
tcaacgcgaggtaacttacca

SEQ ID NO: 56525 - DNA, 21 bp, Artificial sequence
  SiRNA target sequence
caacgcgaggtaacttaccaa

SEQ ID NO: 56526 - DNA, 21 bp, Artificial sequence
  SiRNA target sequence
aacgcgaggtaacttaccaat

SEQ ID NO: 56527 - DNA, 21 bp, Artificial sequence
  SiRNA target sequence
acgcgaggtaacttaccaata

SEQ ID NO: 56528 - DNA, 21 bp, Artificial sequence
  SiRNA target sequence
cgcgaggtaacttaccaatat

SEQ ID NO: 56529 - DNA, 21 bp, Artificial sequence
  SiRNA target sequence
gcgaggtaacttaccaatatt

SEQ ID NO: 56530 - DNA, 21 bp, Artificial sequence
  SiRNA target sequence
cgaggtaacttaccaatattt

SEQ ID NO: 56531 - DNA, 21 bp, Artificial sequence
  SiRNA target sequence
gaggtaacttaccaatatttt

SEQ ID NO: 56532 - DNA, 21 bp, Artificial sequence
  SiRNA target sequence
aggtaacttaccaatatttta

SEQ ID NO: 56533 - DNA, 21 bp, Artificial sequence
  SiRNA target sequence
ggtaacttaccaatattttat

SEQ ID NO: 56534 - DNA, 21 bp, Artificial sequence
  SiRNA target sequence
gtaacttaccaatattttatt

SEQ ID NO: 56535 - DNA, 21 bp, Artificial sequence
  SiRNA target sequence
taacttaccaatattttattg

SEQ ID NO: 56536 - DNA, 21 bp, Artificial sequence
  SiRNA target sequence
aacttaccaatattttattgt

SEQ ID NO: 56537 - DNA, 21 bp, Artificial sequence
  SiRNA target sequence
acttaccaatattttattgtt

SEQ ID NO: 56538 - DNA, 21 bp, Artificial sequence
  SiRNA target sequence
cttaccaatattttattgttc

SEQ ID NO: 56539 - DNA, 21 bp, Artificial sequence
  SiRNA target sequence
ttaccaatattttattgttct

SEQ ID NO: 56540 - DNA, 21 bp, Artificial sequence
  SiRNA target sequence
taccaatattttattgttctg

SEQ ID NO: 56541 - DNA, 21 bp, Artificial sequence
  SiRNA target sequence
accaatattttattgttctgc

SEQ ID NO: 56542 - DNA, 21 bp, Artificial sequence
  SiRNA target sequence
ccaatattttattgttctgcg

SEQ ID NO: 56543 - DNA, 21 bp, Artificial sequence
  SiRNA target sequence
caatattttattgttctgcga

SEQ ID NO: 56544 - DNA, 21 bp, Artificial sequence
  SiRNA target sequence
aatattttattgttctgcgag

SEQ ID NO: 56545 - DNA, 21 bp, Artificial sequence
  SiRNA target sequence
atattttattgttctgcgagg

SEQ ID NO: 56546 - DNA, 21 bp, Artificial sequence
  SiRNA target sequence
tattttattgttctgcgagga

SEQ ID NO: 56547 - DNA, 21 bp, Artificial sequence
  SiRNA target sequence
attttattgttctgcgaggat

SEQ ID NO: 56548 - DNA, 21 bp, Artificial sequence
  SiRNA target sequence
ttttattgttctgcgaggata

SEQ ID NO: 56549 - DNA, 21 bp, Artificial sequence
  SiRNA target sequence
tttattgttctgcgaggatat

SEQ ID NO: 56550 - DNA, 21 bp, Artificial sequence
  SiRNA target sequence
ttattgttctgcgaggatatg

SEQ ID NO: 56551 - DNA, 21 bp, Artificial sequence
  SiRNA target sequence
tattgttctgcgaggatatga

SEQ ID NO: 56552 - DNA, 21 bp, Artificial sequence
  SiRNA target sequence
attgttctgcgaggatatgat

SEQ ID NO: 56553 - DNA, 21 bp, Artificial sequence
  SiRNA target sequence
ttgttctgcgaggatatgatc

SEQ ID NO: 56554 - DNA, 21 bp, Artificial sequence
  SiRNA target sequence
tgttctgcgaggatatgatct

SEQ ID NO: 56555 - DNA, 21 bp, Artificial sequence
  SiRNA target sequence
gttctgcgaggatatgatctg

SEQ ID NO: 56556 - DNA, 21 bp, Artificial sequence
  SiRNA target sequence
ttctgcgaggatatgatctga

SEQ ID NO: 56557 - DNA, 21 bp, Artificial sequence
  SiRNA target sequence
tctgcgaggatatgatctgag

SEQ ID NO: 56558 - DNA, 21 bp, Artificial sequence
  SiRNA target sequence
ctgcgaggatatgatctgagg

SEQ ID NO: 56559 - DNA, 21 bp, Artificial sequence
  SiRNA target sequence
tgcgaggatatgatctgagga

SEQ ID NO: 56560 - DNA, 21 bp, Artificial sequence
  SiRNA target sequence
gcgaggatatgatctgaggat

SEQ ID NO: 56561 - DNA, 21 bp, Artificial sequence
  SiRNA target sequence
cgaggatatgatctgaggatg

SEQ ID NO: 56562 - DNA, 21 bp, Artificial sequence
  SiRNA target sequence
gaggatatgatctgaggatga

SEQ ID NO: 56563 - DNA, 21 bp, Artificial sequence
  SiRNA target sequence
aggatatgatctgaggatgat

SEQ ID NO: 56564 - DNA, 21 bp, Artificial sequence
  SiRNA target sequence
ggatatgatctgaggatgata

SEQ ID NO: 56565 - DNA, 21 bp, Artificial sequence
  SiRNA target sequence
gatatgatctgaggatgataa

SEQ ID NO: 56566 - DNA, 21 bp, Artificial sequence
  SiRNA target sequence
atatgatctgaggatgataat

SEQ ID NO: 56567 - DNA, 21 bp, Artificial sequence
  SiRNA target sequence
tatgatctgaggatgataata

SEQ ID NO: 56568 - DNA, 21 bp, Artificial sequence
  SiRNA target sequence
atgatctgaggatgataatag

SEQ ID NO: 56569 - DNA, 21 bp, Artificial sequence
  SiRNA target sequence
tgatctgaggatgataatagt

SEQ ID NO: 56570 - DNA, 21 bp, Artificial sequence
  SiRNA target sequence
gatctgaggatgataatagtg

SEQ ID NO: 56571 - DNA, 21 bp, Artificial sequence
  SiRNA target sequence
atctgaggatgataatagtgg

SEQ ID NO: 56572 - DNA, 21 bp, Artificial sequence
  SiRNA target sequence
tctgaggatgataatagtggt

SEQ ID NO: 56573 - DNA, 21 bp, Artificial sequence
  SiRNA target sequence
ctgaggatgataatagtggtg

SEQ ID NO: 56574 - DNA, 21 bp, Artificial sequence
  SiRNA target sequence
tgaggatgataatagtggtgc

SEQ ID NO: 56575 - DNA, 21 bp, Artificial sequence
  SiRNA target sequence
gaggatgataatagtggtgca

SEQ ID NO: 56576 - DNA, 21 bp, Artificial sequence
  SiRNA target sequence
aggatgataatagtggtgcat

SEQ ID NO: 56577 - DNA, 21 bp, Artificial sequence
  SiRNA target sequence
ggatgataatagtggtgcatg

SEQ ID NO: 56578 - DNA, 21 bp, Artificial sequence
  SiRNA target sequence
gatgataatagtggtgcatgg

SEQ ID NO: 56579 - DNA, 21 bp, Artificial sequence
  SiRNA target sequence
atgataatagtggtgcatggc

SEQ ID NO: 56580 - DNA, 21 bp, Artificial sequence
  SiRNA target sequence
tgataatagtggtgcatggcc

SEQ ID NO: 56581 - DNA, 21 bp, Artificial sequence
  SiRNA target sequence
gataatagtggtgcatggccg

SEQ ID NO: 56582 - DNA, 21 bp, Artificial sequence
  SiRNA target sequence
ataatagtggtgcatggccgt

SEQ ID NO: 56583 - DNA, 21 bp, Artificial sequence
  SiRNA target sequence
taatagtggtgcatggccgtt

SEQ ID NO: 56584 - DNA, 21 bp, Artificial sequence
  SiRNA target sequence
aatagtggtgcatggccgttt

SEQ ID NO: 56585 - DNA, 21 bp, Artificial sequence
  SiRNA target sequence
atagtggtgcatggccgtttt

SEQ ID NO: 56586 - DNA, 21 bp, Artificial sequence
  SiRNA target sequence
tagtggtgcatggccgttttc

SEQ ID NO: 56587 - DNA, 21 bp, Artificial sequence
  SiRNA target sequence
agtggtgcatggccgttttca

SEQ ID NO: 56588 - DNA, 21 bp, Artificial sequence
  SiRNA target sequence
gtggtgcatggccgttttcaa

SEQ ID NO: 56589 - DNA, 21 bp, Artificial sequence
  SiRNA target sequence
tggtgcatggccgttttcaat

SEQ ID NO: 56590 - DNA, 21 bp, Artificial sequence
  SiRNA target sequence
ggtgcatggccgttttcaatg

SEQ ID NO: 56591 - DNA, 21 bp, Artificial sequence
  SiRNA target sequence
gtgcatggccgttttcaatgg

SEQ ID NO: 56592 - DNA, 21 bp, Artificial sequence
  SiRNA target sequence
tgcatggccgttttcaatgga

SEQ ID NO: 56593 - DNA, 21 bp, Artificial sequence
  SiRNA target sequence
gcatggccgttttcaatggat

SEQ ID NO: 56594 - DNA, 21 bp, Artificial sequence
  SiRNA target sequence
catggccgttttcaatggatg

SEQ ID NO: 56595 - DNA, 21 bp, Artificial sequence
  SiRNA target sequence
atggccgttttcaatggatgc

SEQ ID NO: 56596 - DNA, 21 bp, Artificial sequence
  SiRNA target sequence
tggccgttttcaatggatgct

SEQ ID NO: 56597 - DNA, 21 bp, Artificial sequence
  SiRNA target sequence
ggccgttttcaatggatgctg

SEQ ID NO: 56598 - DNA, 21 bp, Artificial sequence
  SiRNA target sequence
gccgttttcaatggatgctgt

SEQ ID NO: 56599 - DNA, 21 bp, Artificial sequence
  SiRNA target sequence
ccgttttcaatggatgctgtg

SEQ ID NO: 56600 - DNA, 21 bp, Artificial sequence
  SiRNA target sequence
cgttttcaatggatgctgtga

SEQ ID NO: 56601 - DNA, 21 bp, Artificial sequence
  SiRNA target sequence
ttgccgacgatgtgatatgag

SEQ ID NO: 56602 - DNA, 21 bp, Artificial sequence
  SiRNA target sequence
tgccgacgatgtgatatgaga

SEQ ID NO: 56603 - DNA, 21 bp, Artificial sequence
  SiRNA target sequence
gccgacgatgtgatatgagat

SEQ ID NO: 56604 - DNA, 21 bp, Artificial sequence
  SiRNA target sequence
ccgacgatgtgatatgagatg

SEQ ID NO: 56605 - DNA, 21 bp, Artificial sequence
  SiRNA target sequence
cgacgatgtgatatgagatgt

SEQ ID NO: 56606 - DNA, 21 bp, Artificial sequence
  SiRNA target sequence
gacgatgtgatatgagatgtt

SEQ ID NO: 56607 - DNA, 21 bp, Artificial sequence
  SiRNA target sequence
acgatgtgatatgagatgttg

SEQ ID NO: 56608 - DNA, 21 bp, Artificial sequence
  SiRNA target sequence
cgatgtgatatgagatgttgt

SEQ ID NO: 56609 - DNA, 21 bp, Artificial sequence
  SiRNA target sequence
gatgtgatatgagatgttgta

SEQ ID NO: 56610 - DNA, 21 bp, Artificial sequence
  SiRNA target sequence
atgtgatatgagatgttgtat

SEQ ID NO: 56611 - DNA, 21 bp, Artificial sequence
  SiRNA target sequence
tgtgatatgagatgttgtatt

SEQ ID NO: 56612 - DNA, 21 bp, Artificial sequence
  SiRNA target sequence
gtgatatgagatgttgtatta

SEQ ID NO: 56613 - DNA, 21 bp, Artificial sequence
  SiRNA target sequence
tgatatgagatgttgtattac

SEQ ID NO: 56614 - DNA, 21 bp, Artificial sequence
  SiRNA target sequence
gatatgagatgttgtattaca

SEQ ID NO: 56615 - DNA, 21 bp, Artificial sequence
  SiRNA target sequence
atatgagatgttgtattacat

SEQ ID NO: 56616 - DNA, 21 bp, Artificial sequence
  SiRNA target sequence
tatgagatgttgtattacatt

SEQ ID NO: 56617 - DNA, 21 bp, Artificial sequence
  SiRNA target sequence
atgagatgttgtattacatta

SEQ ID NO: 56618 - DNA, 21 bp, Artificial sequence
  SiRNA target sequence
tgagatgttgtattacattat

SEQ ID NO: 56619 - DNA, 21 bp, Artificial sequence
  SiRNA target sequence
gagatgttgtattacattata

SEQ ID NO: 56620 - DNA, 21 bp, Artificial sequence
  SiRNA target sequence
agatgttgtattacattatag

SEQ ID NO: 56621 - DNA, 21 bp, Artificial sequence
  SiRNA target sequence
gatgttgtattacattataga

SEQ ID NO: 56622 - DNA, 21 bp, Artificial sequence
  SiRNA target sequence
atgttgtattacattatagaa

SEQ ID NO: 56623 - DNA, 21 bp, Artificial sequence
  SiRNA target sequence
tgttgtattacattatagaaa

SEQ ID NO: 56624 - DNA, 21 bp, Artificial sequence
  SiRNA target sequence
gttgtattacattatagaaat

SEQ ID NO: 56625 - DNA, 21 bp, Artificial sequence
  SiRNA target sequence
ttgtattacattatagaaatt

SEQ ID NO: 56626 - DNA, 21 bp, Artificial sequence
  SiRNA target sequence
tgtattacattatagaaatta

SEQ ID NO: 56627 - DNA, 21 bp, Artificial sequence
  SiRNA target sequence
gtattacattatagaaattag

SEQ ID NO: 56628 - DNA, 21 bp, Artificial sequence
  SiRNA target sequence
tattacattatagaaattaga

SEQ ID NO: 56629 - DNA, 21 bp, Artificial sequence
  SiRNA target sequence
attacattatagaaattagag

SEQ ID NO: 56630 - DNA, 21 bp, Artificial sequence
  SiRNA target sequence
ttacattatagaaattagagt

SEQ ID NO: 56631 - DNA, 21 bp, Artificial sequence
  SiRNA target sequence
tacattatagaaattagagtt

SEQ ID NO: 56632 - DNA, 21 bp, Artificial sequence
  SiRNA target sequence
acattatagaaattagagttt

SEQ ID NO: 56633 - DNA, 21 bp, Artificial sequence
  SiRNA target sequence
cattatagaaattagagtttt

SEQ ID NO: 56634 - DNA, 21 bp, Artificial sequence
  SiRNA target sequence
attatagaaattagagttttt

SEQ ID NO: 56635 - DNA, 21 bp, Artificial sequence
  SiRNA target sequence
ttatagaaattagagtttttt

SEQ ID NO: 56636 - DNA, 21 bp, Artificial sequence
  SiRNA target sequence
tatagaaattagagttttttg

SEQ ID NO: 56637 - DNA, 21 bp, Artificial sequence
  SiRNA target sequence
atagaaattagagttttttgg

SEQ ID NO: 56638 - DNA, 21 bp, Artificial sequence
  SiRNA target sequence
tagaaattagagttttttggc

SEQ ID NO: 56639 - DNA, 21 bp, Artificial sequence
  SiRNA target sequence
agaaattagagttttttggct

SEQ ID NO: 56640 - DNA, 21 bp, Artificial sequence
  SiRNA target sequence
gaaattagagttttttggctc

SEQ ID NO: 56641 - DNA, 21 bp, Artificial sequence
  SiRNA target sequence
aaattagagttttttggctct

SEQ ID NO: 56642 - DNA, 21 bp, Artificial sequence
  SiRNA target sequence
aattagagttttttggctctg

SEQ ID NO: 56643 - DNA, 21 bp, Artificial sequence
  SiRNA target sequence
attagagttttttggctctgg

SEQ ID NO: 56644 - DNA, 21 bp, Artificial sequence
  SiRNA target sequence
ttagagttttttggctctggg

SEQ ID NO: 56645 - DNA, 21 bp, Artificial sequence
  SiRNA target sequence
tagagttttttggctctgggg

SEQ ID NO: 56646 - DNA, 21 bp, Artificial sequence
  SiRNA target sequence
agagttttttggctctgggga

SEQ ID NO: 56647 - DNA, 21 bp, Artificial sequence
  SiRNA target sequence
gagttttttggctctggggat

SEQ ID NO: 56648 - DNA, 21 bp, Artificial sequence
  SiRNA target sequence
agttttttggctctggggata

SEQ ID NO: 56649 - DNA, 21 bp, Artificial sequence
  SiRNA target sequence
gttttttggctctggggatag

SEQ ID NO: 56650 - DNA, 21 bp, Artificial sequence
  SiRNA target sequence
ttttttggctctggggatagt

SEQ ID NO: 56651 - DNA, 21 bp, Artificial sequence
  SiRNA target sequence
tttttggctctggggatagta

SEQ ID NO: 56652 - DNA, 21 bp, Artificial sequence
  SiRNA target sequence
ttttggctctggggatagtat

SEQ ID NO: 56653 - DNA, 21 bp, Artificial sequence
  SiRNA target sequence
tttggctctggggatagtatg

SEQ ID NO: 56654 - DNA, 21 bp, Artificial sequence
  SiRNA target sequence
ttggctctggggatagtatga

SEQ ID NO: 56655 - DNA, 21 bp, Artificial sequence
  SiRNA target sequence
tggctctggggatagtatgat

SEQ ID NO: 56656 - DNA, 21 bp, Artificial sequence
  SiRNA target sequence
ggctctggggatagtatgatc

SEQ ID NO: 56657 - DNA, 21 bp, Artificial sequence
  SiRNA target sequence
gctctggggatagtatgatcg

SEQ ID NO: 56658 - DNA, 21 bp, Artificial sequence
  SiRNA target sequence
ctctggggatagtatgatcgc

SEQ ID NO: 56659 - DNA, 21 bp, Artificial sequence
  SiRNA target sequence
tctggggatagtatgatcgca

SEQ ID NO: 56660 - DNA, 21 bp, Artificial sequence
  SiRNA target sequence
ctggggatagtatgatcgcaa

SEQ ID NO: 56661 - DNA, 21 bp, Artificial sequence
  SiRNA target sequence
tggggatagtatgatcgcaag

SEQ ID NO: 56662 - DNA, 21 bp, Artificial sequence
  SiRNA target sequence
ggggatagtatgatcgcaaga

SEQ ID NO: 56663 - DNA, 21 bp, Artificial sequence
  SiRNA target sequence
gggatagtatgatcgcaagat

SEQ ID NO: 56664 - DNA, 21 bp, Artificial sequence
  SiRNA target sequence
ggatagtatgatcgcaagatt

SEQ ID NO: 56665 - DNA, 21 bp, Artificial sequence
  SiRNA target sequence
gatagtatgatcgcaagattg

SEQ ID NO: 56666 - DNA, 21 bp, Artificial sequence
  SiRNA target sequence
atagtatgatcgcaagattga

SEQ ID NO: 56667 - DNA, 21 bp, Artificial sequence
  SiRNA target sequence
tagtatgatcgcaagattgaa

SEQ ID NO: 56668 - DNA, 21 bp, Artificial sequence
  SiRNA target sequence
agtatgatcgcaagattgaaa

SEQ ID NO: 56669 - DNA, 21 bp, Artificial sequence
  SiRNA target sequence
gtatgatcgcaagattgaaaa

SEQ ID NO: 56670 - DNA, 21 bp, Artificial sequence
  SiRNA target sequence
tatgatcgcaagattgaaaat

SEQ ID NO: 56671 - DNA, 21 bp, Artificial sequence
  SiRNA target sequence
atgatcgcaagattgaaaatt

SEQ ID NO: 56672 - DNA, 21 bp, Artificial sequence
  SiRNA target sequence
tgatcgcaagattgaaaatta

SEQ ID NO: 56673 - DNA, 21 bp, Artificial sequence
  SiRNA target sequence
gatcgcaagattgaaaattaa

SEQ ID NO: 56674 - DNA, 21 bp, Artificial sequence
  SiRNA target sequence
atcgcaagattgaaaattaaa

SEQ ID NO: 56675 - DNA, 21 bp, Artificial sequence
  SiRNA target sequence
tcgcaagattgaaaattaaag

SEQ ID NO: 56676 - DNA, 21 bp, Artificial sequence
  SiRNA target sequence
cgcaagattgaaaattaaaga

SEQ ID NO: 56677 - DNA, 21 bp, Artificial sequence
  SiRNA target sequence
gcaagattgaaaattaaagaa

SEQ ID NO: 56678 - DNA, 21 bp, Artificial sequence
  SiRNA target sequence
caagattgaaaattaaagaaa

SEQ ID NO: 56679 - DNA, 21 bp, Artificial sequence
  SiRNA target sequence
aagattgaaaattaaagaaat

SEQ ID NO: 56680 - DNA, 21 bp, Artificial sequence
  SiRNA target sequence
agattgaaaattaaagaaatt

SEQ ID NO: 56681 - DNA, 21 bp, Artificial sequence
  SiRNA target sequence
gattgaaaattaaagaaattg

SEQ ID NO: 56682 - DNA, 21 bp, Artificial sequence
  SiRNA target sequence
attgaaaattaaagaaattga

SEQ ID NO: 56683 - DNA, 21 bp, Artificial sequence
  SiRNA target sequence
ttgaaaattaaagaaattgac

SEQ ID NO: 56684 - DNA, 21 bp, Artificial sequence
  SiRNA target sequence
tgaaaattaaagaaattgacg

SEQ ID NO: 56685 - DNA, 21 bp, Artificial sequence
  SiRNA target sequence
gaaaattaaagaaattgacgg

SEQ ID NO: 56686 - DNA, 21 bp, Artificial sequence
  SiRNA target sequence
aaaattaaagaaattgacgga

SEQ ID NO: 56687 - DNA, 21 bp, Artificial sequence
  SiRNA target sequence
aaattaaagaaattgacggaa

SEQ ID NO: 56688 - DNA, 21 bp, Artificial sequence
  SiRNA target sequence
aattaaagaaattgacggaag

SEQ ID NO: 56689 - DNA, 21 bp, Artificial sequence
  SiRNA target sequence
attaaagaaattgacggaaga

SEQ ID NO: 56690 - DNA, 21 bp, Artificial sequence
  SiRNA target sequence
ttaaagaaattgacggaagaa

SEQ ID NO: 56691 - DNA, 21 bp, Artificial sequence
  SiRNA target sequence
taaagaaattgacggaagaat

SEQ ID NO: 56692 - DNA, 21 bp, Artificial sequence
  SiRNA target sequence
aaagaaattgacggaagaata

SEQ ID NO: 56693 - DNA, 21 bp, Artificial sequence
  SiRNA target sequence
aagaaattgacggaagaatac

SEQ ID NO: 56694 - DNA, 21 bp, Artificial sequence
  SiRNA target sequence
agaaattgacggaagaatacc

SEQ ID NO: 56695 - DNA, 21 bp, Artificial sequence
  SiRNA target sequence
gaaattgacggaagaatacca

SEQ ID NO: 56696 - DNA, 21 bp, Artificial sequence
  SiRNA target sequence
aaattgacggaagaataccac

SEQ ID NO: 56697 - DNA, 21 bp, Artificial sequence
  SiRNA target sequence
aattgacggaagaataccaca

SEQ ID NO: 56698 - DNA, 21 bp, Artificial sequence
  SiRNA target sequence
attgacggaagaataccacaa

SEQ ID NO: 56699 - DNA, 21 bp, Artificial sequence
  SiRNA target sequence
ttgacggaagaataccacaag

SEQ ID NO: 56700 - DNA, 21 bp, Artificial sequence
  SiRNA target sequence
tgacggaagaataccacaagg

SEQ ID NO: 56701 - DNA, 21 bp, Artificial sequence
  SiRNA target sequence
gacggaagaataccacaagga

SEQ ID NO: 56702 - DNA, 21 bp, Artificial sequence
  SiRNA target sequence
acggaagaataccacaaggag

SEQ ID NO: 56703 - DNA, 21 bp, Artificial sequence
  SiRNA target sequence
cggaagaataccacaaggagt

SEQ ID NO: 56704 - DNA, 21 bp, Artificial sequence
  SiRNA target sequence
ggaagaataccacaaggagtg

SEQ ID NO: 56705 - DNA, 21 bp, Artificial sequence
  SiRNA target sequence
gaagaataccacaaggagtgg

SEQ ID NO: 56706 - DNA, 21 bp, Artificial sequence
  SiRNA target sequence
aagaataccacaaggagtgga

SEQ ID NO: 56707 - DNA, 21 bp, Artificial sequence
  SiRNA target sequence
agaataccacaaggagtggat

SEQ ID NO: 56708 - DNA, 21 bp, Artificial sequence
  SiRNA target sequence
gaataccacaaggagtggatt

SEQ ID NO: 56709 - DNA, 21 bp, Artificial sequence
  SiRNA target sequence
aataccacaaggagtggattg

SEQ ID NO: 56710 - DNA, 21 bp, Artificial sequence
  SiRNA target sequence
ataccacaaggagtggattgt

SEQ ID NO: 56711 - DNA, 21 bp, Artificial sequence
  SiRNA target sequence
taccacaaggagtggattgtg

SEQ ID NO: 56712 - DNA, 21 bp, Artificial sequence
  SiRNA target sequence
accacaaggagtggattgtgc

SEQ ID NO: 56713 - DNA, 21 bp, Artificial sequence
  SiRNA target sequence
ccacaaggagtggattgtgcg

SEQ ID NO: 56714 - DNA, 21 bp, Artificial sequence
  SiRNA target sequence
cacaaggagtggattgtgcgg

SEQ ID NO: 56715 - DNA, 21 bp, Artificial sequence
  SiRNA target sequence
acaaggagtggattgtgcggc

SEQ ID NO: 56716 - DNA, 21 bp, Artificial sequence
  SiRNA target sequence
caaggagtggattgtgcggct

SEQ ID NO: 56717 - DNA, 21 bp, Artificial sequence
  SiRNA target sequence
aaggagtggattgtgcggctt

SEQ ID NO: 56718 - DNA, 21 bp, Artificial sequence
  SiRNA target sequence
aggagtggattgtgcggctta

SEQ ID NO: 56719 - DNA, 21 bp, Artificial sequence
  SiRNA target sequence
ggagtggattgtgcggcttaa

SEQ ID NO: 56720 - DNA, 21 bp, Artificial sequence
  SiRNA target sequence
gagtggattgtgcggcttaat

SEQ ID NO: 56721 - DNA, 21 bp, Artificial sequence
  SiRNA target sequence
agtggattgtgcggcttaatt

SEQ ID NO: 56722 - DNA, 21 bp, Artificial sequence
  SiRNA target sequence
gtggattgtgcggcttaattt

SEQ ID NO: 56723 - DNA, 21 bp, Artificial sequence
  SiRNA target sequence
tggattgtgcggcttaatttg

SEQ ID NO: 56724 - DNA, 21 bp, Artificial sequence
  SiRNA target sequence
ggattgtgcggcttaatttga

SEQ ID NO: 56725 - DNA, 21 bp, Artificial sequence
  SiRNA target sequence
gattgtgcggcttaatttgac

SEQ ID NO: 56726 - DNA, 21 bp, Artificial sequence
  SiRNA target sequence
attgtgcggcttaatttgact

SEQ ID NO: 56727 - DNA, 21 bp, Artificial sequence
  SiRNA target sequence
ttgtgcggcttaatttgactc

SEQ ID NO: 56728 - DNA, 21 bp, Artificial sequence
  SiRNA target sequence
tgtgcggcttaatttgactca

SEQ ID NO: 56729 - DNA, 21 bp, Artificial sequence
  SiRNA target sequence
gtgcggcttaatttgactcaa

SEQ ID NO: 56730 - DNA, 21 bp, Artificial sequence
  SiRNA target sequence
tgcggcttaatttgactcaac

SEQ ID NO: 56731 - DNA, 21 bp, Artificial sequence
  SiRNA target sequence
gcggcttaatttgactcaacg

SEQ ID NO: 56732 - DNA, 21 bp, Artificial sequence
  SiRNA target sequence
cggcttaatttgactcaacgc

SEQ ID NO: 56733 - DNA, 21 bp, Artificial sequence
  SiRNA target sequence
ggcttaatttgactcaacgcg

SEQ ID NO: 56734 - DNA, 21 bp, Artificial sequence
  SiRNA target sequence
gcttaatttgactcaacgcga

SEQ ID NO: 56735 - DNA, 21 bp, Artificial sequence
  SiRNA target sequence
cttaatttgactcaacgcgag

SEQ ID NO: 56736 - DNA, 21 bp, Artificial sequence
  SiRNA target sequence
ttaatttgactcaacgcgagg

SEQ ID NO: 56737 - DNA, 21 bp, Artificial sequence
  SiRNA target sequence
taatttgactcaacgcgaggt

SEQ ID NO: 56738 - DNA, 21 bp, Artificial sequence
  SiRNA target sequence
aatttgactcaacgcgaggta

SEQ ID NO: 56739 - DNA, 21 bp, Artificial sequence
  SiRNA target sequence
atttgactcaacgcgaggtaa

SEQ ID NO: 56740 - DNA, 21 bp, Artificial sequence
  SiRNA target sequence
tttgactcaacgcgaggtaac

SEQ ID NO: 56741 - DNA, 21 bp, Artificial sequence
  SiRNA target sequence
ttgactcaacgcgaggtaact

SEQ ID NO: 56742 - DNA, 21 bp, Artificial sequence
  SiRNA target sequence
tgactcaacgcgaggtaactt

SEQ ID NO: 56743 - DNA, 21 bp, Artificial sequence
  SiRNA target sequence
gactcaacgcgaggtaactta

SEQ ID NO: 56744 - DNA, 21 bp, Artificial sequence
  SiRNA target sequence
actcaacgcgaggtaacttac

SEQ ID NO: 56745 - DNA, 21 bp, Artificial sequence
  SiRNA target sequence
ctcaacgcgaggtaacttacc

SEQ ID NO: 56746 - DNA, 21 bp, Artificial sequence
  SiRNA target sequence
tcaacgcgaggtaacttacca

SEQ ID NO: 56747 - DNA, 21 bp, Artificial sequence
  SiRNA target sequence
caacgcgaggtaacttaccaa

SEQ ID NO: 56748 - DNA, 21 bp, Artificial sequence
  SiRNA target sequence
aacgcgaggtaacttaccaat

SEQ ID NO: 56749 - DNA, 21 bp, Artificial sequence
  SiRNA target sequence
acgcgaggtaacttaccaata

SEQ ID NO: 56750 - DNA, 21 bp, Artificial sequence
  SiRNA target sequence
cgcgaggtaacttaccaatat

SEQ ID NO: 56751 - DNA, 21 bp, Artificial sequence
  SiRNA target sequence
gcgaggtaacttaccaatatt

SEQ ID NO: 56752 - DNA, 21 bp, Artificial sequence
  SiRNA target sequence
cgaggtaacttaccaatattt

SEQ ID NO: 56753 - DNA, 21 bp, Artificial sequence
  SiRNA target sequence
gaggtaacttaccaatatttt

SEQ ID NO: 56754 - DNA, 21 bp, Artificial sequence
  SiRNA target sequence
aggtaacttaccaatatttta

SEQ ID NO: 56755 - DNA, 21 bp, Artificial sequence
  SiRNA target sequence
ggtaacttaccaatattttat

SEQ ID NO: 56756 - DNA, 21 bp, Artificial sequence
  SiRNA target sequence
gtaacttaccaatattttatt

SEQ ID NO: 56757 - DNA, 21 bp, Artificial sequence
  SiRNA target sequence
taacttaccaatattttattg

SEQ ID NO: 56758 - DNA, 21 bp, Artificial sequence
  SiRNA target sequence
aacttaccaatattttattgt

SEQ ID NO: 56759 - DNA, 21 bp, Artificial sequence
  SiRNA target sequence
acttaccaatattttattgtt

SEQ ID NO: 56760 - DNA, 21 bp, Artificial sequence
  SiRNA target sequence
cttaccaatattttattgttc

SEQ ID NO: 56761 - DNA, 21 bp, Artificial sequence
  SiRNA target sequence
ttaccaatattttattgttct

SEQ ID NO: 56762 - DNA, 21 bp, Artificial sequence
  SiRNA target sequence
taccaatattttattgttctg

SEQ ID NO: 56763 - DNA, 21 bp, Artificial sequence
  SiRNA target sequence
accaatattttattgttctgc

SEQ ID NO: 56764 - DNA, 21 bp, Artificial sequence
  SiRNA target sequence
ccaatattttattgttctgcg

SEQ ID NO: 56765 - DNA, 21 bp, Artificial sequence
  SiRNA target sequence
caatattttattgttctgcga

SEQ ID NO: 56766 - DNA, 21 bp, Artificial sequence
  SiRNA target sequence
aatattttattgttctgcgag

SEQ ID NO: 56767 - DNA, 21 bp, Artificial sequence
  SiRNA target sequence
atattttattgttctgcgagg

SEQ ID NO: 56768 - DNA, 21 bp, Artificial sequence
  SiRNA target sequence
tattttattgttctgcgagga

SEQ ID NO: 56769 - DNA, 21 bp, Artificial sequence
  SiRNA target sequence
attttattgttctgcgaggat

SEQ ID NO: 56770 - DNA, 21 bp, Artificial sequence
  SiRNA target sequence
ttttattgttctgcgaggata

SEQ ID NO: 56771 - DNA, 21 bp, Artificial sequence
  SiRNA target sequence
tttattgttctgcgaggatat

SEQ ID NO: 56772 - DNA, 21 bp, Artificial sequence
  SiRNA target sequence
ttattgttctgcgaggatatg

SEQ ID NO: 56773 - DNA, 21 bp, Artificial sequence
  SiRNA target sequence
tattgttctgcgaggatatga

SEQ ID NO: 56774 - DNA, 21 bp, Artificial sequence
  SiRNA target sequence
attgttctgcgaggatatgat

SEQ ID NO: 56775 - DNA, 21 bp, Artificial sequence
  SiRNA target sequence
ttgttctgcgaggatatgatc

SEQ ID NO: 56776 - DNA, 21 bp, Artificial sequence
  SiRNA target sequence
tgttctgcgaggatatgatct

SEQ ID NO: 56777 - DNA, 21 bp, Artificial sequence
  SiRNA target sequence
gttctgcgaggatatgatctg

SEQ ID NO: 56778 - DNA, 21 bp, Artificial sequence
  SiRNA target sequence
ttctgcgaggatatgatctga

SEQ ID NO: 56779 - DNA, 21 bp, Artificial sequence
  SiRNA target sequence
tctgcgaggatatgatctgag

SEQ ID NO: 56780 - DNA, 21 bp, Artificial sequence
  SiRNA target sequence
ctgcgaggatatgatctgagg

SEQ ID NO: 56781 - DNA, 21 bp, Artificial sequence
  SiRNA target sequence
tgcgaggatatgatctgagga

SEQ ID NO: 56782 - DNA, 21 bp, Artificial sequence
  SiRNA target sequence
gcgaggatatgatctgaggat

SEQ ID NO: 56783 - DNA, 21 bp, Artificial sequence
  SiRNA target sequence
cgaggatatgatctgaggatg

SEQ ID NO: 56784 - DNA, 21 bp, Artificial sequence
  SiRNA target sequence
gaggatatgatctgaggatga

SEQ ID NO: 56785 - DNA, 21 bp, Artificial sequence
  SiRNA target sequence
aggatatgatctgaggatgat

SEQ ID NO: 56786 - DNA, 21 bp, Artificial sequence
  SiRNA target sequence
ggatatgatctgaggatgata

SEQ ID NO: 56787 - DNA, 21 bp, Artificial sequence
  SiRNA target sequence
gatatgatctgaggatgataa

SEQ ID NO: 56788 - DNA, 21 bp, Artificial sequence
  SiRNA target sequence
atatgatctgaggatgataat

SEQ ID NO: 56789 - DNA, 21 bp, Artificial sequence
  SiRNA target sequence
tatgatctgaggatgataata

SEQ ID NO: 56790 - DNA, 21 bp, Artificial sequence
  SiRNA target sequence
atgatctgaggatgataatag

SEQ ID NO: 56791 - DNA, 21 bp, Artificial sequence
  SiRNA target sequence
tgatctgaggatgataatagt

SEQ ID NO: 56792 - DNA, 21 bp, Artificial sequence
  SiRNA target sequence
gatctgaggatgataatagtg

SEQ ID NO: 56793 - DNA, 21 bp, Artificial sequence
  SiRNA target sequence
atctgaggatgataatagtgg

SEQ ID NO: 56794 - DNA, 21 bp, Artificial sequence
  SiRNA target sequence
tctgaggatgataatagtggt

SEQ ID NO: 56795 - DNA, 21 bp, Artificial sequence
  SiRNA target sequence
ctgaggatgataatagtggtg

SEQ ID NO: 56796 - DNA, 21 bp, Artificial sequence
  SiRNA target sequence
tgaggatgataatagtggtgc

SEQ ID NO: 56797 - DNA, 21 bp, Artificial sequence
  SiRNA target sequence
gaggatgataatagtggtgca

SEQ ID NO: 56798 - DNA, 21 bp, Artificial sequence
  SiRNA target sequence
aggatgataatagtggtgcat

SEQ ID NO: 56799 - DNA, 21 bp, Artificial sequence
  SiRNA target sequence
ggatgataatagtggtgcatg

SEQ ID NO: 56800 - DNA, 21 bp, Artificial sequence
  SiRNA target sequence
gatgataatagtggtgcatgg

SEQ ID NO: 56801 - DNA, 21 bp, Artificial sequence
  SiRNA target sequence
atgataatagtggtgcatggc

SEQ ID NO: 56802 - DNA, 21 bp, Artificial sequence
  SiRNA target sequence
tgataatagtggtgcatggcc

SEQ ID NO: 56803 - DNA, 21 bp, Artificial sequence
  SiRNA target sequence
gataatagtggtgcatggccg

SEQ ID NO: 56804 - DNA, 21 bp, Artificial sequence
  SiRNA target sequence
ataatagtggtgcatggccgt

SEQ ID NO: 56805 - DNA, 21 bp, Artificial sequence
  SiRNA target sequence
taatagtggtgcatggccgtt

SEQ ID NO: 56806 - DNA, 21 bp, Artificial sequence
  SiRNA target sequence
aatagtggtgcatggccgttt

SEQ ID NO: 56807 - DNA, 21 bp, Artificial sequence
  SiRNA target sequence
atagtggtgcatggccgtttt

SEQ ID NO: 56808 - DNA, 21 bp, Artificial sequence
  SiRNA target sequence
tagtggtgcatggccgttttc

SEQ ID NO: 56809 - DNA, 21 bp, Artificial sequence
  SiRNA target sequence
agtggtgcatggccgttttca

SEQ ID NO: 56810 - DNA, 21 bp, Artificial sequence
  SiRNA target sequence
gtggtgcatggccgttttcaa

SEQ ID NO: 56811 - DNA, 21 bp, Artificial sequence
  SiRNA target sequence
tggtgcatggccgttttcaat

SEQ ID NO: 56812 - DNA, 21 bp, Artificial sequence
  SiRNA target sequence
ggtgcatggccgttttcaatg

SEQ ID NO: 56813 - DNA, 21 bp, Artificial sequence
  SiRNA target sequence
gtgcatggccgttttcaatgg

SEQ ID NO: 56814 - DNA, 21 bp, Artificial sequence
  SiRNA target sequence
tgcatggccgttttcaatgga

SEQ ID NO: 56815 - DNA, 21 bp, Artificial sequence
  SiRNA target sequence
gcatggccgttttcaatggat

SEQ ID NO: 56816 - DNA, 21 bp, Artificial sequence
  SiRNA target sequence
catggccgttttcaatggatg

SEQ ID NO: 56817 - DNA, 21 bp, Artificial sequence
  SiRNA target sequence
atggccgttttcaatggatgc

SEQ ID NO: 56818 - DNA, 21 bp, Artificial sequence
  SiRNA target sequence
tggccgttttcaatggatgct

SEQ ID NO: 56819 - DNA, 21 bp, Artificial sequence
  SiRNA target sequence
ggccgttttcaatggatgctg

SEQ ID NO: 56820 - DNA, 21 bp, Artificial sequence
  SiRNA target sequence
gccgttttcaatggatgctgt

SEQ ID NO: 56821 - DNA, 21 bp, Artificial sequence
  SiRNA target sequence
ccgttttcaatggatgctgtg

SEQ ID NO: 56822 - DNA, 21 bp, Artificial sequence
  SiRNA target sequence
cgttttcaatggatgctgtga
